US009567581B2

(12) United States Patent
Lee et al.

(10) Patent No.: US 9,567,581 B2
(45) Date of Patent: Feb. 14, 2017

(54) SELECTIVE REACTIVATION OF GENES ON THE INACTIVE X CHROMOSOME

(71) Applicant: The General Hospital Corporation, Boston, MA (US)

(72) Inventors: Jeannie T. Lee, Boston, MA (US); Stefan Pinter, Cambridge, MA (US); Ruslan Sadreyev, Brookline, MA (US); Barry Kesner, Charlestown, MA (US)

(73) Assignee: The General Hospital Corporation, Boston, MA (US)

( * ) Notice: Subject to any disclaimer, the term of this patent is extended or adjusted under 35 U.S.C. 154(b) by 0 days.

(21) Appl. No.: 14/419,763

(22) PCT Filed: Aug. 7, 2013

(86) PCT No.: PCT/US2013/053948
§ 371 (c)(1),
(2) Date: Feb. 5, 2015

(87) PCT Pub. No.: WO2014/025887
PCT Pub. Date: Feb. 13, 2014

(65) Prior Publication Data
US 2015/0225717 A1 Aug. 13, 2015

Related U.S. Application Data

(60) Provisional application No. 61/680,616, filed on Aug. 7, 2012.

(51) Int. Cl.
A61K 48/00 (2006.01)
C12N 15/113 (2010.01)
C07H 21/00 (2006.01)
C07H 21/04 (2006.01)
C12N 15/11 (2006.01)

(52) U.S. Cl.
CPC ............. *C12N 15/113* (2013.01); *C07H 21/00* (2013.01); *C07H 21/04* (2013.01); *C12N 15/111* (2013.01); *C12N 2310/11* (2013.01); *C12N 2310/113* (2013.01); *C12N 2310/14* (2013.01); *C12N 2310/315* (2013.01); *C12N 2310/321* (2013.01); *C12N 2310/3231* (2013.01); *C12N 2310/341* (2013.01); *C12N 2310/3533* (2013.01); *C12N 2320/30* (2013.01)

(58) Field of Classification Search
CPC .................................................... A61K 48/00
See application file for complete search history.

(56) References Cited

FOREIGN PATENT DOCUMENTS

| WO | 2012/065143 | 5/2012 |
|---|---|---|
| WO | WO 2012/087983 | 6/2012 |
| WO | WO 2013/173608 | 11/2013 |

OTHER PUBLICATIONS

Zahnow et al. (Molecular Cell 39; Sep. 2010: 661-663).*
Grant et al., "Activation of the hprt gene on the inactive X chromosome in transformed diploid female Chinese hamster cells." Journal of Cell Science, 1989, 92, pp. 723-732.
International Search Report and Written Opinion dated Nov. 28, 2103 in international application No. PCT/US2013/053948, 6 pgs.
Bailey et al., "MEME: discovering and analyzing DNA and protein sequence motifs," Nucleic Acids Res. 2006, 34:W369-W373.
Bailey et al., "Molecular evidence for a relationship between LINE-1 elements and X chromosome inactivation: The Lyon repeat hypothesis," Proc Natl Acad Sci, Jun. 2000, 97: 6634-6639.
Barr and Moore, "Chromosomes, sex chromatin, and cancer," Proc. Can. Cancer Conf., 1957, 2:3-16.
Barski et al., "High-resolution profiling of histone methylations in the human genome," Cell, May 2007, 129:823-837.
Beletskii et al., "PNA interference mapping demonstrates functional domains in the noncoding RNA Xist," Proc. Natl. Acad. Sci., Jul. 2001, 98:9215-9220.
Berletch et al., "Escape from X inactivation in mice and humans," Genome Biol., 2010, 11:213.
Bernstein et al., "A bivalent chromatin structure marks key developmental genes in embryonic stem cells," Cell, Apr. 2006, 125:315-326.
Borah et al., "Further studies on the prognostic importance of Barr body frequency in human breast cancer: with discussion on its probable mechanism," J. Surg. Oncol., 1980, 13:1-7.
Boyer et al., "Polycomb complexes repress developmental regulators in murine embryonic stem cells," Nature, 2006, 441:349-353.
Brockdorff et al., "The product of the mouse Xist gene is a 15 kb inactive X-specific transcript containing no conserved ORF and located in the nucleus," Cell, Oct. 1992, 71:515-526.
Brown et al., "The human XIST gene: analysis of a 17 kb inactive X-specific RNA that contains conserved repeats and is highly localized within the nucleus," Cell, Oct. 1992, 71:527-542.
Camargo and Wang, "Cytogenetic evidence for the absence of an inactivated X chromosome in a human female (XX) breast carcinoma cell line," Hum. Genet., 1980, 55:81-5.
Cantrell et al., "X chromosome inactivation and Xist evolution in a rodent lacking LINE-1 activity," PLoS One, Jul. 2009, 4(7):e6252.
Carrel et al., "X-inactivation profile reveals extensive variability in X-linked gene expression in females," Nature, Mar. 2005, 434:400-404.
Chow et al., "LINE-1 activity in facultative heterochromatin formation during X chromosome inactivation," Cell, Jun. 2010, 141:956-969.
Chow et al., "Silencing of the mammalian X chromosome," Annual Review of Genomics and Human Genetics, Sep. 2005, 6:69-92.
Chureau et al., "Ftx is a non-coding RNA which affects Xist expression and chromatin structure within the X-inactivation center region," Hum Mol Genet, 2011, 20:705-718.
Clemson et al., "XIST RNA paints the inactive X chromosome at interphase: evidence for a novel RNA involved in nuclear/chromosome structure," J Cell Biol., Feb. 1996, 132:259-275.
Dinger et al., "NRED: a database of long noncoding RNA expression," Nucleic Acids Res., 2009, 37:D122-D126.
Dutrillaux et al., "Imbalance of sex chromosomes, with gain of early-replicating X, in human solid tumors," Int. J. Cancer, Oct. 1986, 38:475-9.
Engstrom et al., "Complex Loci in Human and Mouse Genomes," PLoS Genet., Apr. 2006, 2:e47.
(Continued)

*Primary Examiner* — Kimberly Chong
(74) *Attorney, Agent, or Firm* — Fish & Richardson P.C.

(57) ABSTRACT

Methods and compositions for selectively reactivating genes on the inactive X chromosome (Xi) in a locus-specific manner, e.g., genes associated with X-linked diseases, e.g., Rett Syndrome, Factor VIII or IX deficiency, Fragile X Syndrome, Duchenne muscular dystrophy, and PNH, in heterozygous females.

34 Claims, 24 Drawing Sheets

(56) References Cited

OTHER PUBLICATIONS

Falls et al., "Genomic Imprinting: Implications for Human Disease," Am. J. Pathol., Mar. 1999, 154:635-647.
Ganesan et al., "Abnormalities of the Inactive X Chromosome are a Common Feature of BRCA1 Mutant and Sporadic Basal-like Breast Cancer," Cold Spring Harb Symp Quant Biol., 2005, 70:93-7.
Gartler et al., "Mammalian X-chromosome inactivation," Annu Rev Genet, 1983, 17:155-190.
Germain, "Chapter 7: General aspects of X-linked diseases" in Fabry Disease: Perspectives from 5 Years of FOS. Mehta A, Beck M, Sunder-Plassmann G, editors. (Oxford: Oxford PharmaGenesis; 2006), 7 pages.
Ghosh and Shah, "Probable mechanism for the loss of Barr body in human female tumor with special reference to breast cancer," Med Hypotheses, Aug. 1981, 7:1099-104.
Ghosh and Shah, "Significance of the Barr body in human female tumors," Cancer Genet. Cytogenet., Nov. 1981, 4:269-74.
Ghosh et al., "Barr body frequency in esophageal cancer in Indian women," Acta. Cytol., 1983, 27:202-3.
Greenfield et al., "The UTX gene escapes X inactivation in mice and humans," Hum. Mol. Genet., 1998, 7:737-742.
Guttman et al., "Chromatin signature reveals over a thousand highly conserved large non-coding RNAs in mammals," Nature, Mar. 2009, 458(7235):223-7.
Guy et al., "Reversal of Neurological Defects in a Mouse Model of Rett Syndrome," Science, Feb. 2007, 315(5815):1143-7.
Hall, "Genomic imprinting: nature and clinical relevance," Annu. Rev. Med., 1997, 48:35-44.
Hasegawa et al., "The matrix protein hnRNP U is required for chromosomal localization of Xist RNA," Dev Cell, Sep. 2010, 19:469-476.
Helbig et al., "Scaffold attachment factor A (SAFA) is concentrated in inactive X chromosome territories through its RGG domain," Chromosoma, Dec. 2003, 112:173-182.
Huang et al., "Relationship of XIST Expression and Responses of Ovarian Cancer to Chemotherapy," Mol. Cancer Ther., Aug. 2002, 1:769-776.
International Preliminary Report on Patentability in International application No. PCT/US2013/053948, dated Feb. 10, 2015, 6 pages.
Jeon et al., "YY1 tethers Xist RNA to the inactive X nucleation center," Cell, Jul. 2011, 146:119-133.
Jia et al., "Genome-wide computational identification and manual annotation of human long noncoding RNA genes," RNA, 2010, 16(8):1478-1487.
Johnston et al., "Enox, a novel gene that maps 10 kb upstream of Xist and partially escapes X inactivation," Genomics, 2002, 80:236-244.
Kanhere et al., "Short RNAs are Transcribed from Repressed Polycomb Target Genes and Interact with Polycomb Repressive Complex-2," Molecular Cell, Jun. 2010, 38:675-688.
Kawakami et al., "Characterization of loss-of-inactive X in Klinefelter syndrome and female-derived cancer cells," Oncogene, 2004, 23:6163-6169.
Kawakami et al., "The roles of supernumerical X chromosomes and XIST expression in testicular germ cell tumors," J. Urol., Apr. 2003, 169:1546-52.
Kawakami et al., "XIST unmethylated DNA fragments in male-derived plasma as a tumour marker for testicular cancer," Lancet, Jan. 2004, 363:40-2.
Keane et al., "Mouse genomic variation and its effect on phenotypes and gene regulation," Nature, Sep. 2011, 477:289-294.
Khalil et al., "Many human large intergenic noncoding RNAs associate with chromatin-modifying complexes and affect gene expression," PNAS, Jul. 2009, 106(28):11675-11680.
Ku et al., "Genomewide analysis of PRC1 and PRC2 occupancy identifies two classes of bivalent domains," PLoS Genet., 2008, 4:e1000242.
Lalande, "Parental imprinting and human disease," Annu. Rev. Genet., 1996, 30:173-195.

Lee et al., "Chromatin immunoprecipitation and microarray-based analysis of protein location," Nat. Protoc., 2006, 1:729-748.
Lee et al., "Tsix, a gene antisense to Xist at the X-inactivation centre," Nat. Genet., Apr. 1999, 21:400-404.
Lee, "Gracefully ageing at 50, X-chromosome inactivation becomes a paradigm for RNA and chromatin control," Nat. Rev. Mol. Cell Biol., Dec. 2011, 12:815-826.
Liao et al., "Novel perspective: focusing on the X chromosome in reproductive cancers," Cancer Invest., 2003, 21:641-58.
Lipovich et al., "MacroRNA underdogs in a microRNA world: Evolutionary, regulatory, and biomedical significance of mammalian long non-protein-coding RNA," Biochim Biophys Acta., Sep. 2010, 1799(9):597-615.
Luo et al., "Transcriptomic and Genomic Analysis of Human Hepatocellular Carcinomas and Hepatoblastomas," Hepatology., Oct. 2006, 44(4):1012-24.
Lyon, "Imprinting and X-chromosome inactivation," Results Probl. Cell Differ., 1999, 25:73-90.
Lyon, "LINE-1 elements and X chromosome inactivation: a function for "junk" DNA?" Proc Natl Acad Sci., Jun. 2000, 97:6248-6249.
Lyon, "X-chromosome inactivation and human genetic disease," Acta. Paediatr. Suppl., 2002, 91(439):107-12.
Marks et al., "High-resolution analysis of epigenetic changes associated with X inactivation," Genome Res., 2009, 19:1361-1373.
Mikkelsen et al., "Genome-wide maps of chromatin state in pluripotent and lineage-committed cells," Nature, Aug. 2007, 448:553-560.
Moore and Barr, "The Sex Chromatin in Benign Tumours and Related Conditions in Man," Br. J. Cancer, Jun. 1955, 9:246-52.
Moore and Barr, "The sex chromatin in human malignant tissues," Br. J. Cancer, Sep. 1957, 11:384-90.
Moore et al., "The sex chromatin of the bovine freemartin," J Exp. Zool., Jun. 1957, 135:101-25.
Namekawa et al., "Two-step imprinted X inactivation: repeat versus genic silencing in the mouse," Mol. Cell Biol., Jul. 2010, 30:3187-3205.
Numata et al., "Comparative analysis of cis-encoded antisense RNAs in eukaryotes," Gene, May 2007, 392:134-141.
Numata et al., "Identification of novel endogenous antisense transcripts by DNA microarray analysis targeting complementary strand of annotated genes," BMC Genomics, Aug. 2009, 10:392.
Ogawa et al., "Intersection of the RNA interference and X-inactivation pathways," Science, Jun. 2008, 320:1336-1341.
Okada et al., "Comparative expression analysis uncovers novel features of endogenous antisense transcription," Hum. Mol. Genet., 2008, 17(11):1631-40.
Ørom et al., "Long Noncoding RNAs with Enhancer-like Function in Human Cells," Cell, Oct. 2010, 143(1):46-58.
Pandey et al., "Kcnq1ot1 antisense noncoding RNA mediates lineage-specific transcriptional silencing through chromatin-level regulation," Mol. Cell., Oct. 2008, 32(2):232-46.
Payer et al., "X chromosome dosage compensation: how mammals keep the balance," Annu. Rev. Genet., Sep. 2008, 42:733-772.
Pedersen et al., "Identification and Classification of Conserved RNA Secondary Structures in the Human Genome," PLoS Computat. Biol., Apr. 2006, 2(4):e33.
Plath et al., "Role of histone H3 lysine 27 methylation in X inactivation," Science, Apr. 2003, 300:131-135.
Plenge et al., "Skewed X-Chromosome Inactivation is a Common Feature of X-Linked Mental Retardation Disorders," Am. J. Hum. Genet., 2002, 71:168-173.
Ponting et al., "Evolution and Functions of Long Noncoding RNAs," Cell, Feb. 2009, 136(4):629-641.
Pullirsch et al., "The Trithorax group protein Ash2l and Saf-A are recruited to the inactive X chromosome at the onset of stable X inactivation," Development, Jan. 2010, 137:935-943.
Reinius et al., "Female-biased expression of long non-coding RNAs in domains that escape X-inactivation inactivation in mouse," BMC Genomics, 2010, 11:614.
Rosen et al., "Barr Body Distribution and Estrogen Receptor Protein in Mammary Carcinoma," Ann. Clin. Lab Sci., 1977, 7:491-9.

(56) References Cited

OTHER PUBLICATIONS

Rosok and Sioud, "Systematic identification of sense-antisense transcripts in mammalian cells," Nat Biotechnol. Jan. 2004, 22(1):104-8.
Seila et al., "Divergent Transcription from Active Promoters," Science, Dec. 2008, 322(5909):1849-51.
Silva et al., "Establishment of histone h3 methylation on the inactive X chromosome 5 requires transient recruitment of Eed-Enx1 polycomb group complexes," Dev. Cell, Apr. 2003, 4:481-495.
Simon and Kingston, "Mechanisms of polycomb gene silencing: knowns and unknowns," Nat. Rev. Mol. Cell Biol., Oct. 2009, 10:697-708.
Sirchia et al., "Loss of the Inactive X Chromosome and Replication of the Active X in BRCA1-Defective and Wild-type Breast Cancer Cells," Cancer Res., Mar. 2005, 65:2139-2146.
Spatz et al., "X-Chromosome Genetics and Human Cancer," Nat. Rev. Cancer, Aug. 2004, 4:617-29.
Splinter et al., "The inactive X chromosome adopts a unique three-dimensional conformation that is dependent on Xist RNA," Genes Dev., 2011, 25:1371-1383.
Tavares, "On the sex of cancer and teratomata cells," Lancet, May 1955, 268:948-9.
Tavares, "Sex chromatin in tumor cells," Acta Cytol., 1962, 6:90-4.
Tavares, "Sex chromatin in tumors," Medico (Porto), Jan. 1961, 12:97-100 (with English summary).
Tian et al., "The long noncoding RNA, Jpx, is a molecular switch for Xchromosome Inactivation," Cell, Oct. 2010, 143(3):390-403.
Torarinsson et al., "Thousands of corresponding human and mouse genomic regions unalignable in primary sequence contain common RNA structure," Genome Res., Jul. 2006, 16(7):885-889.
Tsai et al., "Long Noncoding RNA as Modular Scaffold of Histone Modification Complexes," Science, Aug. 2010, 329(5992):689-93.
Van den Veyver, "Skewed X Inactivation in X-Linked Disorders," Semin Reprod. Med., 2001, 19(2):183-91.
Wang et al., "Evidence of influence of genomic DNA sequence on human X chromosome inactivation," PLoS Comput. Biol., Sep. 2006, 2:e113.
Wang et al., "Two identical active X chromosomes in human mammary carcinoma cells," Cancer Genet. Cytogenet. Jun. 1990, 46:271-80.
Washietl et al., "Fast and reliable prediction of noncoding RNAs," Proc. Natl. Acad. Sci. USA, Feb. 2005, 102(7):2454-9.
Washietl et al., "Mapping of conserved RNA secondary structures predicts thousands of functional noncoding RNAs in the human genome," Nat. Biotechnol., Nov. 2005, 23(11):1383-90.
Wutz and Gribnau, "X inactivation Xplained," Curr. Opin. Genet. Dev., 2007. 17:387-393.
Yang et al., "Global survey of escape from X inactivation by RNA-sequencing in mouse," Genome Res., 2010, 20:614-622.
Yap et al., "Molecular Interplay of the Noncoding RNA ANRIL and Methylated Histone H3 Lysine 27 by Polycomb CBX7 in Transcriptional Silencing of INK4a," Mol. Cell, Jun. 2010, 38(5):662-74.
Yildirim et al., "Xist RNA is a Potent Suppressor of Hematologic Cancer in Mice," Cell, Feb. 2013, 152:727-742.
Zhang et al., "NATsDB: Natural Antisense Transcripts DataBase," Nucl. Acids Res., Nov. 2006, 35:D156-D161.
Zhao et al., "Genome-wide Identification of Polycomb-Associated RNAs by RIP-seq," Molecular Cell, Dec. 2010, 40:939-953.
Zhao et al., "Polycomb proteins targeted by a short repeat RNA to the mouse X chromosome," Science, Oct. 2008, 322:750-756.

\* cited by examiner

SELECTIVE REACTIVATION OF GENES ON THE INACTIVE X CHROMOSOME

CLAIM OF PRIORITY

This application is a U.S. National Phase Application under 35 U.S.C. §371 of International Patent Application No. PCT/US2013/053948, filed on Aug. 7, 2013, which claims the benefit of U.S. Patent Application Ser. No. 61/680,616, filed on Aug. 7, 2012, The entire contents of the foregoing are hereby incorporated by reference herein.

FEDERALLY SPONSORED RESEARCH OR DEVELOPMENT

This invention was made with Government support under Grant No. RO1-GM090278 awarded by the National Institutes of Health. The Government has certain rights in the invention.

TECHNICAL FIELD

This invention relates to methods and compositions for selectively reactivating genes on the inactive X chromosome (Xi), e.g., genes associated with X-linked diseases, e.g., Rett Syndrome, Factor VIII or IX deficiency, Fragile X Syndrome, Duchenne muscular dystrophy, and PNH, in heterozygous females carrying a mutated allele, in addition to a functional wildtype or hypomorphic allele.

BACKGROUND

X chromosome inactivation (XCI) achieves dosage balance in mammals by repressing one of two X chromosomes in females. X-linked diseases occur in females when a defective gene is present on the active X chromosome (Xa). In some cases, a normal, wild type copy of the gene is present on the inactive X chromosome (Xi), and the severity of the disease may depend on the prevalence (skewing) of inactivation of the X chromosome carrying the wild type gene. Reactivating the entire Xi is undesirable as cancers could arise as a result of X-chromosome gene overdosing (Yildirim et al., 2013, Cell 152: 727-742). Locus-specific reactivation of the non-disease silent allele on the Xi would be therapeutic in many cases of X-linked disease, such as Rett Syndrome.

SUMMARY

At least in part, the present invention is based on the discovery that, during XCI, the long noncoding Xist RNA and Polycomb proteins spread along the inactive X (Xi) to initiate chromosome-wide silencing. Although inactivation is known to commence at the X-inactivation center (Xic), how it propagates remains unknown. The present disclosure is based on an examination allele-specific binding of Polycomb repressive complex 2 (PRC2) and chromatin composition during XCI, which was used to generate a chromosome-wide profile of Xi and Xa (active X) at nucleosome-resolution. As described herein, initially, Polycomb proteins are localized to ~150 strong sites along the X and concentrated predominantly within bivalent domains coinciding with CpG islands ("canonical sites"). As XCI proceeds, ~4000 non-canonical sites are recruited, most of which are intergenic, non-bivalent, and lack CpG islands. Non-canonical sites cluster around the ~150 strong sites, and their H3K27me3 levels reflect a graded concentration originating from strong sites. This suggests that PRC2 and H3K27 methylation spread along a gradient unique to XCI. Thus, XCI is governed by a hierarchy of defined Polycomb stations that spread H3K27 methylation in cis.

A vast majority of the strong and moderate sites demonstrate transcription of at least one RNA, many of which are likely to be noncoding. Some overlap the previously described PRC2 transcriptome (Zhao et al., 2010, Molecular Cell; WO 2012/065143; and PCT/US2011/065939), but a large number does not.

Thus, in one aspect the invention provides methods for activating an inactive X-linked allele in a cell of a female heterozygous subject. The methods include administering to the cell an inhibitory oligonucleotide targeting one or more of a strong or moderate PRC2 or EZH2 or SUZ12 binding site as listed in Tables A, IVA-C or XIII-XV; and/or one or more of the transcripts associated with the PRC2 sites, as listed in Tables VI-IX, XVI-XVIII. In some embodiments, both an inhibitory oligonucleotide targeting a strong or moderate PRC2 or EZH2 or SUZ12 binding site, and an inhibitory oligonucleotide targeting a transcript associated with the same PRC2 site are administered.

In another aspect, the invention provides methods for activating an inactive X-linked allele in a cell, preferably a cell of a female heterozygous subject. The methods include administering to the cell one or more of:
(a) an inhibitory oligonucleotide targeting a strong or moderate PRC2 binding site (e.g., EZH2 or SUZ12 binding site, preferably a strong binding site) as listed in Tables A, IVA-C or XIII-XV, i.e., an oligo that is complementary or identical to a region within a strong or moderate PRC2 site, and/or
(b) an inhibitory oligonucleotide targeting (i.e., complementary to) a polycomb-associated RNA (pa-RNA) associated with the X-linked allele, e.g., a paRNA as set forth in Tables VI-IX or XVI-XVIII.

Although the end result is an activation or increase in gene expression, the oligonucleotides described herein are referred to as "inhibitory" because they inhibit the PRC2-mediated gene silencing, either by binding to either strand of the genomic DNA where the PRC2 complex binds (i.e., a strong or moderate site as described herein) and, without wishing to be bound by theory, inhibit binding of the PRC2 complex to that site, or because they bind to a paRNA as described herein and, without wishing to be bound by theory, inhibit the ability of the paRNA to silence the associated gene.

In some embodiments, the inactive X-linked allele is associated with an X-linked disorder, and the oligonucleotide is administered in a therapeutically effective amount.

In some embodiments, the cell is in a living subject.

In some embodiments, the inhibitory oligonucleotide is complementary or identical to at least 8 consecutive nucleotides of one or more of a strong or moderate PRC2 or EZH2 or SUZ12 binding site as listed in TABLES A, IV, XIII-XV; and/or one complementary to at least 8 consecutive nucleotides of one of the transcripts associated with the PRC2 sites, as listed in Tables VI-IX, XVI-XVIII.

In some embodiments, the oligonucleotide does not comprise three or more consecutive guanosine nucleotides. In some embodiments, the oligonucleotide does not comprise four or more consecutive guanosine nucleotides.

In some embodiments, the oligonucleotide is 8 to 30 nucleotides in length.

In some embodiments, at least one nucleotide of the oligonucleotide is a nucleotide analogue.

In some embodiments, at least one nucleotide of the oligonucleotide comprises a 2' O-methyl.

In some embodiments, each nucleotide of the oligonucleotide comprises a 2' O-methyl.

In some embodiments, the oligonucleotide comprises at least one ribonucleotide, at least one deoxyribonucleotide, or at least one bridged nucleotide. In some embodiments, the bridged nucleotide is a LNA nucleotide, a cEt nucleotide or a ENA modified nucleotide.

In some embodiments, each nucleotide of the oligonucleotide is a LNA nucleotide.

In some embodiments, the nucleotides of the oligonucleotide comprise 2'-fluoro-deoxyribonucleotides.

In some embodiments, the nucleotides of the oligonucleotide comprise 2'-O-methyl nucleotides.

In some embodiments, the nucleotides of the oligonucleotide comprise ENA nucleotide analogues.

In some embodiments, the nucleotides of the oligonucleotide comprise LNA nucleotides.

In some embodiments, the nucleotides of the oligonucleotide comprise comprising phosphorothioate internucleotide linkages between at least two nucleotides.

In some embodiments, the nucleotides of the oligonucleotide comprise phosphorothioate as internucleotide linkages between all nucleotides.

In some embodiments, the oligonucleotide is a gapmer or a mixmer.

In some embodiments, the oligonucleotide increases expression of mecp2.

In another aspect, the invention provides inhibitory oligonucleotides that are complementary to at least 8 consecutive nucleotides of one or more of a strong or moderate PRC2/EZH2 or SUZ12 binding site as listed in TABLES A, IV, XII-XV; and/or one or more of the transcripts associated with the PRC2 sites, as listed in Tables VI-IX, XVI-XVIII.

In some embodiments, the oligonucleotide does not comprise three or more consecutive guanosine nucleotides.

In some embodiments, the oligonucleotide does not comprise four or more consecutive guanosine nucleotides.

In some embodiments, the oligonucleotide is 8 to 30 nucleotides in length.

In some embodiments, at least one nucleotide of the oligonucleotide is a nucleotide analogue.

In some embodiments, at least one nucleotide of the oligonucleotide comprises a 2' O-methyl.

In some embodiments, each nucleotide of the oligonucleotide comprises a 2' O-methyl.

In some embodiments, the oligonucleotide comprises at least one ribonucleotide, at least one deoxyribonucleotide, or at least one bridged nucleotide.

In some embodiments, the bridged nucleotide is a LNA nucleotide, a cEt nucleotide or a ENA modified nucleotide.

In some embodiments, each nucleotide of the oligonucleotide is a LNA nucleotide.

In some embodiments, the nucleotides of the oligonucleotide comprise 2'-fluoro-deoxyribonucleotides.

In some embodiments, the nucleotides of the oligonucleotide comprise 2'-O-methyl nucleotides.

In some embodiments, the nucleotides of the oligonucleotide comprise ENA nucleotide analogues.

In some embodiments, the nucleotides of the oligonucleotide comprise LNA nucleotides.

In some embodiments, the nucleotides of the oligonucleotide comprise comprising phosphorothioate internucleotide linkages between at least two nucleotides.

In some embodiments, the nucleotides of the oligonucleotide comprise phosphorothioate internucleotide linkages between all nucleotides.

In some embodiments, the oligonucleotides are gapmers or mixmers.

In some embodiments, the oligonucleotide increases expression of mecp2.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

REFERENCE TO SEQUENCES SUBMITTED ON A COMPACT DISC

This application includes a compact disc containing a sequence listing. The sequence listing is identified on the compact disc as follows.

| Disc | File Name | Date of Creation | size (bytes) |
|---|---|---|---|
| 29539_0067WO1_1 | 29539_0067WO1_ST25.txt | Aug. 7, 2013 | 606,912 KB |

Figure 1A:
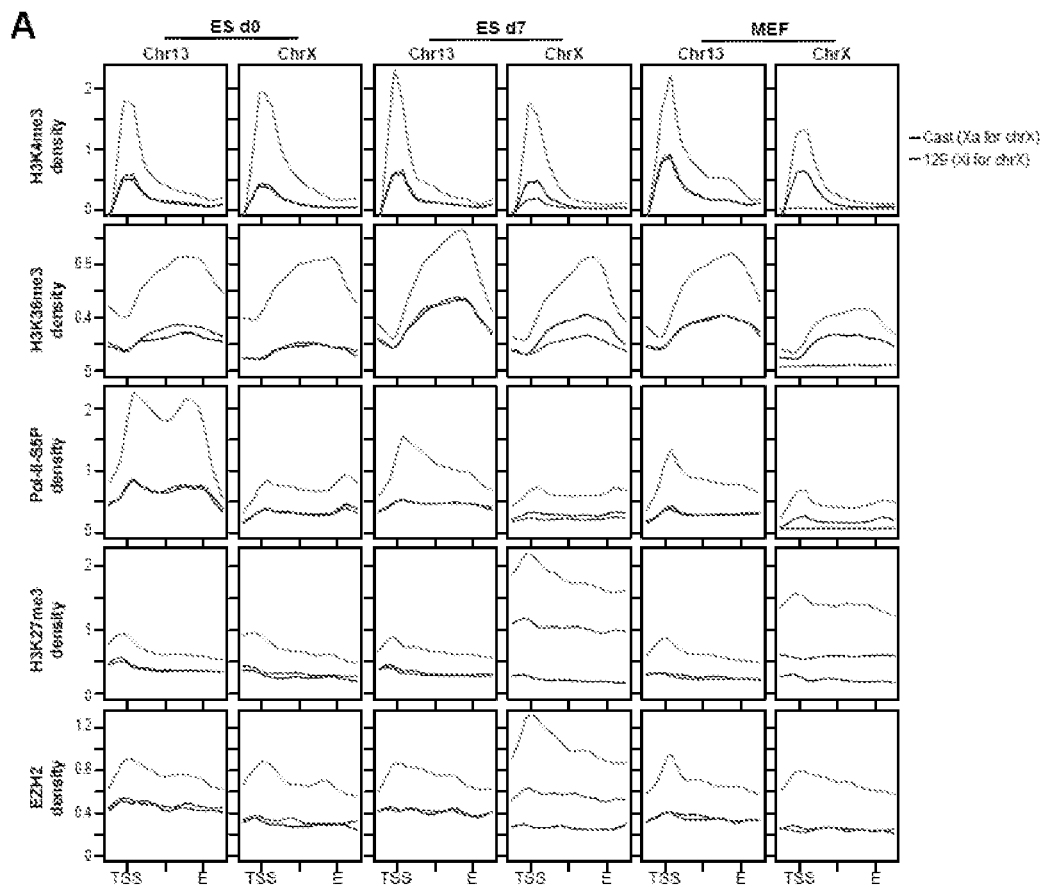
FIG. 1: Allelic Chromatin Profiles of Xa and Xi.

(A) Metagene analysis for chromatin epitopes on Chr13 and ChrX at indicated timepoints. Coverages were averaged over all genes (843 for Chr13, 1007 for ChrX) and scaled from TSS to 3' end, E. Profiles extend 3 kb upstream of TSS and 3 kb downstream of E. Densities were normalized to the average gene coverage over the chromosome.

(B,C) Pearson correlations for pairwise comparisons between epitopes were compared to a permutation-based random model and resulting Z-scores plotted in heatmaps. (B) plots MEF results. (C) plots ES d0 and d7 results. Numerical Z-scores are color-coded and scaled identically for all heatmaps. Yellow-red patches, significant positive correlation; blue patches, significant negative correlation. A white diagonal line separates Cast and 129 results.

FIG. 2: Many Strong EZH2 Sites are Defined Bivalent Domains.

(A) Characteristics of constant, acquired, and lost strong EZH2 sites on d0 and d7. The portion of sites lying within CpG islands is indicated by stripes.

(B) Changes in peak widths, densities (coverage per bp) for EZH2 and H3K27me3 between d0 and d7. Medians (turquoise, Chr13; orange, ChrX), 25-75 percentile (box) and 10-90 percentile (error bars) are shown.

(C) Allelic skewing of strong EZH2 sites. Numbers of sites skewing to Cast (blue) or 129 (red) are shown. Those with significant skewing (p<0.05, norm. approx. of binomial) are shown in darker blue and red. Grey bars, non-polymorphic sites (n/d, not determined).

(D) Summed coverage of EZH2 and H3K27me3 at strong and moderate sites as a percentage of total chromosomal coverage on d0 and d7 (left) and as absolute fold-increase (d7/d0, right).

FIG. 3: Moderate EZH2 Sites are Non-Canonical PRC2 Targets.

(A) Characteristics of moderate EZH2 sites on d0 and d7. The portion of sites overlapping CpG islands is indicated by stripes.

(B) Allelic skewing of moderate EZH2 sites. Numbers of sites skewing to Cast (blue) or 129 (red) are shown. Those with significant skewing (p<0.05, norm. approx. of binomial) are shown in darker blue and red. Grey bars, non-polymorphic sites (n/d, not determined).

(C) Changes in EZH2 and H3K27me3 densities between d0 and d7. Medians (turquoise, Chr13; orange, ChrX), 25-75 percentile (box) and 10-90 percentile (error bars) are shown.

(D) Metasite analysis for strong and moderate sites at indicated timepoints. Coverages were averaged over all strong (ChrX: 56, 147, 50 sites; Chr13: 79, 81, 83 sites for d0, d7 and MEFs) and moderate sites (ChrX: 1618, 4077, 1211 sites; chr13: 1241, 1041, 758 sites for d0, d7 and MEFs) and scaled from start to end. Profiles extend ±20 kb into flanks. Densities were normalized to the average site coverage over the chromosome.

FIG. 4: Relationship of Repetitive Elements to EZH2 Sites.

(A) Repeat classes enriched or depleted in strong sites, ±3 kb flanking strong sites and moderate sites are plotted by their level of enrichment (positive log 2 odds ratio) or depletion (negative). Different timepoints and chromosomes, as marked. Bubble sizes indicate the fraction of sites (Scale: 0.05, 0.2, 0.5, 1.0) containing a given repeat class (if enriched) or lacking it (if depleted). For example, LINE1 sequences are depleted across the board in most sites, hence their bubbles are large. Only statistically significant (Z>2.5) enrichment or depletion is shown (bubble sizes smaller than 0.05 indicate insignificance). The full data are listed in Table II for further reference.

(B-D) Log 2 odds ratios for significant (Z>2.5) enrichment and depletion of specific repeat types at (B) strong sites, (C) flanking (+/−3 kb) strong sites and (D) moderate sites. The full data are listed in Table III for further reference.

Figure 5A:
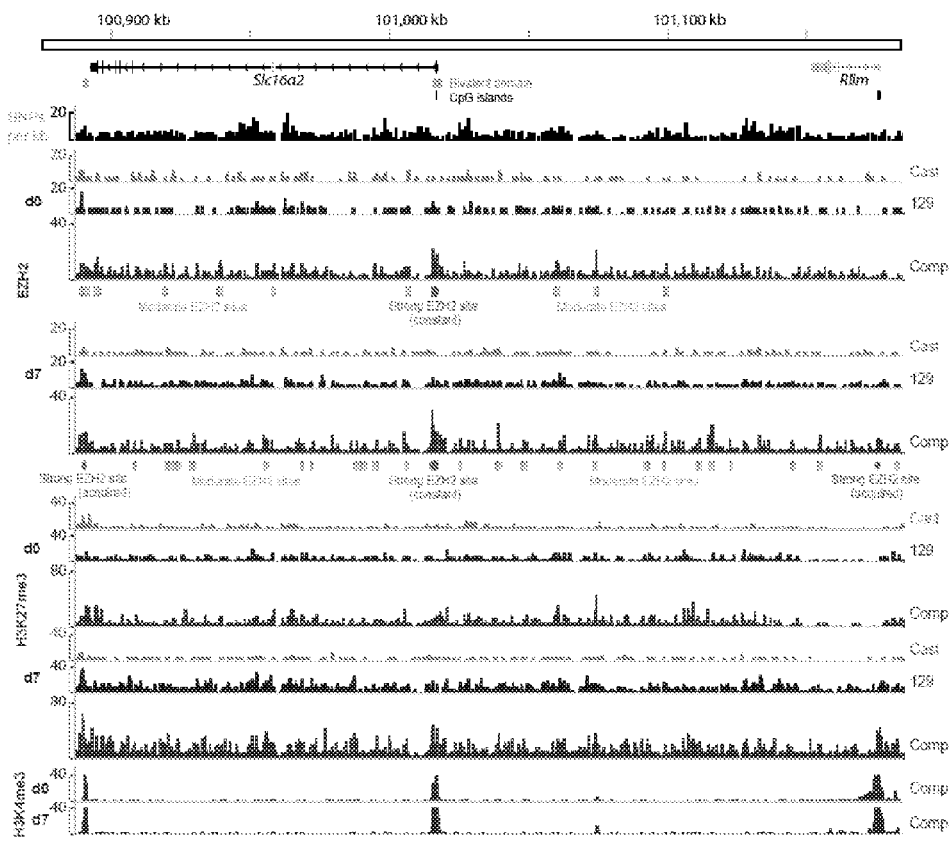

FIG. 5: Developmental Profile of the Slc16a2-Rnf12 Region.

(A) ES d0 and d7 profiles for Slc16a2-Rnf12 region.

(B) Three models for spreading of EZH2.

FIG. 6: Spread of H3K27me3 from EZH2 sites occurs in a distance-dependent manner.

(A) EZH2 and H3K27me3 densities from d0 and d7 were binned over Chr13 and ChrX positions to obtain correlation coefficients and Z scores from a permutation-based random model. Pearson R coefficients are indicated for the correlation of strong/moderate EZH2 sites (orange values) and H3K27me3/moderate EZH2 sites (black values). A purple triangle marks the location of the Xic.

(B,C) Smoothened trendlines of EZH2 (B) or H3K27me3 (C) densities at a given nucleosome-sized window of x-distance from the nearest strong site, on indicated days and chromosomes. Densities are plotted over a sliding 1 kb window with steps of 200 bp.

FIG. 7: A Hierarchy of EZH2 Sites, with Limited EZH2 Translocation and Long-Range H3K27Me3 Gradient.

(A) Smoothened trendlines of EZH2 densities at a moderate (mod) site at given distances (x-axis) from the nearest strong site, on indicated days and chromosomes.

(B) Smoothened trendlines of H3K27me3 densities at a moderate (mod) site at given distances (x-axis) from the nearest strong site, on indicated days and chromosomes. Color-coded triangles denote distance-at-half-maximum for each chromosomal timepoint.

(C) Depiction of the number of moderate (mod) sites at given distances from the nearest strong site on d0 and d7 for Chr13 and ChrX. Scale, bubble sizes represent fractions of 0.2, 0.05 and 0.02 of all mod sites. Each graphed bubble is summed over 40 kb bins. Pearson correlation coefficients (R) and Z scores (Fisher transformed) shown.

(D) Model and summary.

FIG. 8: X Chromosome State and Allelic Ratio in Differentiating ESCs and MEFs.

(A) Percentage of EZH2 and H3K27me3 immunofluorescence stained differentiating ES cells (d4, d7, d10 example images next to bar chart), Xist-RNA FISH and X chromosome paint in MEFs, demonstrating 1:1 state of Xi:Xa.

(B) Relative abundance of input DNA aligning to specific chromosomes normalized solely by chromosome length in d0, d7 and MEFs, demonstrating expected relative abundance near 1 for all samples (not accounting for mapability). Chromosomes 13 and X highlighted by MEF labels (0.98 and 0.84, respectively).

(C) Distribution of input coverage densities over 1 kb in d0, d7 and MEFs in composite (comp), cast and 129 tracks over chr13 (black) and chrX (red), demonstrating lack of right-ward shift expected in case of aneuploidy.

Figure 9:
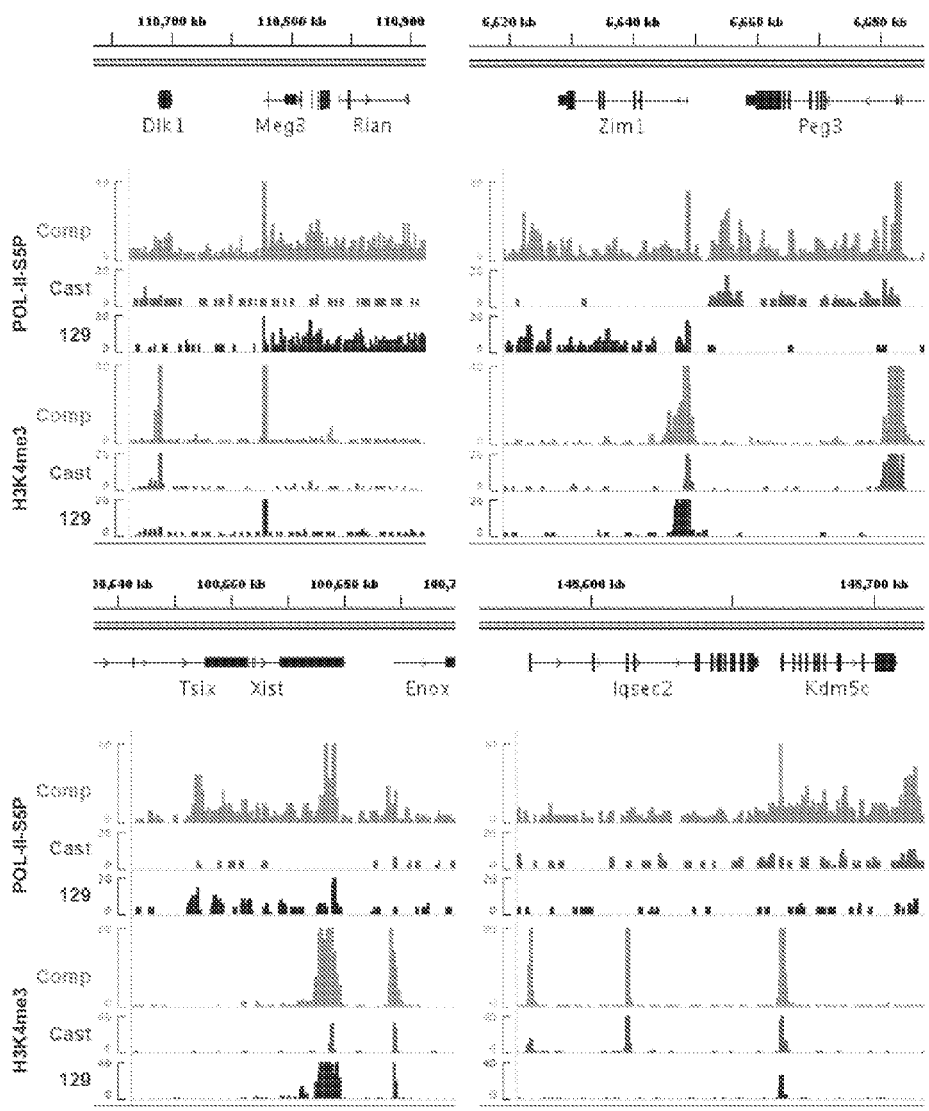

FIG. 9: Allele-Specific ChIP-Seq at Imprinted, Biallelic and X-Linked Loci.

Select ChIP-seq profiles for POL-II-S5P, H3K4me3, H3K27me3, and EZH2 epitopes in MEFs were mapped to Mus castaneus (Cast) or 129 alleles. Comp, composite track (Cast+129+neutral). While composite tracks indicate total epitope abundance, enrichment in the allele-specific tracks is a function of both epitope abundance and SNP density. Input-normalized coverage values are indicated on the y-axis and scaled identically between alleles.

Figures 10A, 10B:
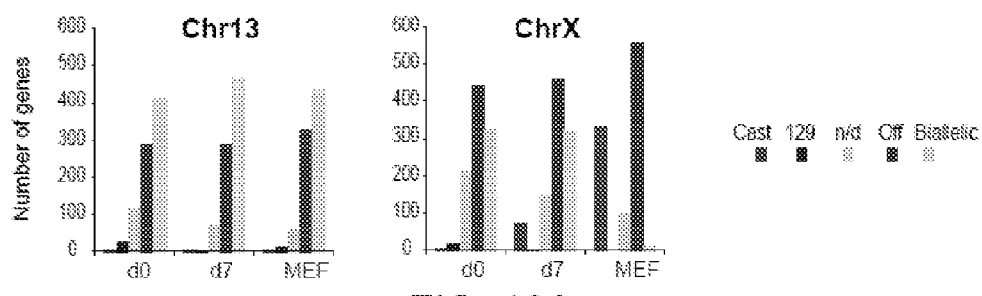
Figure 10C:
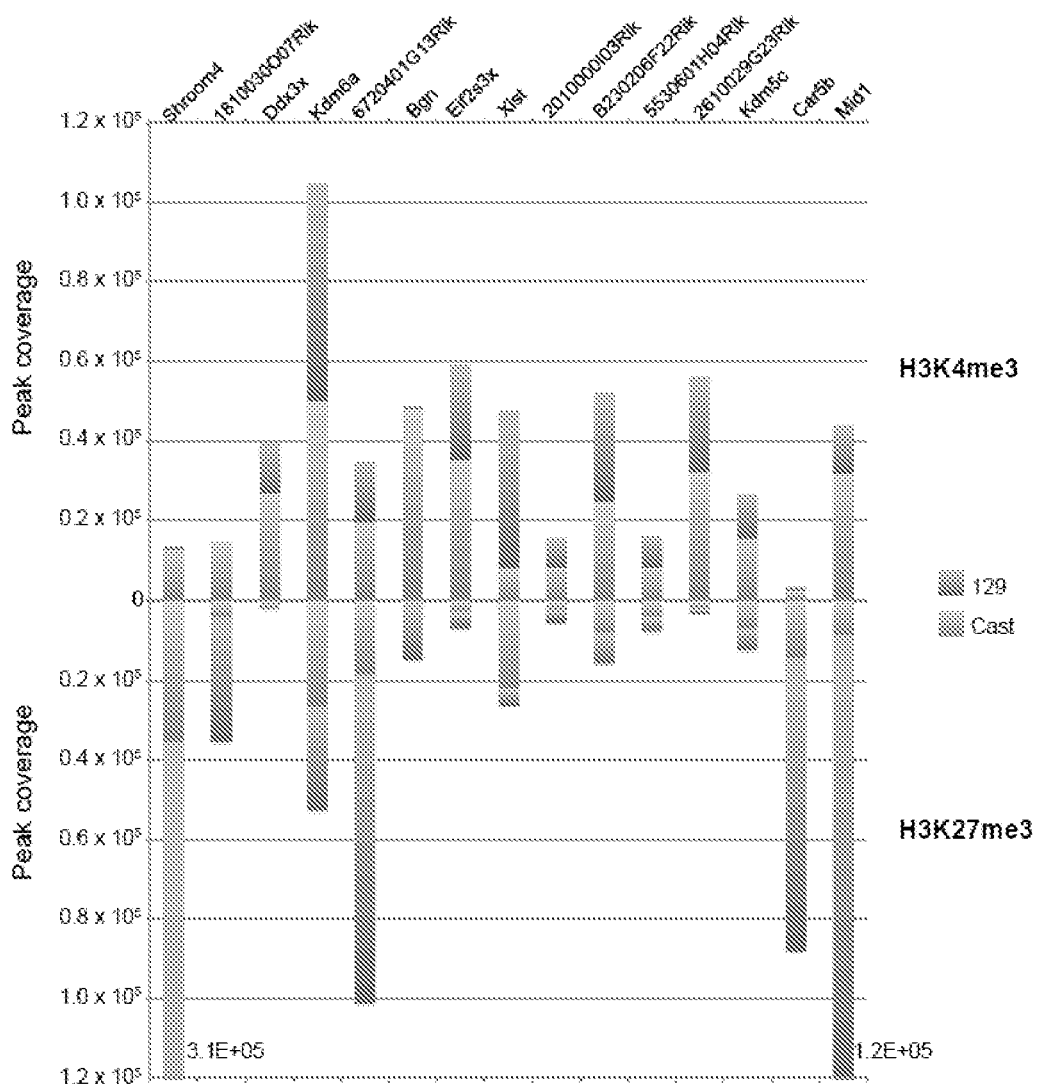

FIG. 10: Genes that Escape XCI.

(A) Classification of Chr13 and ChrX genes according to H3K4me3 status in d0, d7 and MEF, n/d, not determined due to lack of allele-specific polymorphisms. Peaks within 3 kb of an annotated TSS were scored for their allelic skew and significance (p<0.05, norm. approx. of binomial).

(B) Genes that escape XCI are shown with aliases, ChrX coordinates, and allelic skew values ranging 100% Cast to 100% 129 for H3K4me3 ChIP DNA. Composite values (comp) indicate total H3K4me3 coverage. X-linked genes marked with H3K4me3 in MEFs were classified as escapee candidates if allelic skew was not significant (p >0.05, binomial test) and/or had a maximal H3K4me3 coverage of >3000 over a given 1 kb window on the 129 allele. Escapee gene candidates predicted by RNA-seq (Yang et al., 2010) are also included in the table for comparison: 8 genes were identified in both studies (green), 4 specific to Yang et al. (2010)(yellow), and 3 specific to this study (blue).

(C) Allelic (Cast in blue, 129 in red) chromatin states of escapee gene candidates (in MEFs). Peak coverage of active mark H3K4me3 is shown on top, repressive mark H3K27me3 on the bottom (y-axis reversed to improve visualization).

Figure 11A:
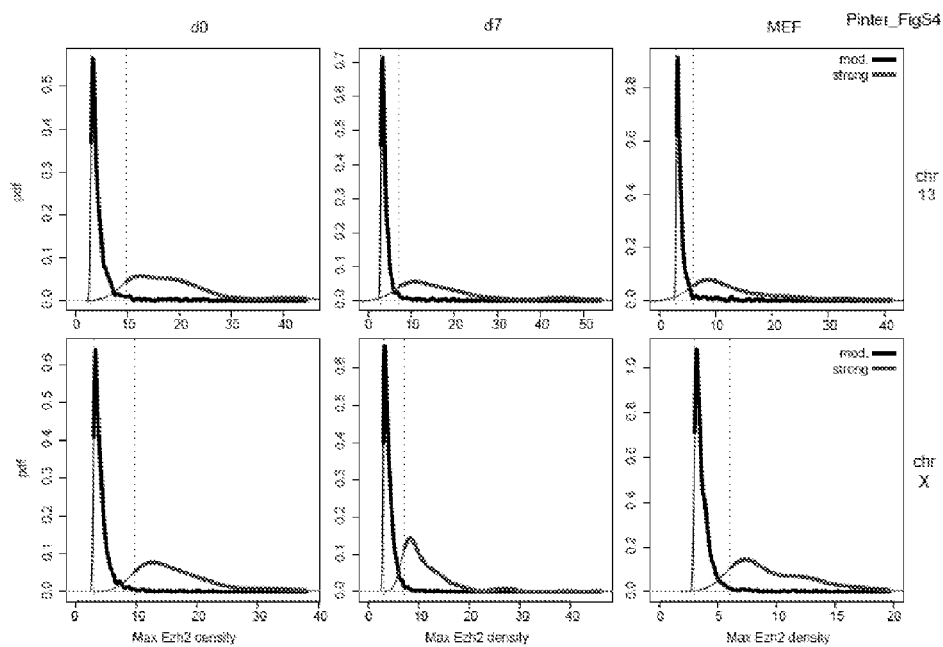
Figure 11B:
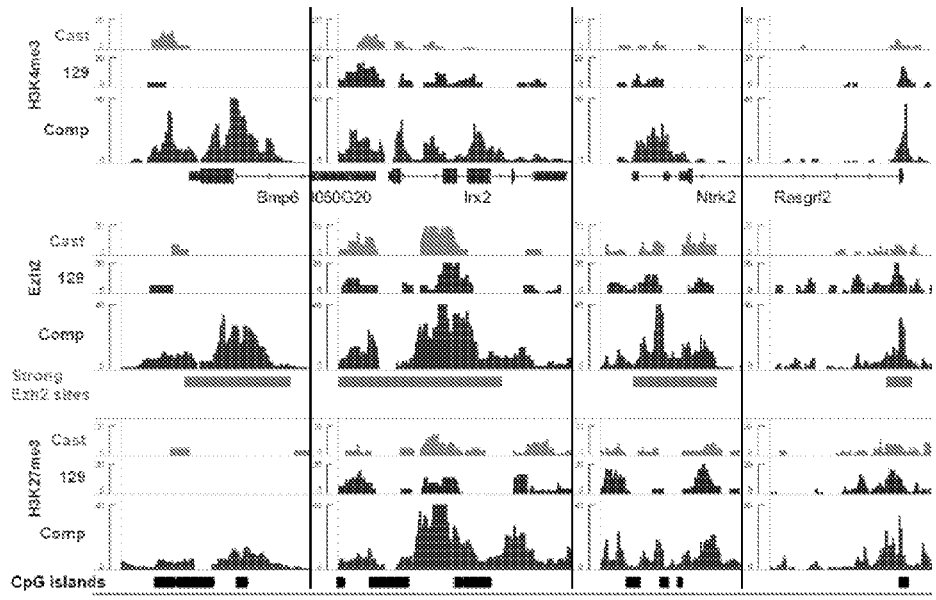

FIG. 11: Comparison of Strong EZH2 Sites.

(A) Distribution (as probability density function (pdf) on y-axis) of maximal EZH2 density (per 1 kb) on strong (red) and moderate (black) EZH2 sites on Chr13 and ChrX in d0, d7 and MEF cells. Two dotted threshold lines indicate the density cutoff for moderate (left) and strong EZH2 sites (right), thick lines indicate density of 1 kb windows that were above these cutoffs in moderate (black) and strong (red) EZH2 sites. Significance threshold ($p<10^{-5}$) for strong EZH2 sites was chosen such that the vast majority of moderate sites were excluded.

(B) Examples of previously identified (Ku, M et al. 2008) EZH2 targets in undifferentiated ES cells (d0) are called in our set of strong EZH2 sites (labeled in pink underneath composite EZH2 track in the middle): Bmp6, Irx2, Ntrk2 and Rasgrf2. All examples are bivalent (H3K4me3 tracks on top, H3K27me3 tracks on bottom) and contain CpG islands (labeled in black, last track).

Figure 12:
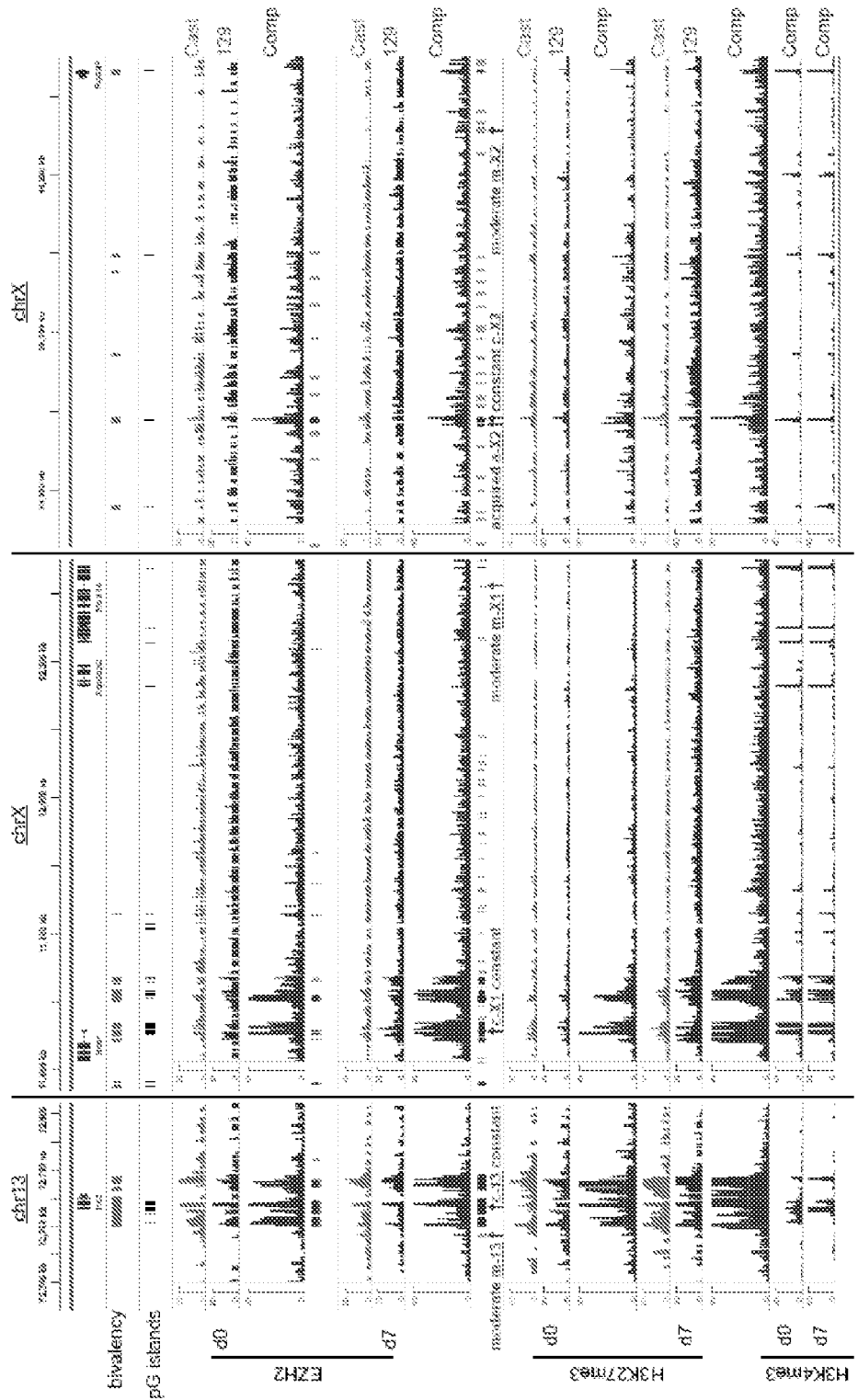

FIG. 12: Loci for Validation of Strong and Moderate EZH2 Sites.

Screenshots of EZH2 and H3K27me3 tracks from loci chosen for validation of strong and moderate EZH2 sites on Chr13 and ChrX. Purple arrows and labels identify sites assayed by allele-specific qPCR in FIG. 13 and include a strong (constant, c-13) and moderate site (m-13) on Chr13, three strong (acquired, a-X2 and constant, c-X1, c-X2) and two moderate sites (m-X1, m-X2) on ChrX.

Figure 13:
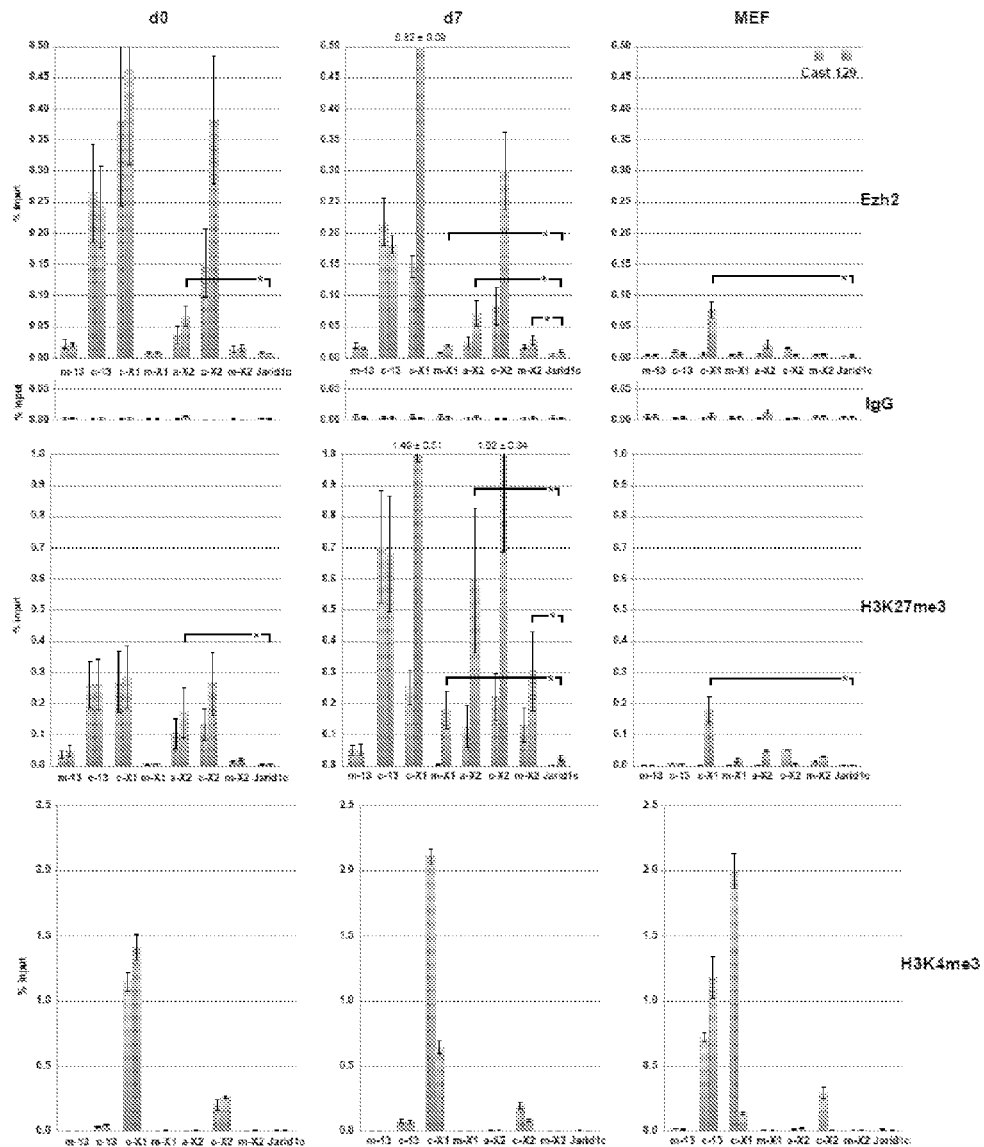

FIG. 13: Allele-Specific qPCR for Validation of Strong and Moderate EZH2 Sites.

Input and chromatin-immunoprecipitated (ChIP) DNA from EZH2, H3K27me3 and IgG ChIPs in d0, d7 and MEF cells (three biological replicates each) was amplified with primer sets (one universal, one allele-specific primer each) to the sites shown in FIG. 12. Error bars indicate standard error of Cast (blue) and 129 (red) means. A representative H3K4me3 ChIP sample was also included with error bars indicating standard error of three technical replicates. Asterisk indicates statistically significant difference ($p<0.05$, one-tailed Mann-Whitney U test) to the 129 signal at negative control locus in the gene body of escapee gene Jaridlc.

Figure 14:
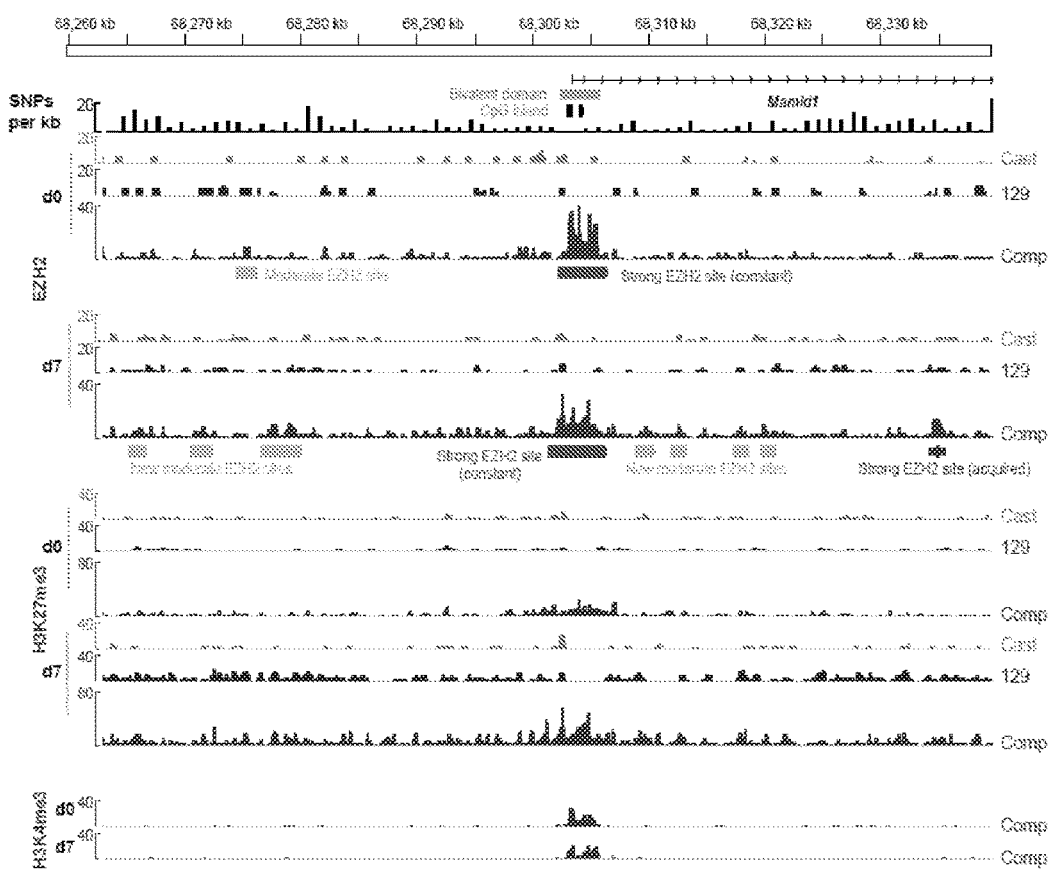

FIG. 14: Strong and Moderate EZH2 Site at the Xic-Distant Site, MamId1.

Screenshot of EZH2, H3K27me3, and H3K4me3 tracks in d0 and d7 cells at Mamid1, approximately 30 Mb from the Xic. As in FIG. 5, strong (constant and acquired) and moderate EZH2 sites are indicated underneath the composite (comp) EZH2 tracks, SNP (and Indel) density per 1 kb window above the epitope tracks.

Figure 15A:
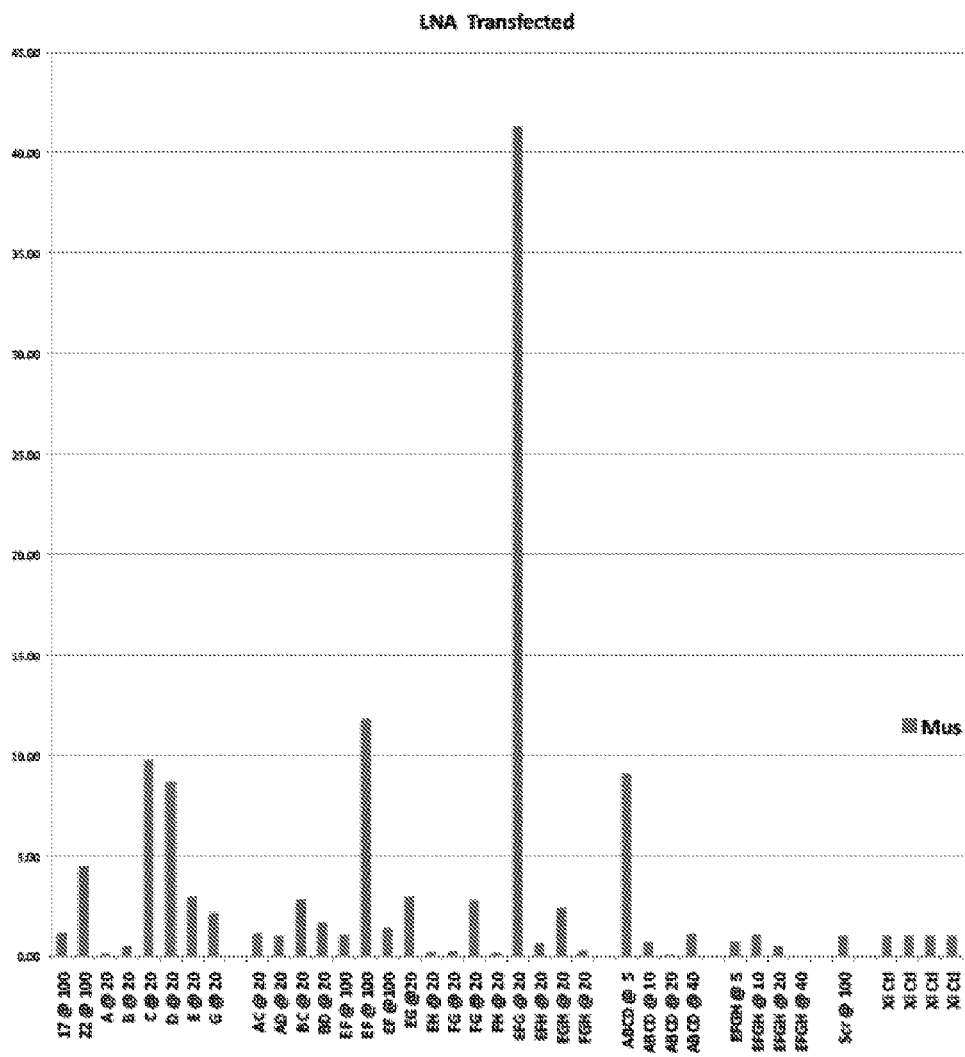
Figure 15B:
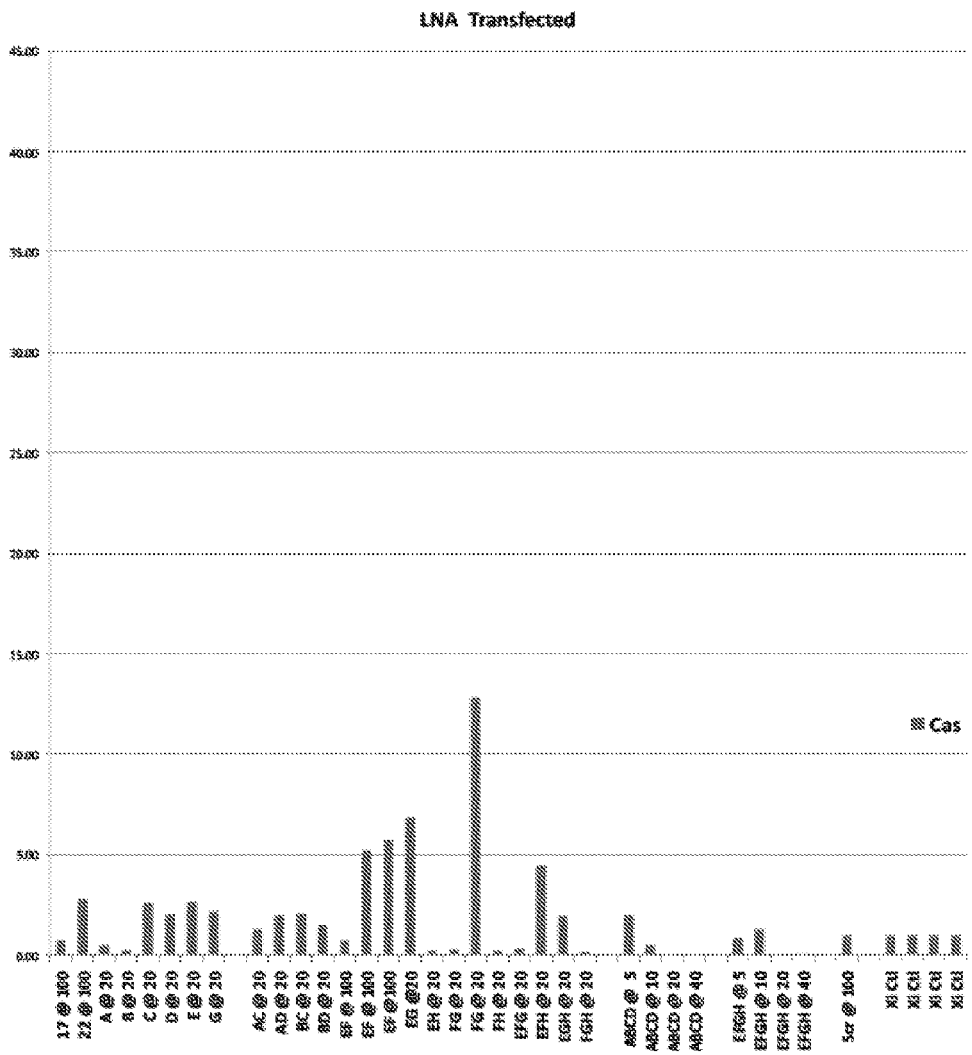

FIGS. 15A-B: Targeting Mecp2-AS or PRC2 Binding Sites Reactivates Expression

Bar graphs showing the results of with the untreated control set to a value of 1.0 and all others normalized to this value. LNA concentrations shown after each oligo in "nM". All values normalized to Gapdh control. Then the level of expression in untreated samples (Xi control, Xi ctrl) was set to a normalized value of 1.0. The results are shown at a single time point, 24 h post-LNA treatment. 15A, expression from the mus (Xi) chromosome; 15B, expression from the Castaneus X (active X), shown at the same scale as 15A.

DETAILED DESCRIPTION

XCI provides an excellent model by which to study Polycomb regulation and the role of long noncoding RNAs (lncRNA) in inducing facultative heterochromatin (Lyon, 1999; Wutz and Gribnau, 2007; Payer and Lee, 2008)(Lee, 2011). XCI is controlled by the X-inactivation center (Xic), an X-linked region that controls the counting of X chromosomes, the mutually exclusive choice of Xa and Xi, and the recruitment and propagation of silencing complexes. The 17-kb Xist RNA initiates the silencing step as it accumulates on the X (Brockdorff et al., 1992; Brown et al., 1992; Clemson et al., 1996). Although recent studies have shown that Xist RNA directly recruits Polycomb repressive complex 2 (PRC2) to the Xi (Zhao et al., 2008) and that loading of the Xist-PRC2 complex occurs first at a YY1-bound nucleation center located within the Xic (Jeon and Lee, 2011), how the silencing complexes spread throughout the X after this obligatory nucleation step remains a major unsolved problem. Because autosomes with ectopic Xic sequences are subject to long-range silencing (Wutz and Gribnau, 2007; Payer and Lee, 2008), it is thought that spreading elements cannot be unique to the X. One hypothesis suggests that repetitive elements of the LINE1 class facilitate spreading (Lyon, 2000). However, this hypothesis has been difficult to test, as linking repeats to locus-specific function has been complicated by their repetitive nature. Some studies have provided correlative evidence (Bailey et al., 2000; Wang et al., 2006; Chow et al., 2010), whereas others find that species lacking active LINE1s nonetheless possess XCI (Cantrell et al., 2009). Other classes of repeats may be more enriched on the X (Chow et al., 2005). Matrix-associated proteins, such as SAF-A/hnRNP-U, have also been proposed to facilitate spreading (Helbig and Fackelmayer, 2003; Hasegawa et al., 2010; Pullirsch et al., 2010), but a direct link has also not been demonstrated.

In general, the identification of spreading elements has been thwarted by the lack of high-throughput approaches that distinguish Xi and Xa at sufficient resolution. Epigenomic studies have primarily focused on male cells (Bernstein et al., 2006; Boyer et al., 2006; Barski et al., 2007; Mikkelsen et al., 2007; Ku et al., 2008), though one recent ChIP-seq analysis with partial allele-specific coverage used female mouse embryonic stem (ES) cells but without addressing PRC2 binding. The reported 1.2-fold enrichment of H3K27me3 on Xi (Marks et al., 2009) is unexpectedly low and at odds with intense cytological H3K27me3 immunostaining (Plath et al., 2003; Silva et al., 2003)—likely caused by low-density polymorphisms between Xi and Xa. As a result, the quest for an Xi chromatin state map and spreading elements has remained unrealized.

In principle, silencing complexes could initially load at the Xic and spread serially from nucleosome to nucleosome. Alternatively, they could spread outwardly via 'way stations' located at defined sites along the X that would anchor and relay silencing complexes (Gartler and Riggs, 1983). To test these models, an allele-specific ChIP-seq strategy was devised that enabled the generation of chromosome-wide developmental profiles at unprecedented allelic resolution. Reported herein is a high-density Xi chromatin state map and identification of discrete Polycomb stations.

A vast majority of the strong and moderate sites demonstrates transcription of at least one RNA, many of which are likely to be noncoding. The PRC2 site-associated RNAs can be noncoding (long noncoding RNA, lncRNA) or occasionally part of a coding mRNA; for simplicity, we will discuss them together as polycomb-associated RNA (paRNA) henceforth. Some overlap the previously described PRC2 transcriptome (Zhao et al., 2010, Molecular Cell; WO 2012/087983 and WO 2012/065143). In ES cells and MEFs, 20-25% of putative mouse paRNAs have not been previously described; and 43-45% those within mouse moderate sites are new.

Each strong site governs on average ~10 X-linked genes, and, without wishing to be bound by theory, it may be from these strong sites that local spreading of silencing occurs via moderate sites to encompass genes within the local domain. There is on average 20-30 moderate sites per strong site. PRC2 is first recruited to the strong sites. They are then passed on to moderate sites locally. Locally acting paRNAs within the moderate sites, in intergenic spaces, or within the genes themselves spread the repression to span the entire local gene cluster. Thus, paRNAs at strong and moderate sites are proposed to serve as cis-acting recruiting centers for PRC2. In some embodiments, the present methods include targeting paRNAs at strong and moderate sites to disrupt spreading or maintenance of inactivation at one or a few X-linked genes under the sphere of influence of the strong and moderate sites. In this manner, specific genes of interest on the inactive X could be reactivated to treat X-linked diseases, when the inactivated X chromosome bears a functional or hypomorphic copy of the gene.

paRNAs and paRNA Libraries

The present invention includes the individual paRNAs described herein, as well as libraries of paRNAs produced by methods described herein. In some embodiments, the paRNAs or libraries are in solution, or are lyophilized. In some embodiments, the libraries are bound to a substrate, e.g., wherein each member of the library is bound to an individually addressable member, e.g., an individual area on an array (e.g., a microarray), or a bead. The PRC2-interacting RNA transcript, although non-coding, may include a protein-coding sequence of bases if it is a distinct transcript that overlaps in position with a protein-coding reference gene (e.g. the gene whose expression is modulated in cis). In some embodiments, the paRNAs described herein differ from the endogenous molecule in one or more ways, e.g., they include more or fewer nucleotides, and/or include one or more of the modifications described herein for inhibitory nucleic acids, e.g., backbone or nucleoside modifications.

In one embodiment, a paRNA includes a nucleotide sequence that is at least about 85% or more homologous or identical to the entire length of a paRNA sequence shown herein, e.g., in any of Tables 1-4, or a fragment comprising at least 20 nt thereof (e.g., at least 25, 30, 35, 40, 50, 60, 70, 80, 90, or 100 nt thereof, e.g., at least 5%, 10%, 15%, 20%, 25%, 30%, 35%, 40%, 50% or more of the full length paRNA). In some embodiments, the nucleotide sequence is at least about 90%, 91%, 92%, 93%, 94%, 95%, 96%, 97%, 98%, 99% or 100% homologous or identical to a paRNA sequence shown herein. In some embodiments, the nucleotide sequence is at least about 85%, e.g., is at least about 90%, 91%, 92%, 93%, 94%, 95%, 96%, 97%, 98%, 99% or 100% homologous or identical to a paRNA sequence described herein, in a fragment thereof or a region that is much more conserved, such as Repeat A, but has lower sequence identity outside that region.

Mouse-to-human LiftOver analysis and analysis in the UCSC genome browser of syntenic positions indicate the existence of similar transcripts in the human genome. This process and LiftOver chains are generally described in Kent et al., *Proc. Nat'l Acad. Sci.*, 100(20) 11484-11489 (2003). Similar PRC2-interacting transcripts are believed to occur in the human system given the geographic and sequence similarities between the mouse and human transcripts. The data suggest that many if not all of the mouse PRC2-transcripts have direct counterparts in the human epigenome. Such direct counterparts in other species are termed "orthologous" herein. Empirically identified human paRNAs associated with the X chromosome, and strong and moderate binding sites in the X Chromosome, are described herein (see Example 10).

paRNAs may be functionally conserved without being highly conserved at the level of overall nucleotide identity. For example, mouse Xist shows only 76% overall nucleotide identity with human XIST using sliding 21-bp windows, or an overall sequence identity of only 60%. However, within specific functional domains, such as Repeat A, the degree of conservation can be >70% between different mammalian species. The crucial motif in Repeat A is the secondary structures formed by the repeat. A paRNA interacting with PRC2 may therefore be similarly low in overall conservation but still have conservation in secondary structure within specific domains of the RNA, and thereby demonstrate functional conservation with respect to recruitment of PRC2.

Calculations of homology or sequence identity between sequences (the terms are used interchangeably herein) are performed as follows.

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 1000/%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences.

For purposes of the present invention, the comparison of sequences and determination of percent identity between two sequences can be accomplished using a Blossum 62 scoring matrix with a gap penalty of 12, a gap extend penalty of 4, and a frameshift gap penalty of 5. There are several potential uses for the paRNAs described herein in the expanded PRC2 transcriptome: The RNAs themselves, or antagomirs and small molecules designed against them, can be utilized to modulate expression (either up or down) of Polycomb target genes. In addition, the paRNAs can be used to design and/or test inhibitory nucleic acids as described herein.

In various related aspects, including with respect to the targeting of paRNAs by LNA molecule, paRNAs can include endogenous cellular RNAs that are greater than 60 nt in length, e.g., greater than 100 nt, e.g., greater than 200 nt, have no positive-strand open reading frames greater than 100 amino acids in length, are identified as paRNAs by experimental evidence, and are distinct from known (smaller) functional-RNA classes (including but not limited to ribosomal, transfer, and small nuclear/nucleolar RNAs, siRNA, piRNA, and miRNA). See, e.g., Lipovich et al., "MacroRNA underdogs in a microRNA world: Evolutionary, regulatory, and biomedical significance of mammalian long non-protein-coding RNA" Biochimica et Biophysica Acta (2010) doi:10.1016/j.bbagrm.2010.10.001; Ponting et al., Cell 136(4):629-641 (2009), Jia et al., RNA 16 (8)

(2010) 1478-1487, Dinger et al., Nucleic Acids Res. 37 1685 (2009) D122-D126 (database issue); and references cited therein. paRNAs can include RNAs referred to as long RNA, large RNA, macro RNA, intergenic RNA, and Non-Coding Transcripts. The methods described herein can be used to target nuclear-localized paRNAs. Known classes of paRNAs include large intergenic non-coding RNAs (lincR-NAs, see, e.g., Guttman et al., Nature. 2009 Mar. 12; 458(7235):223-7. Epub 2009 Feb. 1, which describes over a thousand exemplary highly conserved large non-coding RNAs in mammals; and Khalil et al., PNAS 106(28)11675-11680 (2009)): promoter associated short RNAs (PASRs; see, e.g., Seila et al., Science. 2008 Dec. 19; 322(5909): 1849-51. Epub 2008 Dec. 4; Kanhere et al., Molecular Cell 38, 675-688, (2010)); endogenous antisense RNAs (see, e.g., Numata et al., BMC Genomics. 10:392 (2009); Okada et al., Hum Mol Genet. 17(11):1631-40 (2008); Numata et al., Gene 392(1-2):134-141 (2007); and Røsok and Sioud, Nat Biotechnol. 22(1): 104-8 (2004)); and RNAs that bind chromatin modifiers such as PRC2 and LSD1 (see, e.g., Tsai et al., Science. 2010 Aug. 6; 329(5992):689-93. Epub 2010 Jul. 8; and Zhao et al., Science. 2008 Oct. 31; 322(5902): 750-6).

Exemplary paRNAs include the lncRNAs XIST, TSIX, MALAT1, RNCR2, and HOTAIR. The sequences for more than 17,000 long human ncRNAs can be found in the NCode™ Long ncRNA Database on the Invitrogen website. Additional long ncRNAs can be identified using, e.g., manual published literature, Functional Annotation of Mouse (FANTOM3) project, Human Full-length cDNA Annotation Invitational (H-Invitational) project, antisense ncRNAs from cDNA and EST database for mouse and human using a computation pipeline (Zhang et al., Nucl. Acids Res. 35 (suppl 1): D156-D161 (2006); Engstrom et al., PLoS Genet. 2:e47 (2006)), human snoRNAs and scaR-NAs derived from snoRNA-LBME-db, RNAz (Washietl et al. 2005), Noncoding RNA Search (Torarinsson, et al. 2006), and EvoFold (Pedersen et al. 2006).

Disorders Associated with X-Inactivation

The present disclosure provides therapeutics for X-linked diseases formulated by designing inhibitory nucleic acids, e.g., oligonucleotides that bind to the strong or moderate PRC2 binding sites as described herein (on either strand), or oligonucleotides that are complementary to and thus bind to the transcripts that cross the PRC2 sites (paRNAs) described herein, to disrupt silencing of genes controlled by the PRC2 sites (e.g., all of the genes within a cluster), or to disrupt silencing of one specific gene. This methodology is useful in X-linked disorders, e.g., in heterozygous women who retain a wildtype copy of a gene on the Xi (See, e.g., Lyon, Acta Paediatr Suppl. 2002; 91(439):107-12; Carrell and Willard, Nature. 434(7031):400-4 (2005); den Veyver, Semin Reprod Med. 19(2):183-91 (2001)). Again, without wishing to be bound by theory, administration of an inhibitory nucleic acid (e.g., oligonucleotide) targeting a strong or moderate binding site is expected to prevent PRC2 recruitment to a specific X-linked gene cluster or to a specific gene on the inactive X, thereby reactivating the "good" or hypomorphic copy of the X-linked gene. As a result of X-inactivation, heterozygous females are mosaic for X-linked gene expression; some cells express genes from the maternal X and other cells express genes from the paternal X. The relative ratio of these two cell populations in a given female is frequently referred to as the "X-inactivation pattern." One cell population may be at a selective growth disadvantage, resulting in clonal outgrowth of cells with one or the other parental X chromosome active; this can cause significant deviation or skewing from an expected mean X-inactivation pattern (i.e., 50:50). See, e.g., Plenge et al., Am. J. Hum. Genet. 71:168-173 (2002) and references cited therein.

The present methods can be used to treat disorders associated with X-inactivation, which includes those listed in Table A.

TABLE A

| Disorder | OMIM # | Locus | Gene | K562 Suz12* | K562 Ezh2** | GM12878 Ezh2*** |
|---|---|---|---|---|---|---|
| Dent's disease 1 | 300009 | Xp11.22 | CLCN5 | seg_203 seg_204 seg_205 seg_206<br>seg_207 seg_208 seg_209 seg_210<br>seg_211 seg_212 seg_213 seg_214<br>seg_215 seg_216 seg_217 seg_218<br>seg_219 seg_220 seg_221 seg_222<br>seg_223 seg_224 seg_225 seg_226<br>seg_227 seg_228 seg_229 seg_230<br>seg_231 seg_232 seg_233 seg_234<br>seg_235 seg_236 seg_237 seg_238<br>seg_239 seg_240 seg_242 seg_243<br>seg_244 seg_245 seg_246 seg_247<br>seg_249 seg_250 seg_251 seg_252<br>seg_253 seg_254 seg_256 seg_257<br>seg_258 seg_259 seg_260 seg_261<br>seg_262 seg_263 seg_264 seg_265<br>seg_266 seg_267 seg_268 seg_269<br>seg_270 seg_271 seg_202 seg_241<br>seg_248 seg_255 | seg_224 seg_225 seg_226<br>seg_227 seg_228 seg_229<br>seg_230 seg_232 seg_234<br>seg_235 seg_236 seg_237<br>seg_238 seg_239 seg_240<br>seg_241 seg_242 seg_243<br>seg_245 seg_246 seg_247<br>seg_248 seg_249 seg_250<br>seg_251 seg_252 seg_253<br>seg_254 seg_255 seg_256<br>seg_257 seg_258 seg_259<br>seg_260 seg_262 seg_263<br>seg_265 seg_266 seg_267<br>seg_268 seg_269 seg_270<br>seg_271 seg_272 seg_273<br>seg_274 seg_275 seg_276<br>seg_277 seg_231<br>seg_233 seg_244 seg_261<br>seg_264 | seg_96 seg_97 seg_98<br>seg_99 seg_100<br>seg_101 seg_102<br>seg_103 seg_104<br>seg_105 seg_93<br>seg_95 |
| Testicular feminization syndrome | 300068 | Xq11-q12 | AR | seg_296 seg_297 seg_298 seg_300<br>seg_302 seg_305 seg_306 seg_307<br>seg_308 seg_309 seg_310 seg_311<br>seg_313 seg_314 seg_315 seg_316<br>seg_317 seg_318 seg_319 seg_320<br>seg_321 seg_322 seg_323 seg_324<br>seg_326 seg_328 seg_329 seg_330<br>seg_331 seg_332 seg_334 seg_335<br>seg_337 seg_338 seg_339 seg_340<br>seg_341 seg_342 seg_344 seg_345<br>seg_295 seg_299 seg_301 seg_303<br>seg_304 seg_312 seg_325 seg_327<br>seg_333 seg_336 seg_343 | seg_285 seg_286 seg_287<br>seg_290 seg_291 seg_292<br>seg_294 seg_295 seg_296<br>seg_297 seg_298 seg_299<br>seg_302 seg_303 seg_304<br>seg_305 seg_306 seg_307<br>seg_308 seg_309 seg_311<br>seg_312 seg_313 seg_288<br>seg_289 seg_293 seg_300<br>seg_301 seg_310 | seg_108 seg_109<br>seg_110 seg_111<br>seg_112 seg_113<br>seg_114 seg_115<br>seg_116 seg_117<br>seg_118 seg_119<br>seg_121 seg_122<br>seg_124 seg_125<br>seg_120 seg_123 |
| Addison's disease with cerebral sclerosis | 300100 | Xq28 | ABCD1 | seg_564 seg_566 seg_567 seg_568<br>seg_569 seg_571 seg_572 seg_574<br>seg_575 seg_576 seg_577 seg_578<br>seg_579 seg_580 seg_581 seg_582<br>seg_583 seg_584 seg_585 seg_586<br>seg_587 seg_588 seg_589 seg_590<br>seg_591 seg_592 seg_593 seg_594<br>seg_595 seg_596 seg_597 seg_599<br>seg_600 seg_601 seg_602 seg_603<br>seg_604 seg_605 seg_606 seg_607<br>seg_608 seg_609 seg_610 seg_611<br>seg_612 seg_613 seg_615 seg_616<br>seg_617 seg_618 seg_619 seg_620<br>seg_622 seg_623 seg_624 seg_625<br>seg_626 seg_627 seg_628 seg_629<br>seg_630 seg_631 seg_632 seg_633<br>seg_634 seg_635 seg_637 seg_638 | seg_504 seg_505 seg_506<br>seg_507 seg_508 seg_509<br>seg_510 seg_511 seg_512<br>seg_514 seg_515 seg_516<br>seg_517 seg_518 seg_520<br>seg_521 seg_522 seg_523<br>seg_524 seg_525 seg_526<br>seg_527 seg_528 seg_529<br>seg_530 seg_531 seg_532<br>seg_533 seg_534 seg_535<br>seg_536 seg_538 seg_539<br>seg_540 seg_542 seg_543<br>seg_544 seg_545 seg_546<br>seg_547 seg_548 seg_549<br>seg_550 seg_551 seg_552<br>seg_553 seg_554 seg_555<br>seg_556 seg_558 seg_559 | seg_209 seg_210<br>seg_211 seg_212<br>seg_213 seg_214<br>seg_215 |

TABLE A-continued

| Disorder | OMIM # | Locus | Gene | K562 Suz12* | K562 Ezh2** | GM12878 Ezh2*** |
|---|---|---|---|---|---|---|
| Adrenal hypoplasia | 300200 | XP21.3-p21.2 | DAX1 | seg_639 seg_641 seg_642 seg_644<br>seg_645 seg_646 seg_647 seg_648<br>seg_649 seg_650 seg_651 seg_652<br>seg_654 seg_655 seg_656 seg_657<br>seg_658 seg_659 seg_660 seg_661<br>seg_662 seg_663 seg_664 seg_665<br>seg_666 seg_565 seg_570 seg_573<br>seg_614 seg_621 seg_636 seg_640<br>seg_643 seg_598 seg_653 | seg_561 seg_562 seg_563<br>seg_564 seg_565 seg_566<br>seg_567 seg_568 seg_570<br>seg_572 seg_573 seg_574<br>seg_575 seg_576 seg_577<br>seg_578 seg_513 seg_519<br>seg_537 seg_541 seg_557<br>seg_569 seg_571 seg_560 | |
| siderius X-linked mental retardation syndrome | 300263 | Xp11.22 | PHF8 | seg_157 seg_159 seg_160 seg_161<br>seg_162 seg_163 seg_164 seg_158 | seg_198 seg_197 | seg_67 seg_69 seg_71<br>seg_72 seg_73 seg_74<br>seg_75 seg_76 seg_77<br>seg_78 seg_68 seg_70<br>seg_101 seg_102<br>seg_103 seg_104<br>seg_105 seg_106 |
| Agamma-globulinaemia, Bruton type | 300300 | Xq21.3-q22 | BTK | seg_222 seg_223 seg_224 seg_225<br>seg_226 seg_227 seg_228 seg_229<br>seg_230 seg_231 seg_232 seg_233<br>seg_234 seg_235 seg_236 seg_237<br>seg_238 seg_239 seg_240 seg_242<br>seg_243 seg_244 seg_245 seg_246<br>seg_247 seg_249 seg_250 seg_251<br>seg_252 seg_253 seg_254 seg_256<br>seg_257 seg_258 seg_259 seg_260<br>seg_261 seg_262 seg_263 seg_264<br>seg_265 seg_266 seg_267 seg_268<br>seg_269 seg_270 seg_271 seg_272<br>seg_273 seg_274 seg_275 seg_276<br>seg_277 seg_278 seg_279 seg_280<br>seg_281 seg_282 seg_284 seg_241<br>seg_248 seg_255 seg_283<br>seg_376 seg_377 seg_378 seg_379<br>seg_381 seg_382 seg_385 seg_386<br>seg_388 seg_389 seg_391 seg_392<br>seg_393 seg_394 seg_395 seg_396<br>seg_397 seg_398 seg_399 seg_400<br>seg_401 seg_402 seg_403 seg_404<br>seg_405 seg_380 seg_383 seg_387<br>seg_390 seg_384 | seg_247 seg_248 seg_249<br>seg_250 seg_251 seg_252<br>seg_253 seg_254 seg_255<br>seg_256 seg_257 seg_258<br>seg_259 seg_260 seg_262<br>seg_263 seg_265 seg_266<br>seg_267 seg_268 seg_269<br>seg_270 seg_271 seg_272<br>seg_275 seg_274 seg_275<br>seg_276 seg_277 seg_278<br>seg_279 seg_280 seg_281<br>seg_282 seg_283 seg_261<br>seg_264<br>seg_323 seg_324 seg_326<br>seg_327 seg_328 seg_329<br>seg_331 seg_332 seg_333<br>seg_334 seg_336 seg_337<br>seg_338 seg_339 seg_340<br>seg_341 seg_342 seg_343<br>seg_344 seg_345 seg_346<br>seg_347 seg_348 seg_321<br>seg_325 seg_330 seg_335 | seg_140 seg_141<br>seg_142 seg_143<br>seg_144 seg_145<br>seg_146 |
| Choroidoretinal degeneration | 300389 | Xp21.1 | RPGR | seg_165 seg_166 seg_167 seg_168<br>seg_169 seg_170 seg_171 seg_172<br>seg_173 seg_174 seg_175 seg_176<br>seg_177 seg_178 seg_179 seg_181<br>seg_182 seg_183 seg_184 seg_185<br>seg_186 seg_187 seg_188 seg_189<br>seg_191 seg_192 seg_193 seg_195<br>seg_196 seg_180 seg_190 seg_194 | seg_200 seg_201 seg_202<br>seg_203 seg_204 seg_205<br>seg_206 seg_207 seg_208<br>seg_210 seg_211 seg_212<br>seg_213 seg_214 seg_215<br>seg_216 seg_217 seg_218<br>seg_209 | seg_80 seg_81 seg_82<br>seg_83 seg_84 seg_85<br>seg_86 seg_87 seg_88<br>seg_89 seg_90 seg_91 |
| Choroidaemia | 300390 | Xq21.2 | CHM | seg_368 seg_369 seg_370 seg_371<br>seg_372 | | seg_136 seg_137 |
| Albinism, ocular | 300500 | Xp22.3 | OA1 | seg_50 seg_51 seg_52 seg_53 seg_54<br>seg_55 seg_56 seg_57 seg_58 seg_59<br>seg_60 seg_61 seg_63 seg_64 seg_65 | seg_56 seg_57 seg_58<br>seg_60 seg_61 seg_63<br>seg_64 seg_65 seg_66 | seg_9 seg_10 seg_11<br>seg_12 seg_13 seg_14<br>seg_16 seg_17 seg_18 |

TABLE A-continued

| Disorder | OMIM # | Locus | Gene | K562 Suz12* | K562 Ezh2** | GM12878 Ezh2*** |
|---|---|---|---|---|---|---|
| | | | | seg_66 seg_67 seg_68 seg_69 seg_70 | seg_67 seg_68 seg_69 | seg_19 seg_20 seg_21 |
| | | | | seg_71 seg_73 seg_74 seg_75 seg_76 | seg_70 seg_71 seg_72 | seg_22 seg_23 seg_24 |
| | | | | seg_77 seg_78 seg_79 seg_80 seg_81 | seg_73 seg_74 seg_75 | seg_25 seg_26 seg_27 |
| | | | | seg_82 seg_83 seg_84 seg_85 seg_86 | seg_76 seg_77 seg_78 | seg_28 seg_29 seg_30 |
| | | | | seg_87 seg_88 seg_89 seg_90 seg_91 | seg_79 seg_80 seg_81 | seg_31 seg_32 seg_33 |
| | | | | seg_62 seg_72 | seg_82 seg_83 seg_84 | seg_34 seg_15 |
| | | | | | seg_85 seg_36 seg_87 | |
| | | | | | seg_88 seg_89 seg_91 | |
| | | | | | seg_92 seg_93 seg_95 | |
| | | | | | seg_96 seg_97 seg_98 | |
| | | | | | seg_99 seg_100 seg_101 | |
| | | | | | seg_102 seg_103 seg_104 | |
| | | | | | seg_106 seg_107 seg_108 | |
| | | | | | seg_110 seg_59 seg_62 | |
| | | | | | seg_90 seg_94 seg_105 | |
| | | | | | seg_109 | |
| Dent's disease 2 | 300555 | Xq25-q26 | OCRL | seg_474 seg_475 seg_477 seg_478 | seg_420 seg_421 seg_422 | seg_185 seg_186 |
| | | | | seg_479 seg_480 seg_481 seg_482 | seg_423 seg_424 seg_425 | seg_187 seg_188 |
| | | | | seg_483 seg_484 seg_485 seg_486 | seg_426 seg_427 seg_428 | seg_189 seg_190 |
| | | | | seg_487 seg_488 seg_489 seg_490 | seg_429 seg_430 seg_431 | seg_191 seg_192 |
| | | | | seg_491 seg_492 seg_493 seg_494 | seg_432 seg_433 seg_434 | seg_183 |
| | | | | seg_495 seg_496 seg_497 seg_498 | seg_436 seg_438 seg_439 | |
| | | | | seg_499 seg_501 seg_502 seg_503 | seg_440 seg_441 seg_442 | |
| | | | | seg_476 seg_500 | seg_443 seg_435 seg_437 | |
| fragile X syndrome | 300624 | Xq27.3 | FMR1 | seg_561 seg_562 seg_563 seg_564 | seg_503 seg_504 seg_505 | seg_208 seg_209 |
| | | | | seg_566 seg_567 seg_568 seg_569 | seg_506 seg_507 seg_508 | seg_210 seg_211 |
| | | | | seg_571 seg_572 seg_574 seg_575 | seg_509 seg_510 seg_511 | seg_212 |
| | | | | seg_576 seg_577 seg_578 seg_579 | seg_512 seg_514 seg_515 | |
| | | | | seg_580 seg_581 seg_582 seg_583 | seg_516 seg_517 seg_518 | |
| | | | | seg_584 seg_585 seg_586 seg_587 | seg_520 seg_521 seg_522 | |
| | | | | seg_588 seg_589 seg_590 seg_591 | seg_523 seg_524 seg_525 | |
| | | | | seg_592 seg_593 seg_594 seg_595 | seg_526 seg_527 seg_528 | |
| | | | | seg_596 seg_597 seg_599 seg_560 | seg_529 seg_530 seg_531 | |
| | | | | seg_565 seg_570 seg_573 seg_598 | seg_532 seg_513 seg_519 | |
| Rett/Epileptic encephalopathy, early infantile, 2 | 300672 | Xp22.13 | CDKL5 | seg_83 seg_84 seg_85 seg_86 seg_87 | seg_96 seg_97 seg_98 | seg_31 seg_32 seg_33 |
| | | | | seg_88 seg_89 seg_90 seg_91 seg_92 | seg_99 seg_100 seg_101 | seg_34 seg_35 seg_36 |
| | | | | seg_93 seg_94 seg_95 seg_96 seg_97 | seg_102 seg_103 seg_104 | seg_37 seg_38 seg_39 |
| | | | | seg_98 seg_99 seg_100 seg_101 | seg_106 seg_107 seg_108 | seg_40 seg_41 seg_42 |
| | | | | seg_102 seg_103 seg_104 seg_105 | seg_110 seg_111 seg_112 | seg_43 seg_44 seg_45 |
| | | | | seg_106 seg_107 seg_108 seg_109 | seg_113 seg_114 seg_115 | seg_46 seg_47 seg_48 |
| | | | | seg_111 seg_112 seg_113 seg_114 | seg_117 seg_119 seg_120 | seg_49 seg_50 seg_51 |
| | | | | seg_115 seg_116 seg_117 seg_118 | seg_121 seg_122 seg_123 | seg_52 seg_53 seg_55 |
| | | | | seg_119 seg_121 seg_122 seg_124 | seg_124 seg_125 seg_126 | seg_56 seg_57 seg_58 |
| | | | | seg_125 seg_126 seg_127 seg_128 | seg_127 seg_128 seg_130 | seg_59 seg_61 seg_60 |
| | | | | seg_129 seg_131 seg_132 seg_133 | seg_131 seg_132 seg_133 | seg_54 |
| | | | | seg_134 seg_135 seg_136 seg_137 | seg_134 seg_135 seg_136 | |
| | | | | seg_138 seg_139 seg_110 seg_123 | seg_137 seg_138 seg_139 | |
| | | | | seg_130 seg_120 | seg_140 seg_141 seg_142 | |
| | | | | | seg_143 seg_144 seg_145 | |
| | | | | | seg_146 seg_147 seg_148 | |
| | | | | | seg_149 seg_150 seg_151 | |

TABLE A-continued

| Disorder | OMIM # | Locus | Gene | K562 Suz12* | K562 Ezh2** | GM12878 Ezh2*** |
|---|---|---|---|---|---|---|
| | | | | | seg_152 seg_153 seg_156 | |
| | | | | | seg_157 seg_158 seg_159 | |
| | | | | | seg_160 seg_161 seg_162 | |
| | | | | | seg_163 seg_164 seg_165 | |
| | | | | | seg_166 seg_167 seg_168 | |
| | | | | | seg_169 seg_171 seg_172 | |
| | | | | | seg_173 seg_174 seg_175 | |
| | | | | | seg_176 seg_177 seg_178 | |
| | | | | | seg_179 seg_180 seg_181 | |
| | | | | | seg_182 seg_183 seg_184 | |
| | | | | | seg_94 seg_105 seg_109 | |
| | | | | | seg_116 seg_118 seg_129 | |
| Albinism-deafness syndrome | 300700 | Xq26.3-q27.1 | ADFN | seg_434 seg_436 seg_437 seg_438 | seg_154 seg_155 seg_170 | seg_164 seg_165 |
| | | | | seg_440 seg_441 seg_442 seg_443 | seg_375 seg_376 seg_377 | seg_166 seg_167 |
| | | | | seg_444 seg_445 seg_446 seg_447 | seg_378 seg_379 seg_380 | seg_168 seg_169 |
| | | | | seg_448 seg_449 seg_450 seg_451 | seg_381 seg_382 seg_383 | seg_171 seg_172 |
| | | | | seg_452 seg_453 seg_454 seg_455 | seg_384 seg_385 seg_386 | seg_173 seg_174 |
| | | | | seg_456 seg_457 seg_458 seg_459 | seg_387 seg_388 seg_389 | seg_175 seg_176 |
| | | | | seg_460 seg_461 seg_462 seg_464 | seg_390 seg_391 seg_392 | seg_177 seg_178 |
| | | | | seg_465 seg_466 seg_435 seg_439 | seg_393 seg_394 seg_395 | seg_179 seg_180 |
| | | | | seg_463 seg_433 | seg_396 seg_397 seg_398 | seg_181 seg_170 |
| | | | | | seg_399 seg_400 seg_401 | |
| | | | | | seg_402 seg_403 seg_404 | |
| | | | | | seg_405 seg_406 seg_407 | |
| | | | | | seg_409 seg_410 seg_411 | |
| | | | | | seg_413 seg_414 seg_415 | |
| | | | | | seg_408 seg_412 | |
| paroxysmal nocturnal hemoglobinuria | 300818 | Xp22.2 | PIGA | seg_68 seg_89 seg_70 seg_71 seg_73 | seg_77 seg_78 seg_79 | seg_17 seg_18 seg_19 |
| | | | | seg_74 seg_75 seg_76 seg_77 seg_78 | seg_80 seg_81 seg_82 | seg_20 seg_21 seg_22 |
| | | | | seg_79 seg_80 seg_81 seg_82 seg_83 | seg_83 seg_84 seg_85 | seg_23 seg_24 seg_25 |
| | | | | seg_84 seg_85 seg_86 seg_87 seg_88 | seg_86 seg_87 seg_88 | seg_26 seg_27 seg_28 |
| | | | | seg_89 seg_90 seg_91 seg_92 seg_93 | seg_89 seg_91 seg_92 | seg_29 seg_30 seg_31 |
| | | | | seg_94 seg_95 seg_96 seg_97 seg_98 | seg_93 seg_95 seg_96 | seg_32 seg_33 seg_34 |
| | | | | seg_99 seg_100 seg_101 seg_102 | seg_97 seg_98 seg_99 | seg_35 seg_36 seg_37 |
| | | | | seg_103 seg_104 seg_105 seg_106 | seg_100 seg_101 seg_102 | seg_38 seg_39 seg_40 |
| | | | | seg_107 seg_108 seg_109 seg_111 | seg_103 seg_104 seg_106 | seg_41 seg_42 seg_43 |
| | | | | seg_112 seg_113 seg_114 seg_115 | seg_107 seg_108 seg_110 | seg_44 seg_45 seg_48 |
| | | | | seg_116 seg_117 seg_118 seg_119 | seg_111 seg_112 seg_113 | seg_47 seg_48 seg_49 |
| | | | | seg_121 seg_122 seg_124 seg_125 | seg_114 seg_115 seg_117 | seg_50 seg_51 seg_52 |
| | | | | seg_126 seg_127 seg_128 seg_129 | seg_119 seg_120 seg_121 | seg_53 seg_55 seg_56 |
| | | | | seg_72 seg_110 seg_123 seg_130 | seg_122 seg_123 seg_124 | seg_54 |
| | | | | seg_120 | seg_125 seg_126 seg_127 | |
| | | | | | seg_128 seg_130 seg_131 | |
| | | | | | seg_132 seg_133 seg_134 | |
| | | | | | seg_135 seg_136 seg_137 | |
| | | | | | seg_138 seg_139 seg_140 | |
| | | | | | seg_141 seg_142 seg_143 | |
| | | | | | seg_144 seg_145 seg_146 | |
| | | | | | seg_147 seg_148 seg_149 | |
| | | | | | seg_150 seg_151 seg_152 | |
| | | | | | seg_153 seg_156 seg_157 | |

TABLE A-continued

| Disorder | OMIM # | Locus | Gene | K562 Suz12* | K562 Ezh2** | GM12878 Ezh2*** |
|---|---|---|---|---|---|---|
| | | | | | seg_158 seg_159 seg_160 | |
| | | | | | seg_161 seg_162 seg_163 | |
| | | | | | seg_164 seg_165 seg_166 | |
| | | | | | seg_167 seg_168 seg_169 | |
| | | | | | seg_171 seg_172 seg_173 | |
| | | | | | seg_174 seg_175 seg_176 | |
| | | | | | seg_177 seg_178 seg_90 | |
| | | | | | seg_94 seg_105 seg_109 | |
| | | | | | seg_116 seg_118 seg_129 | |
| | | | | | seg_154 seg_155 seg_170 | |
| Aldrich syndrome | 301000 | Xp11.23-p11.22 | WAS | seg_199 seg_201 seg_203 seg_204 | seg_220 seg_221 seg_222 | seg_96 seg_97 seg_98 |
| | | | | seg_205 seg_206 seg_207 seg_208 | seg_223 seg_224 seg_225 | seg_99 seg_100 |
| | | | | seg_209 seg_210 seg_211 seg_212 | seg_226 seg_227 seg_228 | seg_101 seg_102 |
| | | | | seg_213 seg_214 seg_215 seg_216 | seg_229 seg_230 seg_232 | seg_103 seg_93 |
| | | | | seg_217 seg_218 seg_219 seg_220 | seg_234 seg_235 seg_236 | seg_95 |
| | | | | seg_221 seg_222 seg_223 seg_224 | seg_237 seg_238 seg_239 | |
| | | | | seg_225 seg_226 seg_227 seg_228 | seg_240 seg_241 seg_242 | |
| | | | | seg_229 seg_230 seg_231 seg_232 | seg_243 seg_245 seg_246 | |
| | | | | seg_233 seg_234 seg_235 seg_236 | seg_247 seg_248 seg_249 | |
| | | | | seg_237 seg_238 seg_239 seg_240 | seg_250 seg_251 seg_252 | |
| | | | | seg_242 seg_243 seg_244 seg_245 | seg_253 seg_254 seg_255 | |
| | | | | seg_246 seg_247 seg_249 seg_250 | seg_256 seg_257 seg_258 | |
| | | | | seg_251 seg_252 seg_253 seg_254 | seg_259 seg_260 seg_262 | |
| | | | | seg_256 seg_257 seg_258 seg_259 | seg_263 seg_265 seg_266 | |
| | | | | seg_260 seg_261 seg_262 seg_263 | seg_267 seg_268 seg_269 | |
| | | | | seg_264 seg_200 seg_202 seg_241 | seg_270 seg_271 seg_231 | |
| | | | | seg_248 seg_255 | seg_233 seg_244 seg_261 | |
| | | | | | seg_264 | |
| Alport syndrome | 301050 | Xq22.3 | COL4A5 | seg_394 seg_395 seg_396 seg_397 | seg_334 seg_336 seg_337 | seg_146 seg_148 |
| | | | | seg_398 seg_399 seg_400 seg_401 | seg_338 seg_339 seg_340 | seg_149 seg_150 |
| | | | | seg_402 seg_403 seg_404 seg_405 | seg_341 seg_342 seg_343 | seg_152 seg_156 |
| | | | | seg_406 seg_407 seg_408 seg_409 | seg_344 seg_345 seg_346 | seg_157 seg_158 |
| | | | | seg_410 seg_411 seg_412 seg_413 | seg_347 seg_348 seg_349 | seg_159 seg_160 |
| | | | | seg_414 seg_415 seg_417 seg_418 | seg_350 seg_351 seg_352 | seg_161 seg_162 |
| | | | | seg_419 seg_420 seg_421 seg_423 | seg_353 seg_355 seg_356 | seg_163 seg_164 |
| | | | | seg_425 seg_426 seg_427 seg_428 | seg_357 seg_358 seg_362 | seg_165 seg_166 |
| | | | | seg_431 seg_432 seg_434 seg_436 | seg_363 seg_364 seg_365 | seg_167 seg_168 |
| | | | | seg_437 seg_416 seg_422 seg_424 | seg_366 seg_367 seg_368 | seg_147 seg_153 |
| | | | | seg_429 seg_430 seg_435 seg_433 | seg_369 seg_370 seg_371 | seg_154 seg_155 |
| | | | | | seg_372 seg_373 seg_374 | seg_151 |
| | | | | | seg_375 seg_335 seg_354 | |
| Anaemia, hereditary hypochromic | 301300 | Xp11.21 | ALAS2 | seg_229 seg_230 seg_231 seg_232 | seg_359 seg_360 seg_361 | seg_101 seg_102 |
| | | | | seg_233 seg_234 seg_235 seg_236 | seg_252 seg_253 seg_254 | seg_103 seg_104 |
| | | | | seg_237 seg_238 seg_239 seg_240 | seg_255 seg_256 seg_257 | seg_105 seg_106 |
| | | | | seg_242 seg_243 seg_244 seg_245 | seg_258 seg_259 seg_260 | |
| | | | | seg_246 seg_247 seg_249 seg_250 | seg_262 seg_263 seg_265 | |
| | | | | seg_251 seg_252 seg_253 seg_254 | seg_266 seg_267 seg_268 | |
| | | | | seg_256 seg_257 seg_258 seg_259 | seg_269 seg_270 seg_271 | |
| | | | | seg_260 seg_261 seg_262 seg_263 | seg_272 seg_273 seg_274 | |
| | | | | seg_264 seg_265 seg_266 seg_267 | seg_275 seg_276 seg_277 | |
| | | | | | seg_278 seg_279 seg_280 | |

TABLE A-continued

| Disorder | OMIM # | Locus | Gene | K562 Suz12* | K562 Ezh2** | GM12878 Ezh2*** |
|---|---|---|---|---|---|---|
| Anemia, sideroblastic, with ataxia | 301310 | Xq13.3 | ABCB7 | seg_268 seg_269 seg_270 seg_271 seg_272 seg_273 seg_274 seg_275 seg_276 seg_277 seg_278 seg_279 seg_280 seg_281 seg_282 seg_284 seg_241 seg_248 seg_255 seg_283 seg_326 seg_328 seg_329 seg_330 seg_331 seg_332 seg_334 seg_335 seg_337 seg_338 seg_339 seg_340 seg_341 seg_342 seg_344 seg_345 seg_346 seg_347 seg_348 seg_349 seg_350 seg_351 seg_352 seg_353 seg_354 seg_356 seg_358 seg_359 seg_360 seg_361 seg_362 seg_363 seg_325 seg_327 seg_333 seg_336 | seg_281 seg_282 seg_283 seg_261 seg_264 seg_295 seg_296 seg_297 seg_298 seg_299 seg_302 seg_303 seg_304 seg_305 seg_306 seg_307 seg_308 seg_309 seg_311 seg_312 seg_313 seg_314 seg_315 seg_316 seg_317 seg_318 seg_319 seg_300 seg_301 seg_310 | seg_119 seg_121 seg_122 seg_124 seg_125 seg_126 seg_127 seg_123 seg_129 seg_130 seg_131 seg_133 seg_134 seg_120 seg_123 seg_132 |
| Fabry disease | 301500 | Xq22 | GLA | seg_343 seg_355 seg_357 seg_376 seg_377 seg_378 seg_379 seg_381 seg_382 seg_385 seg_386 seg_388 seg_389 seg_391 seg_392 seg_393 seg_394 seg_395 seg_396 seg_397 seg_398 seg_399 seg_400 seg_401 seg_402 seg_403 seg_404 seg_405 seg_380 seg_383 seg_387 seg_390 seg_384 | seg_323 seg_324 seg_326 seg_327 seg_328 seg_329 seg_331 seg_332 seg_333 seg_334 seg_336 seg_337 seg_338 seg_339 seg_340 seg_341 seg_342 seg_343 seg_344 seg_345 seg_346 seg_347 seg_348 seg_321 seg_325 seg_330 seg_335 | seg_140 seg_141 seg_142 seg_143 seg_144 seg_145 seg_146 |
| Spinal muscular atrophy 2 | 301830 | Xp11.23 | UBA1 | seg_197 seg_198 seg_199 seg_201 seg_203 seg_204 seg_205 seg_206 seg_207 seg_208 seg_209 seg_210 seg_211 seg_212 seg_213 seg_214 seg_215 seg_216 seg_217 seg_218 seg_219 seg_220 seg_221 seg_222 seg_223 seg_224 seg_225 seg_226 seg_227 seg_228 seg_229 seg_230 seg_231 seg_232 seg_233 seg_234 seg_235 seg_236 seg_237 seg_238 seg_239 seg_240 seg_242 seg_243 seg_244 seg_200 seg_202 seg_241 | seg_220 seg_221 seg_222 seg_223 seg_224 seg_225 seg_226 seg_227 seg_228 seg_229 seg_230 seg_232 seg_234 seg_235 seg_236 seg_237 seg_238 seg_239 seg_240 seg_241 seg_242 seg_243 seg_245 seg_246 seg_247 seg_248 seg_249 seg_250 seg_251 seg_252 seg_253 seg_254 seg_255 seg_256 seg_257 seg_231 seg_233 seg_244 | seg_94 seg_96 seg_97 seg_98 seg_99 seg_100 seg_93 seg_95 |
| Cataract, congenital | 302200 | Xp | CCT | seg_76 seg_77 seg_78 seg_79 seg_80 seg_81 seg_82 seg_83 seg_84 seg_85 seg_86 seg_87 seg_88 seg_89 seg_90 seg_91 seg_92 seg_93 seg_94 seg_95 seg_96 seg_97 seg_98 seg_99 seg_100 seg_101 seg_102 seg_103 seg_104 seg_105 seg_106 seg_107 seg_108 seg_109 seg_111 seg_112 seg_113 seg_114 seg_115 seg_116 seg_117 seg_118 seg_119 seg_121 seg_122 seg_124 seg_125 seg_126 seg_127 seg_128 seg_129 seg_131 seg_132 seg_133 seg_134 seg_110 seg_123 seg_130 seg_120 | seg_88 seg_89 seg_91 seg_92 seg_93 seg_95 seg_96 seg_97 seg_98 seg_99 seg_100 seg_101 seg_102 seg_103 seg_104 seg_106 seg_107 seg_108 seg_110 seg_111 seg_112 seg_113 seg_114 seg_115 seg_117 seg_120 seg_121 seg_122 seg_123 seg_124 seg_125 seg_126 seg_127 seg_128 seg_130 seg_131 seg_132 seg_133 seg_134 seg_135 seg_136 | seg_21 seg_22 seg_23 seg_24 seg_25 seg_26 seg_27 seg_28 seg_29 seg_30 seg_31 seg_32 seg_33 seg_34 seg_35 seg_36 seg_37 seg_38 seg_39 seg_40 seg_41 seg_42 seg_43 seg_44 seg_45 seg_46 seg_47 seg_48 seg_49 seg_50 seg_51 seg_52 seg_53 seg_55 seg_56 seg_57 seg_58 seg_59 seg_54 |

TABLE A-continued

| Disorder | OMIM # | Locus | Gene | K562 Suz12* | K562 Ezh2** | GM12878 Ezh2*** |
|---|---|---|---|---|---|---|
| | | | | | seg_137 seg_138 seg_139 | |
| | | | | | seg_140 seg_141 seg_142 | |
| | | | | | seg_143 seg_144 seg_145 | |
| | | | | | seg_146 seg_147 seg_148 | |
| | | | | | seg_149 seg_150 seg_151 | |
| | | | | | seg_152 seg_155 seg_156 | |
| | | | | | seg_157 seg_158 seg_159 | |
| | | | | | seg_160 seg_161 seg_162 | |
| | | | | | seg_163 seg_164 seg_165 | |
| | | | | | seg_166 seg_167 seg_168 | |
| | | | | | seg_169 seg_171 seg_172 | |
| | | | | | seg_173 seg_174 seg_175 | |
| | | | | | seg_176 seg_177 seg_178 | |
| | | | | | seg_179 seg_180 seg_181 | |
| | | | | | seg_182 seg_183 seg_184 | |
| | | | | | seg_90 seg_94 seg_105 | |
| | | | | | seg_109 seg_116 seg_118 | |
| | | | | | seg_129 seg_154 seg_155 | |
| | | | | | seg_170 | |
| Charcot-Marie-Tooth, peroneal | 302800 | Xq13.1 | GJB1 | seg_313 seg_314 seg_315 seg_316 | seg_287 seg_290 seg_291 | seg_114 seg_115 |
| | | | | seg_317 seg_318 seg_319 seg_320 | seg_292 seg_294 seg_295 | seg_116 seg_117 |
| | | | | seg_321 seg_322 seg_323 seg_324 | seg_296 seg_297 seg_298 | seg_118 seg_119 |
| | | | | seg_326 seg_328 seg_329 seg_330 | seg_299 seg_302 seg_303 | seg_121 seg_122 |
| | | | | seg_331 seg_332 seg_334 seg_335 | seg_304 seg_305 seg_306 | seg_124 seg_125 |
| | | | | seg_337 seg_338 seg_339 seg_340 | seg_307 seg_308 seg_309 | seg_126 seg_127 |
| | | | | seg_341 seg_342 seg_344 seg_345 | seg_311 seg_312 seg_313 | seg_120 seg_123 |
| | | | | seg_346 seg_347 seg_348 seg_349 | seg_314 seg_315 seg_316 | |
| | | | | seg_350 seg_351 seg_352 seg_353 | seg_317 seg_318 seg_319 | |
| | | | | seg_354 seg_356 seg_312 seg_325 | seg_288 seg_289 seg_293 | |
| | | | | seg_327 seg_333 seg_336 seg_343 | seg_300 seg_301 seg_310 | |
| | | | | seg_355 seg_357 | | |
| Spastic paraplegia | 303350 | Xq28 | L1CAM | seg_564 seg_566 seg_567 seg_568 | seg_504 seg_505 seg_506 | seg_209 seg_210 |
| | | | | seg_569 seg_571 seg_572 seg_574 | seg_507 seg_508 seg_509 | seg_211 seg_212 |
| | | | | seg_575 seg_576 seg_577 seg_578 | seg_510 seg_511 seg_512 | seg_213 seg_214 |
| | | | | seg_579 seg_580 seg_581 seg_582 | seg_514 seg_515 seg_516 | seg_215 |
| | | | | seg_583 seg_584 seg_585 seg_586 | seg_517 seg_518 seg_520 | |
| | | | | seg_587 seg_588 seg_589 seg_590 | seg_521 seg_522 seg_523 | |
| | | | | seg_591 seg_592 seg_593 seg_594 | seg_524 seg_525 seg_526 | |
| | | | | seg_595 seg_596 seg_597 seg_599 | seg_527 seg_528 seg_529 | |
| | | | | seg_600 seg_601 seg_602 seg_603 | seg_530 seg_531 seg_532 | |
| | | | | seg_604 seg_605 seg_606 seg_607 | seg_533 seg_534 seg_535 | |
| | | | | seg_608 seg_609 seg_610 seg_611 | seg_536 seg_538 seg_539 | |
| | | | | seg_612 seg_613 seg_615 seg_616 | seg_540 seg_542 seg_543 | |
| | | | | seg_617 seg_618 seg_619 seg_620 | seg_544 seg_545 seg_546 | |
| | | | | seg_622 seg_623 seg_624 seg_625 | seg_547 seg_548 seg_549 | |
| | | | | seg_626 seg_627 seg_628 seg_629 | seg_550 seg_551 seg_552 | |
| | | | | seg_630 seg_631 seg_632 seg_633 | seg_553 seg_554 seg_555 | |
| | | | | seg_634 seg_635 seg_637 seg_638 | seg_556 seg_558 seg_559 | |
| | | | | seg_639 seg_641 seg_642 seg_644 | seg_561 seg_562 seg_563 | |
| | | | | seg_645 seg_646 seg_647 seg_648 | seg_564 seg_565 seg_566 | |
| | | | | seg_649 seg_650 seg_651 seg_652 | seg_567 seg_568 seg_570 | |

TABLE A-continued

| Disorder | OMIM # | Locus | Gene | K562 Suz12* | K562 Ezh2** | GM12878 Ezh2*** |
|---|---|---|---|---|---|---|
| Colour blindness | 303800 | Xq28 | OPN1MW | seg_654 seg_655 seg_656 seg_657<br>seg_658 seg_659 seg_660 seg_661<br>seg_662 seg_663 seg_664 seg_665<br>seg_666 seg_565 seg_570 seg_573<br>seg_614 seg_621 seg_636 seg_640<br>seg_643 seg_598 seg_653<br>seg_567 seg_568 seg_569 seg_571<br>seg_572 seg_574 seg_575 seg_576<br>seg_577 seg_578 seg_579 seg_580<br>seg_581 seg_582 seg_583 seg_584<br>seg_585 seg_586 seg_587 seg_588<br>seg_589 seg_590 seg_591 seg_592<br>seg_593 seg_594 seg_595 seg_596<br>seg_597 seg_599 seg_600 seg_601<br>seg_602 seg_603 seg_604 seg_605<br>seg_606 seg_607 seg_608 seg_609<br>seg_610 seg_611 seg_612 seg_613<br>seg_615 seg_616 seg_617 seg_618<br>seg_619 seg_620 seg_622 seg_623<br>seg_624 seg_625 seg_626 seg_627<br>seg_628 seg_629 seg_630 seg_631<br>seg_632 seg_633 seg_634 seg_635<br>seg_637 seg_638 seg_639 seg_641<br>seg_642 seg_644 seg_645 seg_646<br>seg_647 seg_648 seg_649 seg_650<br>seg_651 seg_652 seg_654 seg_655<br>seg_656 seg_657 seg_658 seg_659<br>seg_660 seg_661 seg_662 seg_663<br>seg_664 seg_665 seg_666 seg_565<br>seg_570 seg_573 seg_614 seg_621<br>seg_636 seg_640 seg_643 seg_598<br>seg_653 | seg_572 seg_573 seg_574<br>seg_575 seg_576 seg_577<br>seg_578 seg_513 seg_519<br>seg_537 seg_541 seg_557<br>seg_563 seg_571 seg_560<br>seg_504 seg_505 seg_506<br>seg_507 seg_508 seg_509<br>seg_510 seg_511 seg_512<br>seg_514 seg_515 seg_516<br>seg_517 seg_518 seg_520<br>seg_521 seg_522 seg_523<br>seg_524 seg_525 seg_526<br>seg_527 seg_528 seg_529<br>seg_530 seg_531 seg_532<br>seg_533 seg_534 seg_535<br>seg_536 seg_538 seg_539<br>seg_540 seg_542 seg_543<br>seg_544 seg_545 seg_546<br>seg_547 seg_548 seg_549<br>seg_550 seg_551 seg_552<br>seg_553 seg_554 seg_555<br>seg_556 seg_558 seg_559<br>seg_561 seg_562 seg_563<br>seg_564 seg_565 seg_566<br>seg_567 seg_568 seg_570<br>seg_572 seg_573 seg_574<br>seg_575 seg_576 seg_577<br>seg_578 seg_513 seg_519<br>seg_537 seg_541 seg_557<br>seg_569 seg_571 seg_560 | seg_209 seg_210<br>seg_211 seg_212<br>seg_213 seg_214<br>seg_215 |
| Diabetes insipidus, nephrogenic | 304800 | Xq28 | AVPR2 | seg_564 seg_566 seg_567 seg_568<br>seg_569 seg_571 seg_572 seg_574<br>seg_575 seg_576 seg_577 seg_578<br>seg_579 seg_580 seg_581 seg_582<br>seg_583 seg_584 seg_585 seg_586<br>seg_587 seg_588 seg_589 seg_590<br>seg_591 seg_592 seg_593 seg_594<br>seg_595 seg_596 seg_597 seg_599<br>seg_600 seg_601 seg_602 seg_603<br>seg_604 seg_605 seg_606 seg_607<br>seg_608 seg_609 seg_610 seg_611<br>seg_612 seg_613 seg_615 seg_616<br>seg_617 seg_618 seg_619 seg_620<br>seg_622 seg_623 seg_624 seg_625<br>seg_626 seg_627 seg_628 seg_629<br>seg_630 seg_631 seg_632 seg_633<br>seg_634 seg_635 seg_637 seg_638<br>seg_639 seg_641 seg_642 seg_644<br>seg_645 seg_646 seg_647 seg_648 | seg_504 seg_505 seg_506<br>seg_507 seg_508 seg_509<br>seg_510 seg_511 seg_512<br>seg_514 seg_515 seg_516<br>seg_517 seg_518 seg_520<br>seg_521 seg_522 seg_523<br>seg_524 seg_525 seg_526<br>seg_527 seg_528 seg_529<br>seg_530 seg_531 seg_532<br>seg_533 seg_534 seg_535<br>seg_536 seg_538 seg_539<br>seg_540 seg_542 seg_543<br>seg_544 seg_545 seg_546<br>seg_547 seg_548 seg_549<br>seg_550 seg_551 seg_552<br>seg_553 seg_554 seg_555<br>seg_556 seg_558 seg_559<br>seg_561 seg_562 seg_563<br>seg_564 seg_565 seg_566 | seg_209 seg_210<br>seg_211 seg_212<br>seg_213 seg_214<br>seg_215 |

TABLE A-continued

| Disorder | OMIM # | Locus | Gene | K562 Suz12* | K562 Ezh2** | GM12878 Ezh2*** |
|---|---|---|---|---|---|---|
| | | | | seg_649 seg_650 seg_651 seg_652 | seg_567 seg_568 seg_569 seg_570 | |
| | | | | seg_654 seg_655 seg_656 seg_657 | seg_572 seg_573 seg_574 | |
| | | | | seg_658 seg_659 seg_660 seg_661 | seg_575 seg_576 seg_577 | |
| | | | | seg_662 seg_663 seg_664 seg_665 | seg_578 seg_513 seg_519 | |
| | | | | seg_666 seg_565 seg_570 seg_573 | seg_537 seg_541 seg_557 | |
| | | | | seg_614 seg_621 seg_636 seg_640 | seg_569 seg_571 seg_560 | |
| | | | | seg_643 seg_598 seg_653 | | |
| Dyskeratosis congenita | 305000 | Xq28 | DKC1 | seg_577 seg_578 seg_579 seg_580 | seg_511 seg_512 seg_514 | seg_210 seg_211 |
| | | | | seg_581 seg_582 seg_583 seg_584 | seg_515 seg_516 seg_517 | seg_212 seg_213 |
| | | | | seg_585 seg_586 seg_587 seg_588 | seg_518 seg_520 seg_521 | seg_214 seg_215 |
| | | | | seg_589 seg_590 seg_591 seg_592 | seg_522 seg_523 seg_524 | |
| | | | | seg_593 seg_594 seg_595 seg_596 | seg_525 seg_526 seg_527 | |
| | | | | seg_597 seg_599 seg_600 seg_601 | seg_528 seg_529 seg_530 | |
| | | | | seg_602 seg_603 seg_604 seg_605 | seg_531 seg_532 seg_533 | |
| | | | | seg_606 seg_607 seg_608 seg_609 | seg_534 seg_535 seg_536 | |
| | | | | seg_610 seg_611 seg_612 seg_613 | seg_538 seg_539 seg_540 | |
| | | | | seg_615 seg_616 seg_617 seg_618 | seg_542 seg_543 seg_544 | |
| | | | | seg_619 seg_620 seg_622 seg_623 | seg_545 seg_546 seg_547 | |
| | | | | seg_624 seg_625 seg_626 seg_627 | seg_548 seg_549 seg_550 | |
| | | | | seg_628 seg_629 seg_630 seg_631 | seg_551 seg_552 seg_553 | |
| | | | | seg_632 seg_633 seg_634 seg_635 | seg_554 seg_555 seg_556 | |
| | | | | seg_637 seg_638 seg_639 seg_641 | seg_558 seg_559 seg_561 | |
| | | | | seg_642 seg_644 seg_645 seg_646 | seg_562 seg_563 seg_564 | |
| | | | | seg_647 seg_648 seg_649 seg_650 | seg_565 seg_566 seg_567 | |
| | | | | seg_651 seg_652 seg_654 seg_655 | seg_568 seg_570 seg_572 | |
| | | | | seg_656 seg_657 seg_658 seg_659 | seg_573 seg_574 seg_575 | |
| | | | | seg_660 seg_661 seg_662 seg_663 | seg_576 seg_577 seg_578 | |
| | | | | seg_664 seg_665 seg_666 seg_614 | seg_513 seg_519 seg_537 | |
| | | | | seg_621 seg_636 seg_640 seg_643 | seg_541 seg_557 seg_569 | |
| | | | | seg_598 seg_653 | seg_571 seg_560 | |
| Ectodermal dysplasia, anhidrotic | 305100 | Xq12-q13.1 | ED1 | seg_310 seg_311 seg_313 seg_314 | seg_286 seg_287 seg_290 | seg_111 seg_112 |
| | | | | seg_315 seg_316 seg_317 seg_318 | seg_291 seg_292 seg_294 | seg_113 seg_114 |
| | | | | seg_319 seg_320 seg_321 seg_322 | seg_295 seg_296 seg_297 | seg_115 seg_116 |
| | | | | seg_323 seg_324 seg_326 seg_328 | seg_298 seg_299 seg_302 | seg_117 seg_118 |
| | | | | seg_329 seg_330 seg_331 seg_332 | seg_303 seg_304 seg_305 | seg_119 seg_121 |
| | | | | seg_334 seg_335 seg_337 seg_338 | seg_306 seg_307 seg_308 | seg_122 seg_124 |
| | | | | seg_339 seg_340 seg_341 seg_342 | seg_309 seg_311 seg_312 | seg_125 seg_126 |
| | | | | seg_344 seg_345 seg_346 seg_347 | seg_313 seg_314 seg_315 | seg_127 seg_120 |
| | | | | seg_348 seg_349 seg_350 seg_351 | seg_316 seg_317 seg_318 | seg_123 |
| | | | | seg_352 seg_353 seg_354 seg_356 | seg_319 seg_288 seg_289 | |
| | | | | seg_312 seg_325 seg_327 seg_333 | seg_293 seg_300 seg_301 | |
| | | | | seg_336 seg_343 seg_355 | seg_310 | |
| Faciogenital dysplasia (Aarskog syndrome) | 305400 | Xp11.21 | FGD1 | seg_226 seg_227 seg_228 seg_229 | seg_251 seg_252 seg_253 | seg_101 seg_102 |
| | | | | seg_230 seg_231 seg_232 seg_233 | seg_254 seg_255 seg_256 | seg_103 seg_104 |
| | | | | seg_234 seg_235 seg_236 seg_237 | seg_257 seg_258 seg_259 | seg_105 seg_106 |
| | | | | seg_238 seg_239 seg_240 seg_242 | seg_260 seg_262 seg_263 | |
| | | | | seg_243 seg_244 seg_245 seg_246 | seg_265 seg_266 seg_267 | |
| | | | | seg_247 seg_249 seg_250 seg_251 | seg_268 seg_269 seg_270 | |
| | | | | seg_252 seg_253 seg_254 seg_256 | seg_271 seg_272 seg_273 | |
| | | | | seg_257 seg_258 seg_259 seg_260 | seg_274 seg_275 seg_276 | |
| | | | | seg_261 seg_262 seg_263 seg_264 | seg_277 seg_278 seg_279 | |

TABLE A-continued

| Disorder | OMIM # | Locus | Gene | K562 Suz12* | K562 Ezh2** | GM12878 Ezh2*** |
|---|---|---|---|---|---|---|
| Glucose-6-phosphate dehydrogenase deficiency | 305900 | Xq28 | G6PD | seg_265 seg_266 seg_267 seg_268 seg_269 seg_270 seg_271 seg_272 seg_273 seg_274 seg_275 seg_276 seg_277 seg_278 seg_279 seg_280 seg_281 seg_282 seg_284 seg_241 seg_248 seg_255 seg_283 seg_574 seg_575 seg_576 seg_577 seg_578 seg_579 seg_580 seg_581 seg_582 seg_583 seg_584 seg_585 seg_586 seg_587 seg_588 seg_589 seg_590 seg_591 seg_592 seg_593 seg_594 seg_595 seg_596 seg_597 seg_599 seg_600 seg_601 seg_602 seg_603 seg_604 seg_605 seg_606 seg_607 seg_608 seg_609 seg_610 seg_611 seg_612 seg_613 seg_615 seg_616 seg_617 seg_618 seg_619 seg_620 seg_622 seg_623 seg_624 seg_625 seg_626 seg_627 seg_628 seg_629 seg_630 seg_631 seg_632 seg_633 seg_634 seg_635 seg_637 seg_638 seg_639 seg_641 seg_642 seg_644 seg_645 seg_646 seg_647 seg_648 seg_649 seg_650 seg_651 seg_652 seg_654 seg_655 seg_656 seg_657 seg_658 seg_659 seg_660 seg_661 seg_662 seg_663 seg_664 seg_665 seg_666 seg_573 seg_614 seg_621 seg_636 seg_640 seg_643 seg_598 seg_653 | seg_280 seg_281 seg_282 seg_283 seg_261 seg_264 seg_508 seg_509 seg_510 seg_511 seg_512 seg_514 seg_515 seg_516 seg_517 seg_518 seg_520 seg_521 seg_522 seg_523 seg_524 seg_525 seg_526 seg_527 seg_528 seg_529 seg_530 seg_531 seg_532 seg_533 seg_534 seg_535 seg_536 seg_538 seg_539 seg_540 seg_542 seg_543 seg_544 seg_545 seg_546 seg_547 seg_548 seg_549 seg_550 seg_551 seg_552 seg_553 seg_554 seg_555 seg_556 seg_558 seg_559 seg_561 seg_562 seg_563 seg_564 seg_565 seg_566 seg_567 seg_568 seg_570 seg_572 seg_573 seg_574 seg_575 seg_576 seg_577 seg_578 seg_513 seg_519 seg_537 seg_541 seg_557 seg_569 seg_571 seg_560 | seg_209 seg_210 seg_211 seg_212 seg_213 seg_214 seg_215 |
| Glycogen storage disease type VIII | 306000 | Xp22.2-p22.1 | PHKA2 | seg_91 seg_92 seg_93 seg_94 seg_95 seg_96 seg_97 seg_98 seg_99 seg_100 seg_101 seg_102 seg_103 seg_104 seg_105 seg_106 seg_107 seg_108 seg_109 seg_111 seg_112 seg_113 seg_114 seg_115 seg_116 seg_117 seg_118 seg_119 seg_121 seg_122 seg_124 seg_125 seg_126 seg_127 seg_128 seg_129 seg_131 seg_132 seg_133 seg_134 seg_135 seg_136 seg_137 seg_138 seg_139 seg_140 seg_141 seg_142 seg_110 seg_123 seg_130 seg_120 | seg_111 seg_112 seg_113 seg_114 seg_115 seg_117 seg_119 seg_120 seg_121 seg_122 seg_123 seg_124 seg_125 seg_126 seg_127 seg_128 seg_130 seg_131 seg_132 seg_133 seg_134 seg_135 seg_136 seg_137 seg_138 seg_139 seg_140 seg_141 seg_142 seg_143 seg_144 seg_145 seg_146 seg_147 seg_148 seg_149 seg_150 seg_151 seg_152 seg_153 seg_156 seg_157 seg_158 seg_159 seg_160 seg_161 seg_162 seg_163 seg_164 seg_165 seg_166 seg_167 seg_168 seg_169 seg_171 seg_172 seg_173 seg_174 seg_175 seg_176 seg_177 seg_178 seg_179 | seg_35 seg_36 seg_37 seg_38 seg_39 seg_40 seg_41 seg_42 seg_43 seg_44 seg_45 seg_46 seg_47 seg_48 seg_49 seg_50 seg_51 seg_52 seg_53 seg_55 seg_56 seg_57 seg_58 seg_59 seg_61 seg_60 seg_54 |

TABLE A-continued

| Disorder | OMIM # | Locus | Gene | K562 Suz12* | K562 Ezh2** | GM12878 Ezh2*** |
|---|---|---|---|---|---|---|
| Gonadal dysgenesis (XY female type) | 306100 | Xp22.11-p21.2 | GDXY | | seg_180 seg_181 seg_182<br>seg_183 seg_184 seg_185<br>seg_186 seg_109 seg_116<br>seg_118 seg_129 seg_154<br>seg_155 seg_170 | |
| Granulomatous disease (chronic) | 306400 | Xp21.1 | CYBB | seg_165 seg_166 seg_167 seg_168<br>seg_169 seg_170 seg_171 seg_172<br>seg_173 seg_174 seg_175 seg_176<br>seg_177 seg_178 seg_179 seg_181<br>seg_182 seg_183 seg_184 seg_185<br>seg_186 seg_187 seg_188 seg_189<br>seg_191 seg_192 seg_193 seg_195<br>seg_196 seg_180 seg_190 seg_194 | seg_200 seg_201 seg_202<br>seg_203 seg_204 seg_205<br>seg_206 seg_207 seg_208<br>seg_210 seg_211 seg_212<br>seg_213 seg_214 seg_215<br>seg_216 seg_217 seg_218<br>seg_209 | seg_79 seg_80 seg_81<br>seg_82 seg_83 seg_84<br>seg_85 seg_86 seg_87<br>seg_88 seg_89 seg_90<br>seg_91 |
| Haemophilia A | 306700 | Xq28 | F8 | seg_579 seg_580 seg_581 seg_582<br>seg_583 seg_584 seg_585 seg_586<br>seg_587 seg_588 seg_589 seg_590<br>seg_591 seg_592 seg_593 seg_594<br>seg_595 seg_596 seg_597 seg_599<br>seg_600 seg_601 seg_602 seg_603<br>seg_604 seg_605 seg_606 seg_607<br>seg_608 seg_609 seg_610 seg_611<br>seg_612 seg_613 seg_615 seg_616<br>seg_617 seg_618 seg_619 seg_620<br>seg_622 seg_623 seg_624 seg_625<br>seg_626 seg_627 seg_628 seg_629<br>seg_630 seg_631 seg_632 seg_633<br>seg_634 seg_635 seg_637 seg_638<br>seg_639 seg_641 seg_642 seg_644<br>seg_645 seg_646 seg_647 seg_648<br>seg_649 seg_650 seg_651 seg_652<br>seg_654 seg_655 seg_656 seg_657<br>seg_658 seg_659 seg_660 seg_661<br>seg_662 seg_663 seg_664 seg_665<br>seg_666 seg_614 seg_621 seg_636<br>seg_640 seg_643 seg_598 seg_653 | seg_512 seg_514 seg_515<br>seg_516 seg_517 seg_518<br>seg_520 seg_521 seg_522<br>seg_523 seg_524 seg_525<br>seg_526 seg_527 seg_528<br>seg_529 seg_530 seg_531<br>seg_532 seg_533 seg_534<br>seg_535 seg_536 seg_538<br>seg_539 seg_540 seg_542<br>seg_543 seg_544 seg_545<br>seg_546 seg_547 seg_548<br>seg_549 seg_550 seg_551<br>seg_552 seg_553 seg_554<br>seg_555 seg_556 seg_558<br>seg_553 seg_561 seg_562<br>seg_563 seg_564 seg_565<br>seg_566 seg_567 seg_568<br>seg_570 seg_572 seg_573<br>seg_574 seg_575 seg_576<br>seg_577 seg_578 seg_513<br>seg_519 seg_537 seg_541<br>seg_557 seg_569 seg_571<br>seg_560 | seg_210 seg_211<br>seg_212 seg_213<br>seg_214 seg_215 |
| Haemophilia B | 306900 | Xq27.1-q27.2 | F9 | seg_506 seg_507 seg_509 seg_510<br>seg_511 seg_512 seg_513 seg_514<br>seg_515 seg_516 seg_517 seg_518<br>seg_519 seg_520 seg_521 seg_522<br>seg_523 seg_524 seg_525 seg_526<br>seg_527 seg_528 seg_529 seg_530<br>seg_531 seg_532 seg_533 seg_534<br>seg_535 seg_536 seg_537 seg_538<br>seg_540 seg_541 seg_542 seg_543<br>seg_544 seg_545 seg_546 seg_547<br>seg_548 seg_549 seg_550 seg_551 | seg_445 seg_446 seg_447<br>seg_448 seg_449 seg_450<br>seg_451 seg_452 seg_453<br>seg_454 seg_456 seg_457<br>seg_459 seg_460 seg_462<br>seg_463 seg_464 seg_465<br>seg_466 seg_467 seg_469<br>seg_470 seg_471 seg_472<br>seg_473 seg_474 seg_475<br>seg_476 seg_478 seg_480<br>seg_481 seg_482 seg_484 | seg_194 seg_195<br>seg_196 seg_197<br>seg_198 seg_200<br>seg_201 seg_202<br>seg_203 seg_204<br>seg_205 seg_206<br>seg_199 |

TABLE A-continued

| Disorder | OMIM # | Locus | Gene | K562 Suz12* | K562 Ezh2** | GM12878 Ezh2*** |
|---|---|---|---|---|---|---|
| | | | | seg_552 seg_553 seg_554 seg_555 | seg_485 seg_486 seg_487 | |
| | | | | seg_557 seg_558 seg_559 seg_505 | seg_488 seg_489 seg_490 | |
| | | | | seg_508 seg_539 seg_556 | seg_491 seg_492 seg_493 | |
| | | | | | seg_496 seg_497 seg_498 | |
| | | | | | seg_499 seg_500 seg_501 | |
| | | | | | seg_502 seg_455 seg_458 | |
| | | | | | seg_468 seg_477 seg_479 | |
| | | | | | seg_483 seg_494 seg_495 | |
| Hydrocephalus (aqueduct stenosis) | 307000 | Xq28 | L1CAM | seg_564 seg_566 seg_567 seg_568 | seg_461 | |
| | | | | seg_569 seg_571 seg_572 seg_574 | seg_504 seg_505 seg_506 | seg_209 seg_210 |
| | | | | seg_575 seg_576 seg_577 seg_578 | seg_507 seg_508 seg_509 | seg_211 seg_212 |
| | | | | seg_579 seg_580 seg_581 seg_582 | seg_510 seg_511 seg_512 | seg_213 seg_214 |
| | | | | seg_583 seg_584 seg_585 seg_586 | seg_514 seg_515 seg_516 | seg_215 |
| | | | | seg_587 seg_588 seg_589 seg_590 | seg_517 seg_518 seg_520 | |
| | | | | seg_591 seg_592 seg_593 seg_594 | seg_521 seg_522 seg_523 | |
| | | | | seg_595 seg_596 seg_597 seg_599 | seg_524 seg_525 seg_526 | |
| | | | | seg_600 seg_601 seg_602 seg_603 | seg_527 seg_528 seg_529 | |
| | | | | seg_604 seg_605 seg_606 seg_607 | seg_530 seg_531 seg_532 | |
| | | | | seg_603 seg_609 seg_610 seg_611 | seg_533 seg_534 seg_535 | |
| | | | | seg_612 seg_613 seg_615 seg_616 | seg_536 seg_538 seg_539 | |
| | | | | seg_617 seg_618 seg_619 seg_620 | seg_540 seg_542 seg_543 | |
| | | | | seg_622 seg_623 seg_624 seg_625 | seg_544 seg_545 seg_546 | |
| | | | | seg_626 seg_627 seg_628 seg_629 | seg_547 seg_548 seg_549 | |
| | | | | seg_630 seg_631 seg_632 seg_633 | seg_550 seg_551 seg_552 | |
| | | | | seg_634 seg_635 seg_637 seg_638 | seg_553 seg_554 seg_555 | |
| | | | | seg_639 seg_641 seg_642 seg_644 | seg_556 seg_558 seg_555 | |
| | | | | seg_645 seg_646 seg_647 seg_648 | seg_561 seg_562 seg_563 | |
| | | | | seg_649 seg_650 seg_651 seg_652 | seg_564 seg_565 seg_566 | |
| | | | | seg_654 seg_655 seg_656 seg_657 | seg_567 seg_568 seg_570 | |
| | | | | seg_658 seg_659 seg_660 seg_661 | seg_572 seg_573 seg_574 | |
| | | | | seg_662 seg_663 seg_664 seg_665 | seg_575 seg_576 seg_577 | |
| | | | | seg_666 seg_565 seg_570 seg_573 | seg_578 seg_513 seg_519 | |
| | | | | seg_614 seg_621 seg_636 seg_640 | seg_537 seg_541 seg_557 | |
| | | | | seg_643 seg_598 seg_653 | seg_569 seg_571 seg_560 | |
| Hypophosphataemic rickets | 307800 | Xp22.2-p22.1 | PHEX | seg_100 seg_101 seg_102 seg_103 | seg_126 seg_127 seg_128 | seg_49 seg_50 seg_51 |
| | | | | seg_104 seg_105 seg_106 seg_107 | seg_130 seg_131 seg_132 | seg_52 seg_53 seg_55 |
| | | | | seg_108 seg_109 seg_111 seg_112 | seg_133 seg_134 seg_135 | seg_56 seg_57 seg_58 |
| | | | | seg_113 seg_114 seg_115 seg_116 | seg_136 seg_137 seg_138 | seg_59 seg_61 seg_62 |
| | | | | seg_117 seg_118 seg_119 seg_121 | seg_139 seg_140 seg_141 | seg_63 seg_64 seg_60 |
| | | | | seg_122 seg_124 seg_125 seg_126 | seg_142 seg_143 seg_144 | seg_65 seg_54 |
| | | | | seg_127 seg_128 seg_129 seg_131 | seg_145 seg_146 seg_147 | |
| | | | | seg_132 seg_133 seg_134 seg_135 | seg_148 seg_149 seg_150 | |
| | | | | seg_136 seg_137 seg_138 seg_139 | seg_151 seg_152 seg_153 | |
| | | | | seg_140 seg_141 seg_142 seg_143 | seg_156 seg_157 seg_158 | |
| | | | | seg_144 seg_145 seg_147 seg_148 | seg_159 seg_160 seg_161 | |
| | | | | seg_149 seg_150 seg_151 seg_153 | seg_162 seg_163 seg_164 | |
| | | | | seg_154 seg_155 seg_156 seg_110 | seg_165 seg_166 seg_167 | |
| | | | | seg_123 seg_130 seg_146 seg_120 | seg_168 seg_169 seg_171 | |
| | | | | seg_152 | seg_172 seg_173 seg_174 | |
| | | | | | seg_175 seg_176 seg_177 | |

TABLE A-continued

| Disorder | OMIM # | Locus | Gene | K562 Suz12* | K562 Ezh2** | GM12878 Ezh2*** |
|---|---|---|---|---|---|---|
| Lesch-Nyhan syndrome (hypoxanthine-guanine-phosphoribosyl transferase deficiency) | 308000 | Xq26-q27.2 | HPRT1 | seg_479 seg_480 seg_481 seg_482<br>seg_483 seg_484 seg_485 seg_486<br>seg_487 seg_488 seg_489 seg_490<br>seg_491 seg_492 seg_493 seg_494<br>seg_495 seg_496 seg_497 seg_498<br>seg_499 seg_501 seg_502 seg_503<br>seg_504 seg_506 seg_507 seg_509<br>seg_510 seg_511 seg_512 seg_513<br>seg_514 seg_515 seg_516 seg_517<br>seg_518 seg_519 seg_520 seg_521<br>seg_522 seg_523 seg_524 seg_525<br>seg_526 seg_527 seg_528 seg_529<br>seg_530 seg_531 seg_532 seg_533<br>seg_534 seg_535 seg_536 seg_537<br>seg_538 seg_540 seg_541 seg_542<br>seg_543 seg_544 seg_545 seg_546<br>seg_547 seg_548 seg_549 seg_500<br>seg_505 seg_508 seg_539 | seg_178 seg_179 seg_180<br>seg_181 seg_182 seg_183<br>seg_184 seg_185 seg_186<br>seg_187 seg_188 seg_189<br>seg_191 seg_192 seg_193<br>seg_195 seg_129 seg_154<br>seg_190 seg_155 seg_194<br>seg_170<br>seg_421 seg_422 seg_423<br>seg_424 seg_425 seg_426<br>seg_427 seg_428 seg_429<br>seg_430 seg_431 seg_432<br>seg_433 seg_434 seg_436<br>seg_438 seg_439 seg_440<br>seg_441 seg_442 seg_443<br>seg_444 seg_445 seg_446<br>seg_447 seg_448 seg_449<br>seg_450 seg_451 seg_452<br>seg_453 seg_454 seg_456<br>seg_457 seg_459 seg_460<br>seg_462 seg_463 seg_464<br>seg_465 seg_466 seg_467<br>seg_469 seg_470 seg_471<br>seg_472 seg_473 seg_474<br>seg_475 seg_476 seg_478<br>seg_480 seg_481 seg_482<br>seg_484 seg_485 seg_486<br>seg_487 seg_488 seg_489<br>seg_490 seg_491 seg_492<br>seg_493 seg_496 seg_497<br>seg_435 seg_437 seg_455<br>seg_458 seg_468 seg_477<br>seg_479 seg_483 seg_494<br>seg_495 seg_461 | seg_187 seg_188<br>seg_189 seg_190<br>seg_191 seg_192<br>seg_193 seg_194<br>seg_195 seg_196<br>seg_197 seg_198<br>seg_200 seg_201<br>seg_202 seg_203<br>seg_199 |
| Incontinentia pigmenti | 308300 | Xq28 | IKBKG | seg_574 seg_575 seg_576 seg_577<br>seg_578 seg_579 seg_580 seg_581<br>seg_582 seg_583 seg_584 seg_585<br>seg_586 seg_587 seg_588 seg_589<br>seg_590 seg_591 seg_592 seg_593<br>seg_594 seg_595 seg_596 seg_597<br>seg_599 seg_600 seg_601 seg_602<br>seg_603 seg_604 seg_605 seg_606<br>seg_607 seg_608 seg_609 seg_610<br>seg_611 seg_612 seg_613 seg_615<br>seg_616 seg_617 seg_618 seg_619<br>seg_620 seg_622 seg_623 seg_624<br>seg_625 seg_626 seg_627 seg_628<br>seg_629 seg_630 seg_631 seg_632<br>seg_633 seg_634 seg_635 seg_637<br>seg_638 seg_639 seg_641 seg_642<br>seg_644 seg_645 seg_646 seg_647 | seg_508 seg_509 seg_510<br>seg_511 seg_512 seg_514<br>seg_515 seg_516 seg_517<br>seg_518 seg_520 seg_521<br>seg_522 seg_523 seg_524<br>seg_525 seg_526 seg_527<br>seg_528 seg_529 seg_530<br>seg_531 seg_532 seg_533<br>seg_534 seg_535 seg_536<br>seg_538 seg_539 seg_540<br>seg_542 seg_543 seg_544<br>seg_545 seg_546 seg_547<br>seg_548 seg_549 seg_550<br>seg_551 seg_552 seg_553<br>seg_554 seg_555 seg_556<br>seg_558 seg_559 seg_561<br>seg_562 seg_563 seg_564 | seg_209 seg_210<br>seg_211 seg_212<br>seg_213 seg_214<br>seg_215 |

TABLE A-continued

| Disorder | OMIM # | Locus | Gene | K562 Suz12* | K562 Ezh2** | GM12878 Ezh2*** |
|---|---|---|---|---|---|---|
| | | | | seg_648 seg_649 seg_650 seg_651 | seg_565 seg_566 seg_567 | |
| | | | | seg_652 seg_654 seg_655 seg_656 | seg_568 seg_570 seg_572 | |
| | | | | seg_657 seg_658 seg_659 seg_660 | seg_573 seg_574 seg_575 | |
| | | | | seg_661 seg_662 seg_663 seg_664 | seg_576 seg_577 seg_578 | |
| | | | | seg_665 seg_666 seg_573 seg_614 | seg_513 seg_519 seg_537 | |
| | | | | seg_621 seg_636 seg_640 seg_643 | seg_541 seg_557 seg_569 | |
| | | | | seg_598 seg_653 | seg_571 seg_560 | |
| Kallmann syndrome | 308700 | Xp22.3 | KAL1 | seg_48 seg_49 seg_50 seg_51 seg_52 | seg_52 seg_53 seg_54 | seg_8 seg_9 seg_10 |
| | | | | seg_55 seg_54 seg_55 seg_56 seg_57 | seg_55 seg_56 seg_57 | seg_11 seg_12 seg_13 |
| | | | | seg_58 seg_59 seg_60 seg_61 seg_63 | seg_58 seg_60 seg_61 | seg_14 seg_16 seg_17 |
| | | | | seg_64 seg_65 seg_66 seg_67 seg_68 | seg_63 seg_64 seg_65 | seg_18 seg_19 seg_20 |
| | | | | seg_69 seg_70 seg_71 seg_73 seg_74 | seg_66 seg_67 seg_68 | seg_21 seg_22 seg_23 |
| | | | | seg_75 seg_76 seg_77 seg_78 seg_79 | seg_69 seg_70 seg_71 | seg_24 seg_25 seg_26 |
| | | | | seg_80 seg_81 seg_82 seg_83 seg_84 | seg_72 seg_73 seg_74 | seg_27 seg_28 seg_29 |
| | | | | seg_85 seg_47 seg_62 seg_72 | seg_75 seg_76 seg_77 | seg_15 |
| | | | | | seg_78 seg_79 seg_80 | |
| | | | | | seg_81 seg_82 seg_83 | |
| | | | | | seg_84 seg_85 seg_86 | |
| | | | | | seg_87 seg_88 seg_89 | |
| | | | | | seg_91 seg_92 seg_93 | |
| | | | | | seg_95 seg_96 seg_97 | |
| | | | | | seg_98 seg_59 seg_62 | |
| | | | | | seg_90 seg_94 | |
| Keratosis follicularis spinulosa | 308800 | Xp22.1 | SAT | seg_112 seg_113 seg_114 seg_115 | seg_145 seg_146 seg_147 | seg_56 seg_57 seg_58 |
| | | | | seg_116 seg_117 seg_118 seg_119 | seg_148 seg_149 seg_150 | seg_59 seg_61 seg_62 |
| | | | | seg_121 seg_122 seg_124 seg_125 | seg_151 seg_152 seg_153 | seg_63 seg_64 seg_60 |
| | | | | seg_126 seg_127 seg_128 seg_129 | seg_156 seg_157 seg_158 | seg_65 seg_54 |
| | | | | seg_131 seg_132 seg_133 seg_134 | seg_159 seg_160 seg_161 | |
| | | | | seg_135 seg_136 seg_137 seg_138 | seg_162 seg_163 seg_164 | |
| | | | | seg_139 seg_140 seg_141 seg_142 | seg_165 seg_166 seg_167 | |
| | | | | seg_143 seg_144 seg_145 seg_147 | seg_168 seg_169 seg_171 | |
| | | | | seg_148 seg_149 seg_150 seg_151 | seg_172 seg_173 seg_174 | |
| | | | | seg_153 seg_154 seg_155 seg_156 | seg_175 seg_176 seg_177 | |
| | | | | seg_157 seg_110 seg_123 seg_130 | seg_178 seg_179 seg_180 | |
| | | | | seg_146 seg_120 seg_152 | seg_181 seg_182 seg_183 | |
| | | | | | seg_184 seg_185 seg_186 | |
| | | | | | seg_187 seg_188 seg_189 | |
| | | | | | seg_191 seg_192 seg_193 | |
| | | | | | seg_195 seg_154 seg_170 | |
| Lowe (oculocerebrorenal) syndrome | 309000 | Xq26.1 | OCRL | seg_474 seg_475 seg_477 seg_478 | seg_420 seg_421 seg_422 | seg_185 seg_186 |
| | | | | seg_479 seg_480 seg_481 seg_482 | seg_423 seg_424 seg_425 | seg_187 seg_188 |
| | | | | seg_483 seg_484 seg_485 seg_486 | seg_426 seg_427 seg_428 | seg_189 seg_190 |
| | | | | seg_487 seg_488 seg_489 seg_490 | seg_429 seg_430 seg_431 | seg_191 seg_192 |
| | | | | seg_491 seg_492 seg_493 seg_494 | seg_432 seg_433 seg_434 | seg_183 |
| | | | | seg_495 seg_496 seg_497 seg_498 | seg_436 seg_438 seg_439 | |
| | | | | seg_499 seg_501 seg_502 seg_503 | seg_440 seg_441 seg_442 | |
| | | | | seg_476 seg_500 | seg_443 seg_435 seg_437 | |
| Menkes syndrome | 309400 | Xq12-q13 | ATP7A | seg_353 seg_354 seg_356 seg_358 | seg_317 seg_318 seg_319 | seg_128 seg_129 |
| | | | | seg_359 seg_360 seg_361 seg_362 | | seg_130 seg_131 |
| | | | | seg_363 seg_364 seg_365 seg_366 | | seg_133 seg_134 |

TABLE A-continued

| Disorder | OMIM # | Locus | Gene | K562 Suz12* | K562 Ezh2** | GM12878 Ezh2*** |
|---|---|---|---|---|---|---|
| Renpenning Syndrome | 309500 | Xp11.23 | PQBP1 | seg_355 seg_357<br>seg_199 seg_201 seg_203 seg_204<br>seg_205 seg_206 seg_207 seg_208<br>seg_209 seg_210 seg_211 seg_212<br>seg_213 seg_214 seg_215 seg_216<br>seg_217 seg_218 seg_219 seg_220<br>seg_221 seg_222 seg_223 seg_224<br>seg_225 seg_226 seg_227 seg_228<br>seg_229 seg_230 seg_231 seg_232<br>seg_233 seg_234 seg_235 seg_236<br>seg_237 seg_238 seg_239 seg_240<br>seg_242 seg_243 seg_244 seg_245<br>seg_246 seg_247 seg_249 seg_250<br>seg_251 seg_252 seg_253 seg_254<br>seg_256 seg_257 seg_258 seg_259<br>seg_260 seg_261 seg_262 seg_263<br>seg_264 seg_200 seg_202 seg_241<br>seg_248 seg_255 | seg_220 seg_221 seg_222<br>seg_223 seg_224 seg_225<br>seg_226 seg_227 seg_228<br>seg_229 seg_230 seg_232<br>seg_234 seg_235 seg_236<br>seg_237 seg_238 seg_239<br>seg_240 seg_241 seg_242<br>seg_243 seg_245 seg_246<br>seg_247 seg_248 seg_249<br>seg_250 seg_251 seg_252<br>seg_253 seg_254 seg_255<br>seg_256 seg_257 seg_258<br>seg_259 seg_260 seg_262<br>seg_263 seg_265 seg_266<br>seg_267 seg_268 seg_269<br>seg_270 seg_271 seg_231<br>seg_233 seg_244 seg_261<br>seg_264 | seg_135 seg_132<br>seg_96 seg_97 seg_98<br>seg_99 seg_100<br>seg_101 seg_102<br>seg_103 seg_104<br>seg_105 seg_93<br>seg_95 |
| Mental retardation, with or without fragile site (numerous specific types) | 309530 | Xp11.3-q21.1 | MRX1 | seg_218 seg_219 seg_220 seg_221<br>seg_222 seg_223 seg_224 seg_225<br>seg_226 seg_227 seg_228 seg_229<br>seg_230 seg_231 seg_232 seg_233<br>seg_234 seg_235 seg_236 seg_237<br>seg_238 seg_239 seg_240 seg_242<br>seg_243 seg_244 seg_245 seg_246<br>seg_247 seg_249 seg_250 seg_251<br>seg_252 seg_253 seg_254 seg_256<br>seg_257 seg_258 seg_259 seg_260<br>seg_261 seg_262 seg_263 seg_264<br>seg_265 seg_266 seg_267 seg_268<br>seg_269 seg_270 seg_271 seg_272<br>seg_273 seg_274 seg_275 seg_276<br>seg_277 seg_278 seg_279 seg_241<br>seg_248 seg_255 | seg_245 seg_246 seg_247<br>seg_248 seg_249 seg_250<br>seg_251 seg_252 seg_253<br>seg_254 seg_255 seg_256<br>seg_257 seg_258 seg_259<br>seg_260 seg_262 seg_263<br>seg_265 seg_266 seg_267<br>seg_268 seg_269 seg_270<br>seg_271 seg_272 seg_273<br>seg_274 seg_275 seg_276<br>seg_277 seg_278 seg_279<br>seg_280 seg_281 seg_282<br>seg_283 seg_244 seg_261<br>seg_264 | seg_101 seg_102<br>seg_103 seg_104<br>seg_105 seg_106 |
| Coffin-Lowry syndrome | 309580 | Xq13 | ATRX | seg_350 seg_351 seg_352 seg_353<br>seg_354 seg_356 seg_358 seg_359<br>seg_360 seg_361 seg_362 seg_363<br>seg_364 seg_365 seg_366 seg_355<br>seg_357 | seg_317 seg_318 seg_319 | |
| Microphthalmia with multiple anomalies (Lenz syndrome) | 309800 | Xq27-q28 | MAA | seg_561 seg_562 seg_563 seg_564<br>seg_566 seg_567 seg_568 seg_569<br>seg_571 seg_572 seg_574 seg_575<br>seg_576 seg_577 seg_578 seg_579<br>seg_580 seg_581 seg_582 seg_583<br>seg_584 seg_585 seg_586 seg_587<br>seg_588 seg_589 seg_590 seg_591<br>seg_592 seg_593 seg_594 seg_595<br>seg_596 seg_565 seg_560 seg_570<br>seg_573 | seg_503 seg_504 seg_505<br>seg_506 seg_507 seg_508<br>seg_509 seg_510 seg_511<br>seg_512 seg_514 seg_515<br>seg_516 seg_517 seg_518<br>seg_520 seg_521 seg_522<br>seg_523 seg_524 seg_525<br>seg_526 seg_527 seg_528<br>seg_529 seg_530 seg_531<br>seg_513 seg_519 | seg_208 seg_209<br>seg_210 seg_211<br>seg_212 |
| Muscular | 310300 | Xq28 | EMD | seg_567 seg_568 seg_569 seg_571 | seg_504 seg_505 seg_506 | seg_209 seg_210 |

TABLE A-continued

| Disorder | OMIM # | Locus | Gene | K562 Suz12* | K562 Ezh2** | GM12878 Ezh2*** |
|---|---|---|---|---|---|---|
| dystrophy (Becker, Duchenne and Emery-Dreifuss types) | | | | seg_572 seg_574 seg_575 seg_576<br>seg_577 seg_578 seg_579 seg_580<br>seg_581 seg_582 seg_583 seg_584<br>seg_585 seg_586 seg_587 seg_588<br>seg_589 seg_590 seg_591 seg_592<br>seg_593 seg_594 seg_595 seg_596<br>seg_597 seg_599 seg_600 seg_601<br>seg_602 seg_603 seg_604 seg_605<br>seg_606 seg_607 seg_608 seg_609<br>seg_610 seg_611 seg_612 seg_613<br>seg_615 seg_616 seg_617 seg_618<br>seg_619 seg_620 seg_622 seg_623<br>seg_624 seg_625 seg_626 seg_627<br>seg_628 seg_629 seg_630 seg_631<br>seg_632 seg_633 seg_634 seg_635<br>seg_637 seg_638 seg_639 seg_641<br>seg_642 seg_644 seg_645 seg_646<br>seg_647 seg_648 seg_649 seg_650<br>seg_651 seg_652 seg_654 seg_655<br>seg_656 seg_657 seg_658 seg_659<br>seg_660 seg_661 seg_662 seg_663<br>seg_664 seg_665 seg_666 seg_670<br>seg_573 seg_614 seg_621 seg_636<br>seg_640 seg_643 seg_598 seg_653 | seg_507 seg_508 seg_509<br>seg_510 seg_511 seg_512<br>seg_514 seg_515 seg_516<br>seg_517 seg_518 seg_520<br>seg_521 seg_522 seg_523<br>seg_524 seg_525 seg_526<br>seg_527 seg_528 seg_529<br>seg_530 seg_531 seg_532<br>seg_533 seg_534 seg_535<br>seg_536 seg_538 seg_539<br>seg_540 seg_542 seg_543<br>seg_544 seg_545 seg_546<br>seg_547 seg_548 seg_549<br>seg_550 seg_551 seg_552<br>seg_553 seg_554 seg_555<br>seg_556 seg_558 seg_559<br>seg_561 seg_562 seg_563<br>seg_564 seg_565 seg_566<br>seg_567 seg_568 seg_570<br>seg_572 seg_573 seg_574<br>seg_575 seg_576 seg_577<br>seg_578 seg_513 seg_519<br>seg_537 seg_541 seg_557<br>seg_569 seg_571 seg_560 | seg_211 seg_212<br>seg_213 seg_214<br>seg_215 |
| Myotubular myopathy | 310400 | Xq28 | MTM1 | seg_562 seg_563 seg_564 seg_566<br>seg_567 seg_568 seg_569 seg_571<br>seg_572 seg_574 seg_575 seg_576<br>seg_577 seg_578 seg_579 seg_580<br>seg_581 seg_582 seg_583 seg_584<br>seg_585 seg_586 seg_587 seg_588<br>seg_589 seg_590 seg_591 seg_592<br>seg_593 seg_594 seg_595 seg_596<br>seg_597 seg_599 seg_600 seg_601<br>seg_602 seg_603 seg_604 seg_605<br>seg_606 seg_607 seg_608 seg_609<br>seg_610 seg_611 seg_612 seg_613<br>seg_615 seg_616 seg_617 seg_618<br>seg_619 seg_620 seg_622 seg_623<br>seg_624 seg_625 seg_626 seg_627<br>seg_628 seg_629 seg_630 seg_631<br>seg_632 seg_633 seg_634 seg_635<br>seg_637 seg_638 seg_639 seg_641<br>seg_642 seg_644 seg_645 seg_646<br>seg_647 seg_648 seg_649 seg_650<br>seg_651 seg_652 seg_654 seg_655<br>seg_656 seg_657 seg_658 seg_659<br>seg_660 seg_661 seg_662 seg_560<br>seg_565 seg_570 seg_573 seg_614<br>seg_621 seg_636 seg_640 seg_643 | seg_504 seg_505 seg_506<br>seg_507 seg_508 seg_509<br>seg_510 seg_511 seg_512<br>seg_514 seg_515 seg_516<br>seg_517 seg_518 seg_520<br>seg_521 seg_522 seg_523<br>seg_524 seg_525 seg_526<br>seg_527 seg_528 seg_529<br>seg_530 seg_531 seg_532<br>seg_533 seg_534 seg_535<br>seg_536 seg_538 seg_539<br>seg_540 seg_542 seg_543<br>seg_544 seg_545 seg_546<br>seg_547 seg_548 seg_549<br>seg_550 seg_551 seg_552<br>seg_553 seg_554 seg_555<br>seg_556 seg_558 seg_559<br>seg_561 seg_562 seg_563<br>seg_564 seg_565 seg_566<br>seg_567 seg_568 seg_570<br>seg_572 seg_573 seg_574<br>seg_575 seg_576 seg_577<br>seg_513 seg_519 seg_537<br>seg_541 seg_557 seg_569 | seg_208 seg_209<br>seg_210 seg_211<br>seg_212 seg_213<br>seg_214 seg_215 |
| Night | 310500 | Xp11.4 | CSNB1 | seg_167 seg_168 seg_169 seg_170 | seg_200 seg_201 seg_202 | seg_80 seg_81 seg_82 |

TABLE A-continued

| Disorder | OMIM # | Locus | Gene | K562 Suz12* | K562 Ezh2** | GM12878 Ezh2*** |
|---|---|---|---|---|---|---|
| blindness, congenital stationary | | | | seg_171 seg_172 seg_173 seg_174 seg_175 seg_176 seg_177 seg_178 seg_179 seg_181 seg_182 seg_183 seg_184 seg_185 seg_186 seg_187 seg_188 seg_189 seg_191 seg_192 seg_193 seg_195 seg_196 seg_197 seg_198 seg_199 seg_201 seg_180 seg_190 seg_194 seg_200 | seg_203 seg_204 seg_205 seg_206 seg_207 seg_208 seg_210 seg_211 seg_212 seg_213 seg_214 seg_215 seg_216 seg_217 seg_218 seg_219 seg_220 seg_221 seg_222 seg_223 seg_224 seg_225 seg_209 | seg_83 seg_84 seg_85 seg_86 seg_87 seg_88 seg_89 seg_90 seg_91 seg_92 seg_94 seg_93 |
| Norrie's disease (pseudoglioma) | 310600 | Xp11.4 | NDP | seg_174 seg_175 seg_176 seg_177 seg_178 seg_179 seg_181 seg_182 seg_133 seg_184 seg_185 seg_186 seg_187 seg_188 seg_189 seg_191 seg_192 seg_193 seg_195 seg_196 seg_197 seg_198 seg_199 seg_201 seg_203 seg_204 seg_205 seg_206 seg_207 seg_208 seg_209 seg_210 seg_211 seg_212 seg_213 seg_214 seg_215 seg_216 seg_217 seg_180 seg_190 seg_194 seg_200 seg_202 | seg_208 seg_210 seg_211 seg_212 seg_213 seg_214 seg_215 seg_216 seg_217 seg_218 seg_219 seg_220 seg_221 seg_222 seg_223 seg_224 seg_225 seg_226 seg_227 seg_228 seg_229 seg_230 seg_232 seg_234 seg_235 seg_236 seg_237 seg_238 seg_239 seg_240 seg_241 seg_242 seg_243 seg_209 seg_231 seg_233 seg_244 | seg_85 seg_86 seg_87 seg_88 seg_89 seg_90 seg_91 seg_92 seg_94 seg_96 seg_97 seg_98 seg_99 seg_93 seg_95 |
| Nystagmus, oculomotor or 'jerky' | 310700 | Xq26-q27 | NYS1 | seg_475 seg_477 seg_478 seg_479 seg_480 seg_481 seg_482 seg_483 seg_484 seg_485 seg_486 seg_487 seg_488 seg_489 seg_490 seg_491 seg_492 seg_493 seg_494 seg_495 seg_496 seg_497 seg_498 seg_499 seg_501 seg_502 seg_503 seg_504 seg_506 seg_507 seg_509 seg_510 seg_511 seg_512 seg_513 seg_514 seg_515 seg_516 seg_517 seg_518 seg_519 seg_520 seg_521 seg_522 seg_523 seg_524 seg_525 seg_526 seg_527 seg_528 seg_529 seg_530 seg_531 seg_532 seg_533 seg_534 seg_535 seg_536 seg_537 seg_538 seg_540 seg_541 seg_542 seg_476 seg_500 seg_505 seg_508 seg_539 | seg_421 seg_422 seg_423 seg_424 seg_425 seg_426 seg_427 seg_428 seg_429 seg_430 seg_431 seg_432 seg_433 seg_434 seg_436 seg_438 seg_439 seg_440 seg_441 seg_442 seg_443 seg_444 seg_445 seg_446 seg_447 seg_448 seg_449 seg_450 seg_451 seg_452 seg_453 seg_454 seg_456 seg_457 seg_459 seg_460 seg_462 seg_463 seg_464 seg_465 seg_466 seg_467 seg_469 seg_470 seg_471 seg_472 seg_473 seg_474 seg_475 seg_476 seg_478 seg_480 seg_481 seg_482 seg_484 seg_485 seg_486 seg_487 seg_488 seg_489 seg_490 seg_491 seg_492 seg_493 seg_435 seg_437 seg_455 seg_458 seg_468 seg_477 seg_479 seg_483 seg_494 seg_461 | seg_186 seg_187 seg_188 seg_189 seg_190 seg_191 seg_192 seg_193 seg_194 seg_195 seg_196 seg_197 seg_198 seg_199 |
| Orofaciodigital syndrome (type I) | 311200 | Xp22.3-p22.2 | OFD1 | seg_52 seg_53 seg_54 seg_55 seg_56 seg_57 seg_58 seg_59 seg_60 seg_61 seg_63 seg_64 seg_65 seg_66 seg_67 seg_68 seg_69 seg_70 seg_71 seg_73 seg_74 seg_75 seg_76 seg_77 seg_78 | seg_56 seg_57 seg_58 seg_60 seg_61 seg_63 seg_64 seg_65 seg_66 seg_67 seg_68 seg_69 seg_70 seg_71 seg_72 | seg_14 seg_16 seg_17 seg_18 seg_19 seg_20 seg_21 seg_22 seg_23 seg_24 seg_25 seg_26 seg_27 seg_28 seg_29 |

TABLE A-continued

| Disorder | OMIM # | Locus | Gene | K562 Suz12* | K562 Ezh2** | GM12878 Ezh2*** |
|---|---|---|---|---|---|---|
| | | | | seg_79 seg_80 seg_81 seg_82 seg_83 | seg_73 seg_74 seg_75 | seg_30 seg_31 seg_32 |
| | | | | seg_84 seg_85 seg_86 seg_87 seg_88 | seg_76 seg_77 seg_78 | seg_33 seg_34 seg_35 |
| | | | | seg_89 seg_90 seg_91 seg_92 seg_93 | seg_79 seg_80 seg_81 | seg_36 seg_37 seg_38 |
| | | | | seg_94 seg_95 seg_96 seg_97 seg_98 | seg_82 seg_83 seg_84 | seg_39 seg_40 seg_41 |
| | | | | seg_99 seg_100 seg_101 seg_102 | seg_85 seg_86 seg_87 | seg_42 seg_43 seg_44 |
| | | | | seg_103 seg_104 seg_105 seg_106 | seg_88 seg_89 seg_91 | seg_45 seg_46 seg_47 |
| | | | | seg_107 seg_108 seg_109 seg_62 | seg_92 seg_93 seg_95 | seg_48 seg_49 seg_50 |
| | | | | seg_72 | seg_96 seg_97 seg_98 | seg_51 seg_52 seg_53 |
| | | | | | seg_99 seg_100 seg_101 | seg_15 |
| | | | | | seg_102 seg_103 seg_104 | |
| | | | | | seg_106 seg_107 seg_108 | |
| | | | | | seg_110 seg_111 seg_112 | |
| | | | | | seg_113 seg_114 seg_115 | |
| | | | | | seg_117 seg_119 seg_120 | |
| | | | | | seg_121 seg_122 seg_123 | |
| | | | | | seg_124 seg_125 seg_126 | |
| | | | | | seg_127 seg_128 seg_130 | |
| | | | | | seg_131 seg_132 seg_133 | |
| | | | | | seg_134 seg_135 seg_136 | |
| | | | | | seg_137 seg_138 seg_139 | |
| | | | | | seg_140 seg_141 seg_142 | |
| | | | | | seg_143 seg_59 seg_62 | |
| | | | | | seg_90 seg_94 seg_105 | |
| | | | | | seg_109 seg_116 seg_118 | |
| | | | | | seg_129 | |
| Ornithine transcarbamylase deficiency (type I hyperammonaemia) | 311250 | Xp21.1 | OTC | seg_165 seg_166 seg_167 seg_168 | seg_200 seg_201 seg_202 | seg_80 seg_81 seg_82 |
| | | | | seg_169 seg_170 seg_171 seg_172 | seg_203 seg_204 seg_205 | seg_83 seg_84 seg_85 |
| | | | | seg_173 seg_174 seg_175 seg_176 | seg_206 seg_207 seg_208 | seg_86 seg_87 seg_88 |
| | | | | seg_177 seg_178 seg_179 seg_181 | seg_210 seg_211 seg_212 | seg_89 seg_90 seg_91 |
| | | | | seg_182 seg_183 seg_184 seg_185 | seg_213 seg_214 seg_215 | seg_92 |
| | | | | seg_186 seg_187 seg_188 seg_189 | seg_216 seg_217 seg_218 | |
| | | | | seg_191 seg_192 seg_193 seg_195 | seg_209 | |
| | | | | seg_196 seg_180 seg_190 seg_194 | | |
| Phosphoglycerate kinase deficiency | 311800 | Xq13 | PGK1 | seg_353 seg_354 seg_356 seg_358 | seg_317 seg_318 seg_319 | seg_128 seg_129 |
| | | | | seg_359 seg_360 seg_361 seg_362 | | seg_130 seg_131 |
| | | | | seg_383 seg_364 seg_365 seg_366 | | seg_133 seg_134 |
| | | | | seg_355 seg_357 | | seg_135 seg_132 |
| Phosphoribosyl-pyrophosphate synthetase deficiency | 311850 | Xq22-q24 | PRPS1 | seg_392 seg_393 seg_394 seg_395 | seg_329 seg_331 seg_332 | seg_145 seg_146 |
| | | | | seg_396 seg_397 seg_398 seg_399 | seg_333 seg_334 seg_336 | seg_148 seg_149 |
| | | | | seg_400 seg_401 seg_402 seg_403 | seg_337 seg_338 seg_339 | seg_150 seg_152 |
| | | | | seg_404 seg_405 seg_406 seg_407 | seg_340 seg_341 seg_342 | seg_156 seg_157 |
| | | | | seg_408 seg_409 seg_410 seg_411 | seg_343 seg_344 seg_345 | seg_158 seg_159 |
| | | | | seg_412 seg_413 seg_414 seg_415 | seg_346 seg_347 seg_348 | seg_160 seg_161 |
| | | | | seg_417 seg_418 seg_419 seg_420 | seg_349 seg_350 seg_351 | seg_162 seg_163 |
| | | | | seg_421 seg_423 seg_425 seg_426 | seg_352 seg_353 seg_355 | seg_164 seg_165 |
| | | | | seg_427 seg_428 seg_431 seg_432 | seg_356 seg_357 seg_358 | seg_166 seg_147 |
| | | | | seg_434 seg_390 seg_416 seg_422 | seg_362 seg_363 seg_364 | seg_153 seg_154 |
| | | | | seg_424 seg_429 seg_430 seg_435 | seg_365 seg_366 seg_367 | seg_155 seg_151 |
| | | | | seg_433 | seg_368 seg_369 seg_370 | |
| | | | | | seg_371 seg_372 seg_373 | |
| | | | | | seg_374 seg_375 seg_330 | |

TABLE A-continued

| Disorder | OMIM # | Locus | Gene | K562 Suz12* | K562 Ezh2** | GM12878 Ezh2*** |
|---|---|---|---|---|---|---|
| Retinitis pigmentosa | 312610 | Xp21.1 | RPGR | seg_165 seg_166 seg_167 seg_168 seg_169 seg_170 seg_171 seg_172 seg_173 seg_174 seg_175 seg_176 seg_177 seg_178 seg_179 seg_181 seg_182 seg_183 seg_184 seg_185 seg_186 seg_187 seg_188 seg_189 seg_191 seg_192 seg_193 seg_195 seg_196 seg_180 seg_190 seg_194 | seg_335 seg_354 seg_359 seg_360 seg_361 seg_200 seg_201 seg_202 seg_203 seg_204 seg_205 seg_206 seg_207 seg_208 seg_210 seg_211 seg_212 seg_213 seg_214 seg_215 seg_216 seg_217 seg_218 seg_209 | seg_80 seg_81 seg_82 seg_83 seg_84 seg_85 seg_86 seg_87 seg_88 seg_89 seg_90 seg_91 |
| Retinoschisis | 312700 | Xp22.2-p22.1 | RS1 | seg_87 seg_88 seg_89 seg_90 seg_91 seg_92 seg_93 seg_94 seg_95 seg_96 seg_97 seg_98 seg_99 seg_100 seg_101 seg_102 seg_103 seg_104 seg_105 seg_106 seg_107 seg_108 seg_109 seg_111 seg_112 seg_113 seg_114 seg_115 seg_116 seg_117 seg_118 seg_119 seg_121 seg_122 seg_124 seg_125 seg_126 seg_127 seg_128 seg_129 seg_131 seg_132 seg_133 seg_134 seg_135 seg_136 seg_137 seg_138 seg_139 seg_140 seg_110 seg_123 seg_130 seg_120 | seg_101 seg_102 seg_103 seg_104 seg_106 seg_107 seg_108 seg_110 seg_111 seg_112 seg_113 seg_114 seg_115 seg_117 seg_119 seg_120 seg_121 seg_122 seg_123 seg_124 seg_125 seg_126 seg_127 seg_128 seg_130 seg_131 seg_132 seg_133 seg_134 seg_135 seg_136 seg_137 seg_138 seg_139 seg_140 seg_141 seg_142 seg_143 seg_144 seg_145 seg_146 seg_147 seg_148 seg_149 seg_150 seg_151 seg_152 seg_153 seg_156 seg_157 seg_158 seg_159 seg_160 seg_161 seg_162 seg_163 seg_164 seg_165 seg_166 seg_167 seg_168 seg_169 seg_171 seg_172 seg_173 seg_174 seg_175 seg_176 seg_177 seg_178 seg_179 seg_180 seg_181 seg_182 seg_183 seg_184 seg_185 seg_105 seg_109 seg_116 seg_118 seg_129 seg_154 seg_155 seg_170 | seg_31 seg_32 seg_33 seg_34 seg_35 seg_36 seg_37 seg_38 seg_39 seg_40 seg_41 seg_42 seg_43 seg_44 seg_45 seg_46 seg_47 seg_48 seg_49 seg_50 seg_51 seg_52 seg_53 seg_55 seg_56 seg_57 seg_58 seg_59 seg_61 seg_60 seg_54 |
| Rett syndrome | 312750 | Xq28, Xp22 | MECP2 | seg_564 seg_566 seg_567 seg_568 seg_569 seg_571 seg_572 seg_574 seg_575 seg_576 seg_577 seg_578 seg_579 seg_580 seg_581 seg_582 seg_583 seg_584 seg_585 seg_586 seg_587 seg_588 seg_589 seg_590 seg_591 seg_592 seg_593 seg_594 seg_595 seg_596 seg_597 seg_599 seg_600 seg_601 seg_602 seg_603 seg_604 seg_605 seg_606 seg_607 seg_608 seg_609 seg_610 seg_611 seg_612 seg_613 seg_615 seg_616 | seg_504 seg_505 seg_506 seg_507 seg_508 seg_509 seg_510 seg_511 seg_512 seg_514 seg_515 seg_516 seg_517 seg_518 seg_520 seg_521 seg_522 seg_523 seg_524 seg_525 seg_526 seg_527 seg_528 seg_529 seg_530 seg_531 seg_532 seg_533 seg_534 seg_535 seg_536 seg_538 seg_539 seg_540 seg_542 seg_543 | seg_209 seg_210 seg_211 seg_212 seg_213 seg_214 seg_215 |

TABLE A-continued

| Disorder | OMIM # | Locus | Gene | K562 Suz12* | K562 Ezh2** | GM12878 Ezh2*** |
|---|---|---|---|---|---|---|
| | | | | seg_617 seg_618 seg_619 seg_620 | seg_544 seg_545 seg_546 | |
| | | | | seg_622 seg_623 seg_624 seg_625 | seg_547 seg_548 seg_549 | |
| | | | | seg_626 seg_627 seg_628 seg_629 | seg_550 seg_551 seg_552 | |
| | | | | seg_630 seg_631 seg_632 seg_633 | seg_553 seg_554 seg_555 | |
| | | | | seg_634 seg_635 seg_637 seg_638 | seg_556 seg_558 seg_559 | |
| | | | | seg_639 seg_641 seg_642 seg_644 | seg_561 seg_562 seg_563 | |
| | | | | seg_645 seg_646 seg_647 seg_648 | seg_564 seg_565 seg_566 | |
| | | | | seg_649 seg_650 seg_651 seg_652 | seg_567 seg_568 seg_570 | |
| | | | | seg_654 seg_655 seg_656 seg_657 | seg_572 seg_573 seg_574 | |
| | | | | seg_658 seg_659 seg_660 seg_661 | seg_575 seg_576 seg_577 | |
| | | | | seg_662 seg_663 seg_664 seg_665 | seg_578 seg_513 seg_519 | |
| | | | | seg_666 seg_565 seg_570 seg_573 | seg_537 seg_541 seg_557 | |
| | | | | seg_614 seg_621 seg_636 seg_640 | seg_569 seg_571 seg_560 | |
| | | | | seg_643 seg_598 seg_653 | | |
| Muscular atrophy/ Dihydro-testosterone receptor deficiency | 313200 | Xq11-q12 | AR | seg_296 seg_297 seg_298 seg_300 | seg_285 seg_286 seg_287 | seg_108 seg_109 |
| | | | | seg_302 seg_305 seg_306 seg_307 | seg_290 seg_291 seg_292 | seg_110 seg_111 |
| | | | | seg_308 seg_309 seg_310 seg_311 | seg_294 seg_295 seg_296 | seg_112 seg_113 |
| | | | | seg_313 seg_314 seg_315 seg_316 | seg_297 seg_298 seg_299 | seg_114 seg_115 |
| | | | | seg_317 seg_318 seg_319 seg_320 | seg_302 seg_303 seg_304 | seg_116 seg_117 |
| | | | | seg_321 seg_322 seg_323 seg_324 | seg_305 seg_306 seg_307 | seg_118 seg_119 |
| | | | | seg_326 seg_328 seg_329 seg_330 | seg_308 seg_309 seg_311 | seg_121 seg_122 |
| | | | | seg_331 seg_332 seg_334 seg_335 | seg_312 seg_313 seg_288 | seg_124 seg_125 |
| | | | | seg_337 seg_338 seg_339 seg_340 | seg_289 seg_293 seg_300 | seg_120 seg_123 |
| | | | | seg_341 seg_342 seg_344 seg_345 | seg_301 seg_310 | |
| | | | | seg_295 seg_299 seg_301 seg_303 | | |
| | | | | seg_304 seg_312 seg_325 seg_327 | | |
| | | | | seg_333 seg_336 seg_343 | | |
| Spinal muscular atrophy | 313200 | Xq11-q12 | AR | seg_296 seg_297 seg_298 seg_300 | seg_285 seg_286 seg_287 | seg_108 seg_109 |
| | | | | seg_302 seg_305 seg_306 seg_307 | seg_290 seg_291 seg_292 | seg_110 seg_111 |
| | | | | seg_308 seg_309 seg_310 seg_311 | seg_294 seg_295 seg_296 | seg_112 seg_113 |
| | | | | seg_313 seg_314 seg_315 seg_316 | seg_297 seg_298 seg_299 | seg_114 seg_115 |
| | | | | seg_317 seg_318 seg_319 seg_320 | seg_302 seg_303 seg_304 | seg_116 seg_117 |
| | | | | seg_321 seg_322 seg_323 seg_324 | seg_305 seg_306 seg_307 | seg_118 seg_119 |
| | | | | seg_326 seg_328 seg_329 seg_330 | seg_308 seg_309 seg_311 | seg_121 seg_122 |
| | | | | seg_331 seg_332 seg_334 seg_335 | seg_312 seg_313 seg_288 | seg_124 seg_125 |
| | | | | seg_337 seg_338 seg_339 seg_340 | seg_289 seg_293 seg_300 | seg_120 seg_123 |
| | | | | seg_341 seg_342 seg_344 seg_345 | seg_301 seg_310 | |
| | | | | seg_295 seg_299 seg_301 seg_303 | | |
| | | | | seg_304 seg_312 seg_325 seg_327 | | |
| | | | | seg_333 seg_336 seg_343 | | |
| Spondyloepiphyseal dysplasia tarda | 313400 | Xp22.2-p22.1 | SEDL | seg_52 seg_53 seg_54 seg_55 seg_56 | seg_56 seg_57 seg_58 | seg_14 seg_16 seg_17 |
| | | | | seg_57 seg_58 seg_59 seg_60 seg_61 | seg_60 seg_61 seg_63 | seg_18 seg_19 seg_20 |
| | | | | seg_63 seg_64 seg_65 seg_66 seg_67 | seg_64 seg_65 seg_66 | seg_21 seg_22 seg_23 |
| | | | | seg_68 seg_69 seg_70 seg_71 seg_73 | seg_67 seg_68 seg_69 | seg_24 seg_25 seg_26 |
| | | | | seg_74 seg_75 seg_76 seg_77 seg_78 | seg_70 seg_71 seg_72 | seg_27 seg_28 seg_29 |
| | | | | seg_79 seg_80 seg_81 seg_82 seg_83 | seg_73 seg_74 seg_75 | seg_30 seg_31 seg_32 |
| | | | | seg_84 seg_85 seg_86 seg_87 seg_88 | seg_76 seg_77 seg_78 | seg_33 seg_34 seg_35 |
| | | | | seg_89 seg_90 seg_91 seg_92 seg_93 | seg_79 seg_80 seg_81 | seg_36 seg_37 seg_38 |
| | | | | seg_94 seg_95 seg_96 seg_97 seg_98 | seg_82 seg_83 seg_84 | seg_39 seg_40 seg_41 |
| | | | | seg_99 seg_100 seg_101 seg_102 | seg_85 seg_86 seg_87 | seg_42 seg_43 seg_44 |
| | | | | seg_103 seg_104 seg_105 seg_106 | seg_88 seg_89 seg_91 | seg_45 seg_46 seg_47 |

TABLE A-continued

| Disorder | OMIM # | Locus | Gene | K562 Suz12* | K562 Ezh2** | GM12878 Ezh2*** |
|---|---|---|---|---|---|---|
| | | | | seg_107 seg_108 seg_109 seg_62 seg_72 | seg_92 seg_93 seg_95 seg_96 seg_97 seg_98 seg_99 seg_100 seg_101 seg_102 seg_103 seg_104 seg_106 seg_107 seg_108 seg_110 seg_111 seg_112 seg_113 seg_114 seg_115 seg_117 seg_119 seg_120 seg_121 seg_122 seg_123 seg_124 seg_125 seg_126 seg_127 seg_128 seg_130 seg_131 seg_132 seg_133 seg_134 seg_135 seg_136 seg_137 seg_138 seg_139 seg_140 seg_141 seg_142 seg_143 seg_59 seg_62 seg_90 seg_94 seg_105 seg_109 seg_116 seg_118 seg_129 | seg_48 seg_49 seg_50 seg_51 seg_52 seg_53 seg_15 |
| Thrombocytopenia, hereditary | 313900 | Xp11.23-p11.22 | WAS | seg_199 seg_201 seg_203 seg_204 seg_205 seg_206 seg_207 seg_208 seg_209 seg_210 seg_211 seg_212 seg_213 seg_214 seg_215 seg_216 seg_217 seg_218 seg_219 seg_220 seg_221 seg_222 seg_223 seg_224 seg_225 seg_226 seg_227 seg_228 seg_229 seg_230 seg_231 seg_232 seg_233 seg_234 seg_235 seg_236 seg_237 seg_238 seg_239 seg_240 seg_242 seg_243 seg_244 seg_245 seg_246 seg_247 seg_249 seg_250 seg_251 seg_252 seg_253 seg_254 seg_256 seg_257 seg_258 seg_259 seg_260 seg_261 seg_262 seg_263 seg_264 seg_200 seg_202 seg_241 seg_248 seg_255 | seg_220 seg_221 seg_222 seg_223 seg_224 seg_225 seg_226 seg_227 seg_228 seg_225 seg_230 seg_232 seg_234 seg_235 seg_236 seg_237 seg_238 seg_239 seg_240 seg_241 seg_242 seg_243 seg_245 seg_246 seg_247 seg_248 seg_249 seg_250 seg_251 seg_252 seg_253 seg_254 seg_255 seg_256 seg_257 seg_258 seg_259 seg_260 seg_262 seg_263 seg_265 seg_266 seg_267 seg_268 seg_269 seg_270 seg_271 seg_231 seg_233 seg_244 seg_261 seg_264 | seg_96 seg_97 seg_98 seg_99 seg_100 seg_101 seg_102 seg_103 seg_93 seg_95 |
| Thyroxine-binding globulin, absence | 314200 | Xq22.2 | TBG | seg_382 seg_385 seg_386 seg_388 seg_389 seg_391 seg_392 seg_393 seg_394 seg_395 seg_396 seg_397 seg_398 seg_399 seg_400 seg_401 seg_402 seg_403 seg_404 seg_405 seg_406 seg_407 seg_408 seg_409 seg_410 seg_411 seg_412 seg_413 seg_414 seg_415 seg_417 seg_418 seg_419 seg_420 seg_421 seg_423 seg_425 seg_426 seg_427 seg_428 seg_431 seg_432 seg_380 seg_383 seg_387 seg_390 seg_416 seg_422 seg_424 seg_429 seg_430 seg_384 | seg_326 seg_327 seg_328 seg_329 seg_331 seg_332 seg_333 seg_334 seg_336 seg_337 seg_338 seg_339 seg_340 seg_341 seg_342 seg_343 seg_344 seg_345 seg_346 seg_347 seg_348 seg_349 seg_350 seg_351 seg_352 seg_353 seg_355 seg_356 seg_357 seg_358 seg_362 seg_363 seg_364 seg_365 seg_366 seg_367 seg_368 seg_369 seg_370 seg_371 seg_372 seg_373 | seg_145 seg_146 seg_148 seg_149 seg_150 seg_152 seg_156 seg_157 seg_158 seg_159 seg_160 seg_161 seg_162 seg_163 seg_147 seg_153 seg_154 seg_155 seg_151 |

TABLE A-continued

| Disorder | OMIM # | Locus | Gene | K562 Suz12* | K562 Ezh2** | GM12878 Ezh2*** |
|---|---|---|---|---|---|---|
| McLeod syndrome | 314850 | Xp21.1 | XK | seg_165 seg_166 seg_167 seg_168<br>seg_169 seg_170 seg_171 seg_172<br>seg_173 seg_174 seg_175 seg_176<br>seg_177 seg_178 seg_179 seg_181<br>seg_182 seg_183 seg_184 seg_185<br>seg_186 seg_187 seg_188 seg_189<br>seg_191 seg_192 seg_193 seg_195<br>seg_196 seg_180 seg_190 seg_194 | seg_325 seg_330 seg_335<br>seg_354 seg_359 seg_360<br>seg_361<br>seg_200 seg_201 seg_202<br>seg_203 seg_204 seg_205<br>seg_206 seg_207 seg_208<br>seg_210 seg_211 seg_212<br>seg_213 seg_214 seg_215<br>seg_216 seg_217 seg_218<br>seg_209 | seg_79 seg_80 seg_81<br>seg_82 seg_83 seg_84<br>seg_85 seg_86 seg_87<br>seg_88 seg_89 seg_90<br>seg_91 |

*Strong human Suz12/PRC2 binding sites identified in K562 cells, see table XIV.
**Strong human Ezh2/PRC2 binding sites identified in K562 cells, see table XIII.
***Strong human Ezh2/PRC2 binding sites identified in GM12878 cells, see table XV Table A was adapted in part from Germain, "Chapter 7: General aspects of X-linked diseases" in Fabry Disease: Perspectives from 5 Years of FOS. Mehta A, Beck M, Sunder-Plassmann G, editors. (Oxford: Oxford PharmaGenesis; 2006).

Methods of Targeting Genes on Xi

The methods described herein can be used to specifically re-activate one or more genes on Xi, by targeting paRNAs or genomic DNA at strong and/or moderate binding sites as described herein, to disrupt RNA-mediated silencing in cis on the inactive X-chromosome. The PRC2 site-associated RNAs can be noncoding (long noncoding RNA, lncRNA) or occasionally part of a coding mRNA; for simplicity, we will refer to them together as polycomb-associated RNAs (paRNAs) henceforth. The paRNAs described herein, including fragments thereof that are at least 20 nt in length, and inhibitory nucleic acids and small molecules targeting (e.g., complementary to) the paRNAs, or complementray or identical to a region within a strong or moderate binding site in the genome, can be used to modulate gene expression in a cell, e.g., a cancer cell, a stem cell, or other normal cell types for gene or epigenetic therapy. The nucleic acids used in the methods described herein are termed "inhibitory" because they inhibit the paRNA-mediated repression of a specified gene, either by binding to the paRNA itself (e.g., an antisense oligo that is complementary to the paRNA) or by binding to a strong or moderate PRC2 binding site as described herein (also termed an EZH2 or SUZ12 binding site herein) in the genome, and (without wishing to be bound by theory) preventing binding of the PRC2 complex and thus disrupting PRC2-mediated silencing in the region of the strong or moderate binding site. The inhibitory oligonucleotides that bind to a strong or moderate PRC2 binding site described herein can bind to either strand of the DNA, but preferably bind to the same strand to which the paRNA binds.

The cells can be in vitro, including ex vivo, or in vivo (e.g., in a subject who has cancer, e.g., a tumor). In some embodiments, the methods include introducing into the cell an inhibitory nucleic acid or a long non-coding RNA described herein that is modified in some way, e.g., an paRNA that differs from the endogenous paRNA by including one or more modifications to the backbone or bases as described herein for inhibitory nucleic acids. Such modified paRNAs are also within the scope of the present invention.

In some embodiments, the methods include introducing into the cell an inhibitory nucleic acid that specifically binds, or is complementary, to a strong or moderate binding site or a long non-coding RNA described herein. A nucleic acid that binds "specifically" binds primarily to the target, i.e., to the target DNA or paRNA or related paRNAs to inhibit regulatory function or binding of the paRNA but not of other non-target RNAs. The specificity of the nucleic acid interaction thus refers to its function (e.g., inhibiting the PRC2-associated repression of gene expression) rather than its hybridization capacity. Inhibitory nucleic acids may exhibit nonspecific binding to other sites in the genome or other mRNAs, without interfering with binding of other regulatory proteins and without causing degradation of the non-specifically-bound RNA. Thus this nonspecific binding does not significantly affect function of other non-target RNAs and results in no significant adverse effects. These methods can be used to treat an X-linked condition in a subject by administering to the subject a composition (e.g., as described herein) comprising an inhibitory nucleic acid that binds to a long non-coding RNA (e.g., an inhibitory nucleic acid that binds to a paRNA described herein) or to a strong or moderate PRC2 binding site that is associated with a disease gene. Examples of genes involved in X-linked diseases are shown in Table A.

As used herein, treating includes "prophylactic treatment" which means reducing the incidence of or preventing (or reducing risk of) a sign or symptom of a disease in a patient at risk for the disease, and "therapeutic treatment", which means reducing signs or symptoms of a disease, reducing progression of a disease, reducing severity of a disease, in a patient diagnosed with the disease.

In some embodiments, the methods described herein include administering a composition, e.g., a sterile composition, comprising an inhibitory nucleic acid that is complementary to an paRNA described herein. Inhibitory nucleic acids for use in practicing the methods described herein can be an antisense or small interfering RNA, including but not limited to an shRNA or siRNA. In some embodiments, the inhibitory nucleic acid is a modified nucleic acid polymer (e.g., a locked nucleic acid (LNA) molecule).

Inhibitory nucleic acids have been employed as therapeutic moieties in the treatment of disease states in animals, including humans. Inhibitory nucleic acids can be useful therapeutic modalities that can be configured to be useful in treatment regimes for the treatment of cells, tissues and animals, especially humans.

For therapeutics, an animal, preferably a human, suspected of having cancer is treated by administering an paRNA or inhibitory nucleic acid in accordance with this invention. For example, in one non-limiting embodiment, the methods comprise the step of administering to the animal in need of treatment, a therapeutically effective amount of an paRNA or inhibitory nucleic acid as described herein.

Inhibitory Nucleic Acids

Inhibitory nucleic acids useful in the present methods and compositions include antisense oligonucleotides, ribozymes, external guide sequence (EGS) oligonucleotides, siRNA compounds, single- or double-stranded RNA interference (RNAi) compounds such as siRNA compounds, molecules comprising modified bases, locked nucleic acid molecules (LNA molecules), antagomirs, peptide nucleic acid molecules (PNA molecules), and other oligomeric compounds or oligonucleotide mimetics which hybridize to at least a portion of the target nucleic acid and modulate its function. In some embodiments, the inhibitory nucleic acids include antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa); small activating RNAs (saRNAs), or combinations thereof. See, e.g., WO 2010040112. However, in some embodiments the inhibitory nucleic acid is not an miRNA, an stRNA, an shRNA, an siRNA, an RNAi, or a dsRNA.

In some embodiments, the inhibitory nucleic acids are 10 to 50, 13 to 50, or 13 to 30 nucleotides in length. One having ordinary skill in the art will appreciate that this embodies oligonucleotides having antisense (complementary) portions of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range therewithin. It is understood that non-complementary bases may be included in such inhibitory nucleic acids; for example, an inhibitory nucleic acid 30 nucleotides in length may have a portion of 15 bases that is complementary to the targeted RNA. In some embodiments, the oligonucleotides are 15 nucleotides in length. In some embodiments, the antisense or oligonucleotide compounds of the invention are 12 or 13 to 30 nucleotides in length. One having ordinary skill in the art will appreciate that this embodies inhibitory nucleic acids having antisense (complementary) portions of 12, 13, 14, 15, 16, 17, 18, 19, 20, 21, 22, 23, 24, 25, 26, 27, 28, 29 or 30 nucleotides in length, or any range therewithin.

Preferably the inhibitory nucleic acid comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the inhibitory nucleic acids are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric inhibitory nucleic acids of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5, 220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the inhibitory nucleic acid comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than; 2'-deoxyoligonucleotides against a given target. A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly $CH_2$—NH—O—$CH_2$, CH, ~N($CH_3$)~O~$CH_2$ (known as a methylene(methylimino) or MMI backbone], $CH_2$—O—N($CH_3$)—$CH_2$, $CH_2$—N($CH_3$)—N($CH_3$)—$CH_2$ and O—N($CH_3$)—$CH_2$—$CH_2$ backbones, wherein the native phosphodiester backbone is represented as O—P—O—$CH_2$,); amide backbones (see De Mesmaeker et al. Ace. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the olyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455, 233; 5,466,677; 5,476,925; 5,519,126; 5,536,821; 5,541,306; 5,550,111; 5,563, 253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties). Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts; see U.S. Pat. Nos. 5,034,506; 5,166,315; 5,185,444; 5,214,134; 5,216,141; 5,235,033; 5,264, 562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues.

Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide. PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids. Examples of LNAs are described in WO 2008/043753 and WO2007031091 and include compounds of the following formula.

Scheme 1

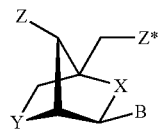

where X and Y are independently selected among the groups —O—, —S—, —N(H)—, N(R)—, —CH2- or —CH— (if part of a double bond), —CH$_2$—O—, —CH$_2$—S—, —CH$_2$—N(H)—, —CH$_2$—N(R)—, —CH$_2$—CH$_2$— or —CH$_2$—CH— (if part of a double bond), —CH═CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligomer of the invention comprises at least one LNA unit according any of the formulas Scheme 2

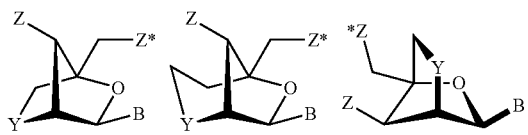

wherein Y is —O—, —S—, —NH—, or N(R$^H$); Z and Z* are independently selected among an internucleoside linkage, a terminal group or a protecting group: B constitutes a natural or non-natural nucleotide base moiety, and RH is selected from hydrogen and C$_{1-4}$-alkyl. Preferably, the Locked Nucleic Acid (LNA) used in an oligomeric compound, such as an antisense oligonucleotide, as described herein comprises at least one nucleotide comprises a Locked Nucleic Acid (LNA) unit according any of the formulas shown in Scheme 2 of PCT/DK2006/000512 (WO2007031091).

Preferably, the LNA used in the oligomer of the invention comprises internucleoside linkages selected from -0-P(O)$_2$—O—, —O—P(O,S)—O—, —O—P(S)$_2$—O—, —S—P(O)$_2$—O—, —S—P(O,S)—O—, —S—P(S)$_2$—O—, -0-P(O)$_2$—S—, —O—P(O,S)—S—, —S—P(O)$_2$—S—, —O—PO(R$^H$)—O—, —O—PO(OCH$_3$)—O—, —O—PO(NR$^H$)—O—, -0-PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, where R$^H$ is selected from hydrogen and C$_{1-4}$-alkyl.

Specifically preferred LNA units are shown in scheme 3:

Scheme 3

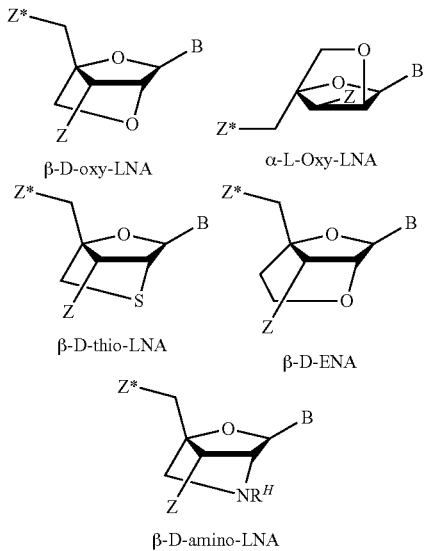

β-D-oxy-LNA    α-L-Oxy-LNA

β-D-thio-LNA    β-D-ENA

β-D-amino-LNA

The term "thio-LNA" comprises a locked nucleotide in which at least one of X or Y in the general formula above is selected from S or —CH2-S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH, —N(R)— where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O— (where the oxygen atom of —CH$_2$—O— is attached to the 2'-position relative to the base B).

LNAs are described in additional detail below. One or more substituted sugar moieties can also be included, e.g., one of the following at the 2' position: OH, SH, SCH$_3$, F, OCN, OCH$_3$ OCH$_3$, OCH$_3$O(CH$_2$)n CH$_3$, O(CH$_2$)n NH$_2$ or O(CH$_2$)n CH$_3$ where n is from 1 to about 10; Ci to C10 lower alkyl, alkoxyalkoxy, substituted lower alkyl, alkaryl or aralkyl; Cl; Br; CN; CF3; OCF3; O-, S-, or N-alkyl; O-, S-, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. A preferred modification includes 2'-methoxyethoxy [2'-O-CH$_2$CH$_2$OCH$_3$, also known as 2'-O-(2-methoxyethyl)](Martin et al, Helv. Chim. Acta, 1995, 78, 486). Other preferred modifications include 2'-methoxy (2'-O-CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Inhibitory nucleic acids can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalkylamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2<0>C. (Sanghvi, in Crooke, and Lebleu, eds., Antisense Research and Applications, CRC Press, Boca Raton, 1993, pp. 276-278) and are presently preferred base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the as nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Inhibitory nucleic acids can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the inhibitory nucleic acids are chemically linked to one or more moieties or conjugates that enhance the activity, cellular distribution, or cellular uptake of the oligonucleotide. For example, one or more inhibitory nucleic acids, of the same or different types, can be conjugated to each other; or inhibitory nucleic acids can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxycholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552, 538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082, 830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241; 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

The inhibitory nucleic acids useful in the present methods are sufficiently complementary to the target paRNA, e.g., hybridize sufficiently well and with sufficient biological functional specificity, to give the desired effect. "Complementary" refers to the capacity for pairing, through base stacking and specific hydrogen bonding, between two sequences comprising naturally or non-naturally occurring (e.g., modified as described above) bases (nucleosides) or analogs thereof. For example, if a base at one position of an inhibitory nucleic acid is capable of hydrogen bonding with a base at the corresponding position of a paRNA, then the bases are considered to be complementary to each other at that position. 100% complementarity is not required. As noted above, inhibitory nucleic acids can comprise universal bases, or inert abasic spacers that provide no positive or negative contribution to hydrogen bonding. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as such as 3-nitropyrrole or 5-nitroindole can hybridize to and are considered complementary to any A, C, U, or T. Nichols et al., Nature, 1994; 369:492-493 and Loakes et al., Nucleic Acids Res., 1994; 22:4039-4043. Inosine (I) has also been considered in the art to be a universal base and is considered complementary to any A, C, U, or T. See Watkins and Santa Lucia, Nucl. Acids Research, 2005; 33 (19): 6258-6267.

In some embodiments, the location on a target paRNA to which an inhibitory nucleic acid hybridizes is a region to which a protein binding partner binds, as identified in Tables VI or VII. The identification of these strong or moderate binding sites, is described in Example 8 below. Routine methods can be used to design an inhibitory nucleic acid that binds to a selected strong or moderate binding site sequence with sufficient specificity. In some embodiments, the methods include using bioinformatics methods known in the art to identify regions of secondary structure, e.g., one, two, or more stem-loop structures, or pseudoknots, and selecting those regions to target with an inhibitory nucleic acid. For example, methods of designing oligonucleotides similar to the inhibitory nucleic acids described herein, and various options for modified chemistries or formats, are exemplified in Lennox and Behlke, Gene Therapy (2011) 18: 1111-1120, which is incorporated herein by reference in its entirety, with the understanding that the inhibitory oligonucleotides of the present disclosure do not target miRNA 'seed regions'.

While the specific sequences of certain exemplary target segments are set forth herein, one of skill in the art will recognize that these serve to illustrate and describe particular embodiments within the scope of the present invention. Additional target segments are readily identifiable by one having ordinary skill in the art in view of this disclosure. Target segments 5-500 nucleotides in length comprising a stretch of at least five (5) consecutive nucleotides within the protein binding region, or immediately adjacent thereto, are considered to be suitable for targeting as well. Target segments can include sequences that comprise at least the 5 consecutive nucleotides from the 5'-terminus of one of the protein binding regions (the remaining nucleotides being a consecutive stretch of the same RNA beginning immediately upstream of the 5'-terminus of the binding segment and continuing until the inhibitory nucleic acid contains about 5 to about 100 nucleotides). Similarly preferred target segments are represented by RNA sequences that comprise at least the 5 consecutive nucleotides from the 3'-terminus of one of the illustrative preferred target segments (the remaining nucleotides being a consecutive stretch of the same paRNA beginning immediately downstream of the 3'-terminus of the target segment and continuing until the inhibitory nucleic acid contains about 5 to about 100 nucleotides). One having skill in the art armed with the sequences provided herein will be able, without undue experimentation, to identify further preferred protein binding regions to target with complementary inhibitory nucleic acids.

In the context of the present disclosure, hybridization means base stacking and hydrogen bonding, which may be Watson-Crick, Hoogsteen or reversed Hoogsteen hydrogen bonding, between complementary nucleoside or nucleotide bases. For example, adenine and thymine are complementary nucleobases which pair through the formation of hydrogen bonds. Complementary, as the term is used in the art, refers to the capacity for precise pairing between two nucleotides. For example, if a nucleotide at a certain position of an oligonucleotide is capable of hydrogen bonding with a nucleotide at the same position of a paRNA molecule, then the inhibitory nucleic acid and the paRNA are considered to be complementary to each other at that position. The inhibitory nucleic acids and the paRNA are complementary to each other when a sufficient number of corresponding positions in each molecule are occupied by nucleotides that can hydrogen bond with each other through their bases. Thus, "specifically hybridizable" and "complementary" are terms which are used to indicate a sufficient degree of complementarity or precise pairing such that stable and specific binding occurs between the inhibitory nucleic acid and the paRNA target. For example, if a base at one position of an inhibitory nucleic acid is capable of hydrogen bonding with a base at the corresponding position of a paRNA, then the bases are considered to be complementary to each other at that position. 100% complementarity is not required. It is understood in the art that a complementary nucleic acid sequence need not be 100% complementary to that of its target nucleic acid to be specifically hybridizable. A complementary nucleic acid sequence for purposes of the present methods is specifically hybridizable when binding of the sequence to the target paRNA molecule interferes with the normal function of the target paRNA to cause a loss of activity (e.g., inhibiting PRC2-associated repression with consequent up-regulation of gene expression) and there is a sufficient degree of complementarity to avoid non-specific binding of the sequence to non-target paRNA sequences under conditions in which avoidance of the non-specific binding is desired, e.g., under physiological conditions in the case of in vivo assays or therapeutic treatment, and in the case of in vitro assays, under conditions in which the assays are performed under suitable conditions of stringency. For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 µg/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

In general, the inhibitory nucleic acids useful in the methods described herein have at least 80% sequence complementarity to a target region within the target nucleic acid, e.g., 90%, 95%, or 100% sequence complementarity to the target region within an paRNA. For example, an antisense compound in which 18 of 20 nucleobases of the antisense oligonucleotide are complementary, and would therefore specifically hybridize, to a target region would represent 90 percent complementarity. Percent complementarity of an inhibitory nucleic acid with a region of a target nucleic acid can be determined routinely using basic local alignment search tools (BLAST programs) (Altschul et al., J. Mol. Biol., 1990, 215, 403-410; Zhang and Madden, Genome Res., 1997, 7, 649-656). Antisense and other compounds of the invention that hybridize to an paRNA are identified through routine experimentation. In general the inhibitory nucleic acids must retain specificity for their target, i.e., either do not directly bind to, or do not directly significantly affect expression levels of, transcripts other than the intended target.

Target-specific effects, with corresponding target-specific functional biological effects, are possible even when the inhibitory nucleic acid exhibits non-specific binding to a large number of non-target RNAs. For example, short 8 base long inhibitory nucleic acids that are fully complementary to a paRNA may have multiple 100% matches to hundreds of sequences in the genome, yet may produce target-specific effects, e.g. upregulation of a specific target gene through inhibition of PRC2 activity. 8-base inhibitory nucleic acids have been reported to prevent exon skipping with a high degree of specificity and reduced off-target effect. See Singh et al., RNA Biol., 2009; 6(3): 341-350. 8-base inhibitory nucleic acids have been reported to interfere with miRNA activity without significant off-target effects. See Obad et al., Nature Genetics, 2011; 43: 371-378.

For further disclosure regarding inhibitory nucleic acids, please see US2010/0317718 (antisense oligos); US2010/0249052 (double-stranded ribonucleic acid (dsRNA)); US2009/0181914 and US2010/0234451 (LNA molecules); US2007/0191294 (siRNA analogues); US2008/0249039 (modified siRNA); and WO2010/129746 and WO2010/040112 (inhibitory nucleic acids).

Antisense

In some embodiments, the inhibitory nucleic acids are antisense oligonucleotides. Antisense oligonucleotides are typically designed to block expression of a DNA or RNA target by binding to the target and halting expression at the level of transcription, translation, or splicing. Antisense oligonucleotides of the present invention are complementary nucleic acid sequences designed to hybridize under stringent conditions to an paRNA in vitro, and are expected to inhibit the activity of PRC2 in vivo. Thus, oligonucleotides are chosen that are sufficiently complementary to the target, i.e., that hybridize sufficiently well and with sufficient biological functional specificity, to give the desired effect.

Modified Bases, Including Locked Nucleic Acids (LNAs)

In some embodiments, the inhibitory nucleic acids used in the methods described herein comprise one or more modified bonds or bases. Modified bases include phosphorothioate, methylphosphonate, peptide nucleic acids, or locked nucleic acids (LNAs). Preferably, the modified nucleotides are part of locked nucleic acid molecules, including [alpha]-L-LNAs. LNAs include ribonucleic acid analogues wherein the ribose ring is "locked" by a methylene bridge between the 2'-oxygen and the 4'-carbon—i.e., oligonucleotides containing at least one LNA monomer, that is, one 2'-O,4'-C-methylene-β-D-ribofuranosyl nucleotide. LNA bases form standard Watson-Crick base pairs but the locked configuration increases the rate and stability of the basepairing reaction (Jepsen et al., Oligonucleotides, 14, 130-146 (2004)). LNAs also have increased affinity to base pair with RNA as compared to DNA. These properties render LNAs especially useful as probes for fluorescence in situ hybridization (FISH) and comparative genomic hybridization, as knockdown tools for miRNAs, and as antisense oligonucleotides to target mRNAs or other RNAs, e.g., paRNAs as described herein.

The modified base/LNA molecules can include molecules comprising, e.g., 10-30, e.g., 12-24, e.g., 12, 13, 14, 15, 16, 17, 18, 19, 20, 21, 22, 23, 24, 25, 26, 27, 28, 29, or 30 nucleotides in each strand, wherein one of the strands is substantially identical, e.g., at least 80% (or more, e.g., 85%, 90%, 95%, or 100%) identical, e.g., having 3, 2, 1, or 0 mismatched nucleotide(s), to a target region in the paRNA. The modified base/LNA molecules can be chemically synthesized using methods known in the art.

The modified base/LNA molecules can be designed using any method known in the art; a number of algorithms are known, and are commercially available (e.g., on the internet, for example at exiqon.com). See, e.g., You et al., Nuc. Acids. Res. 34:e60 (2006); McTigue et al., Biochemistry 43:5388-405 (2004); and Levin et al., Nuc. Acids. Res. 34:e142 (2006). For example, "gene walk" methods, similar to those used to design antisense oligos, can be used to optimize the inhibitory activity of a modified base/LNA molecule; for example, a series of oligonucleotides of 10-30 nucleotides spanning the length of a target paRNA can be prepared, followed by testing for activity. Optionally, gaps, e.g., of 5-10 nucleotides or more, can be left between the LNAs to reduce the number of oligonucleotides synthesized and tested. GC content is preferably between about 30-60%. General guidelines for designing modified base/LNA molecules are known in the art; for example, LNA sequences will bind very tightly to other LNA sequences, so it is preferable to avoid significant complementarity within an LNA molecule. Contiguous runs of three or more Gs or Cs, or more than four LNA residues, should be avoided where possible (for example, it may not be possible with very short (e.g., about 9-10 nt) oligonucleotides). In some embodiments, the LNAs are xylo-LNAs.

In some embodiments, the modified base/LNA molecules can be designed to target a specific region of the paRNA. For example, a specific functional region can be targeted, e.g., a region comprising a known RNA localization motif (i.e., a region complementary to the target nucleic acid on which the paRNA acts), or a region comprising a known protein binding region, e.g., a Polycomb (e.g., Polycomb Repressive Complex 2 (PRC2), comprised of H3K27 methylase EZH2, SUZ12, and EED)) or LSD1/CoREST/REST complex binding region (see, e.g., Tsai et al., Science. 2010 Aug. 6; 329(5992):689-93. Epub 2010 Jul. 8; and Zhao et al., Science. 2008 Oct. 31; 322(5902):750-6). Sarma et al., "Locked nucleic acids (LNAs) reveal sequence requirements and kinetics of Xist RNA localization to the X chromosome." PNAS published ahead of print Dec. 6, 2010, doi:10.1073/pnas.1009785107. Alternatively or in addition, highly conserved regions can be targeted, e.g., regions identified by aligning sequences from disparate species such as primate (e.g., human) and rodent (e.g., mouse) and looking for regions with high degrees of identity. Percent identity can be determined routinely using basic local alignment search tools (BLAST programs) (Altschul et al., J. Mol. Biol., 1990, 215, 403-410; Zhang and Madden, Genome Res., 1997, 7, 649-656), e.g., using the default parameters.

For additional information regarding LNA molecules see U.S. Pat. Nos. 6,268,490; 6,734,291; 6,770,748; 6,794,499; 7,034,133; 7,053,207; 7,060,809; 7,084,125; and 7,572,582; and U.S. Pre-Grant Pub. Nos. 20100267018; 20100261175; and 20100035968; Koshkin et al. Tetrahedron 54, 3607-3630 (1998); Obika et al. Tetrahedron Lett. 39, 5401-5404 (1998); Jepsen et al., Oligonucleotides 14:130-146 (2004); Kauppinen et al., Drug Disc. Today 2(3):287-290 (2005); and Ponting et al., Cell 136(4):629-641 (2009), and references cited therein.

In a related aspect, the present disclosure demonstrates the ability of LNA molecules to displace a cis-acting nuclear long ncRNA with fast kinetics (e.g., RNA/PRC2 disassociation from the chromosome after 2, 5, 10 seconds up to 60 minutes as described herein)—a property that enables the modification and study of the function of long ncRNAs in ways not previously possible. Using 17 kb Xist RNA as a model, the present inventors showed that LNA molecules designed to specifically target the transcript leads to extremely rapid displacement of the RNA from the inactive X chromosome. Interestingly, while the RNA is displaced, transcript stability is not affected. Targeting different Xist regions has allowed the identification of a localization domain and show that Polycomb repressive complex 2 (PRC2) is displaced together with Xist. Thus, PRC2 depends on RNA for both initial targeting to and stable association with chromatin. Time-course analysis of RNA relocalization suggests that Xist and PRC2 spread along X at the same time but does not reach saturating levels for 24 hours, providing a window of opportunity to reprogram the chromatin, if necessary. It is remarkable that targeting a small region within a 17-kb RNA could produce such dramatic effects. The rapid effects suggest that the Xist RNA-protein complex may be anchored to the inactive X chromosome (Xi) chromatin via Repeat C. Alternatively, the LNA molecule's binding to Repeat C could change RNA conformation and interfere with a remote anchoring domain. While RNA displacement occurs with rapid kinetics, the recovery period is prolonged. Although full Xist clouds are restored within 8 hours, the full complement of PRC2 is not recovered for up to 24 hours. This implies that, during the spread of X chromosome inactivation (XCI), synthesis of the RNA is not the rate-limiting step; rather, it is the recruitment of associated silencing proteins such as PRC2. The rapid displacement of Xist and the slow kinetics of recovery provided a large window of opportunity to investigate Xist's spreading pattern relative to that of PRC2. Time-course analysis during the recovery phase indicates that Xist RNA binds most strongly near the Xist locus at first but spreads to the rest of Xi at the same time. Similarly, PRC2 is recruited synchronously throughout the X. Interestingly, neither Xist nor PRC2 levels reach saturation immediately, as the coating of Xist is not complete until t=8 hr and binding of PRC2 does not peak until t=24 hr. Combined, this analysis implies that establishment of chromosome-wide silencing may be relatively slow.

As demonstrated herein, LNA molecules can be used as a valuable tool to manipulate and aid analysis of long nuclear ncRNAs. Advantages offered by an LNA molecule-based system are the relatively low costs, easy delivery, and rapid action. While other inhibitory nucleic acids may exhibit effects after longer periods of time, LNA molecules exhibit effects that are more rapid, e.g., a comparatively early onset of activity, are fully reversible after a recovery period following the synthesis of new paRNA, and occur without causing substantial or substantially complete RNA cleavage or degradation. One or more of these design properties may be desired properties of the inhibitory nucleic acids of the invention. Additionally, LNA as molecules make possible the systematic targeting of domains within much longer nuclear transcripts. Although a PNA-based system has been described earlier, the effects on Xi were apparent only after 24 hours (Beletskii et al., Proc Natl Acad Sci USA 98:9215-9220 (2001)). The LNA technology enables high-throughput screens for functional analysis of long non-coding RNAs and also provides a novel tool to manipulate chromatin states in vivo for therapeutic applications.

In various related aspects, the methods described herein include using LNA molecules to target paRNAs for a number of uses, including as a research tool to probe the function of a specific paRNA, e.g., in vitro or in vivo. The methods include selecting one or more desired paRNAs, designing one or more LNA molecules that target the paRNA, providing the designed LNA molecule, and administering the LNA molecule to a cell or animal. The methods can optionally include selecting a region of the paRNA and designing one or more LNA molecules that target that region of the paRNA.

Aberrant imprinted gene expression is implicated in several diseases including Long QT syndrome, Beckwith-Wiedemann, Prader-Willi, and Angelman syndromes, as well as behavioral disorders and carcinogenesis (see, e.g., Falls et al., Am. J. Pathol. 154:635-647 (1999); Lalande, Annu Rev Genet 30:173-195 (1996); Hall Annu Rev Med. 48:35-44 (1997)). LNA molecules can be created to treat such imprinted diseases. As one example, the long QT Syndrome can be caused by a K+ gated Calcium-channel encoded by Kcnq1. This gene is regulated by its antisense counterpart, the long noncoding RNA, Kcnq1ot1 (Pandey et al., Mol Cell. 2008 Oct. 24; 32(2):232-46). Disease arises when Kcnq1ot1 is aberrantly expressed. LNA molecules can be created to downregulate Kcnq1ot1, thereby restoring expression of Kcnq1. As another example, LNA molecules could inhibit paRNA cofactors for polycomb complex chromatin modifiers to reverse the imprinted defect. From a commercial and clinical perspective, the timepoints between about 1 to 24 hours potentially define a window for epigenetic reprogramming. The advantage of the LNA system is that it works quickly, with a defined half-life, and is therefore reversible upon degradation of LNAs, at the same time that it provides a discrete timeframe during which epigenetic manipulations can be made. By targeting nuclear long ncRNAs, LNA molecules or similar polymers, e.g., xylo-LNAs, might be utilized to manipulate the chromatin state of cells in culture or in vivo, by transiently eliminating the regulatory RNA and associated proteins long enough to alter the underlying locus for therapeutic purposes. In particular, LNA molecules or similar polymers that specifically bind to, or are complementary to, PRC2-binding paRNA can prevent recruitment of PRC2 to a specific chromosomal locus, in a gene-specific fashion.

LNA molecules might also be administered in vivo to treat other human diseases, such as but not limited to cancer, neurological disorders, infections, inflammation, and myotonic dystrophy. For example, LNA molecules might be delivered to tumor cells to downregulate the biologic activity of a growth-promoting or oncogenic long nuclear ncRNA (e.g., Gtl2 or MALAT1 (Luo et al., Hepatology. 44(4):1012-24 (2006)), a paRNA associated with metastasis and is frequently upregulated in cancers). Repressive paRNAs downregulating tumor suppressors can also be targeted by LNA molecules to promote reexpression. For example, expression of the INK4b/ARF/INK4a tumor suppressor locus is controlled by Polycomb group proteins including PRC1 and PRC2 and repressed by the antisense noncoding RNA ANRIL (Yap et al., Mol Cell. 2010 Jun. 11; 38(5):662-74). ANRIL can be targeted by LNA molecules to promote reexpression of the INK4b/ARF/INK4a tumor suppressor. Some paRNA may be positive regulators of oncogenes. Such "activating paRNAs" have been described recently (e.g., Jpx (Tian et al., Cell. 143(3):390-403 (2010) and others (Ørom et al., Cell. 143(1):46-58 (2010)). Therefore, LNA molecules could be directed at these activating paRNAs to downregulate oncogenes. LNA molecules could also be delivered to inflammatory cells to downregulate regulatory paRNA that modulate the inflammatory or immune response. (e.g., LincRNA-Cox2, see Guttman et al., Nature. 458(7235):223-7. Epub 2009 Feb. 1 (2009)).

In still other related aspects, the LNA molecules targeting paRNAs described herein can be used to create animal or cell models of conditions associated with altered gene expression (e.g., as a result of altered epigenetics).

For example, it was first noticed about half a century ago that X chromosome changes are often seen in female reproductive cancers. Some 70% of breast carcinomas lack a 'Barr body', the cytologic hallmark of the inactive X chromosome (Xi), and instead harbor two or more active Xs (Xa). Additional X's are also a risk factor for men, as XXY men (Klinefelter Syndrome) have a 20- to 50-fold increased risk of breast cancer in a BRCA1 background. The X is also known to harbor a number of oncogenes. Supernumerary Xa's correlate with a poor prognosis and stand as one of the most common cytogenetic abnormalities not only in reproductive cancers but also in leukemias, lymphomas, and germ cell tumors of both sexes. See, e.g., Liao et al., Cancer Invest 21, 641-58 (2003); Spatz et al., Nat Rev Cancer 4, 617-29 (2004); Barr et al., Proc Can Cancer Conf 2, 3-16 (1957); Borah et al., J Surg Oncol 13, 1-7 (1980); Camargo and Wang, Hum Genet 55, 81-5 (1980); Dutrillaux et al., Int J Cancer 38, 475-9 (1986); Ghosh and Shah, Cancer Genet Cytogenet 4, 269-74 (1981); Ghosh and Shah, Med Hypotheses 7, 1099-104 (1981); Ghosh et al., Acta Cytol 27, 202-3 (1983); Huang et al., Mol Cancer Ther 1, 769-76 (2002); Kawakami et al., Lancet 363, 40-2 (2004); Kawakami et al., J Urol 169, 1546-52 (2003); Kawakami et al., Oncogene 23, 6163-9 (2004); Moore and Barr, Br J Cancer 9, 246-52 (1955); Moore and Barr, Br J Cancer 11, 384-90 (1957); Moore et al., J Exp Zool 135, 101-25 (1957); Rosen et al., Ann Clin Lab Sci 7, 491-9 (1977); Sirchia et al., Cancer Res 65, 2139-46 (2005); Tavares, Lancet 268, 948-9 (1955); Tavares, Medico (Porto) 12, 97-100 (1961); Tavares, Acta Cytol 6, 90-4 (1962); Wang et al., Cancer Genet Cytogenet 46, 271-80 (1990); and Ganesan et al., Cold Spring Harb Symp Quant Biol 70, 93-7 (2005).

See also PCT/US11/60493, which is incorporated by reference herein in its entirety.

Antagomirs

In some embodiments, the inhibitory nucleic acid is an antagomir. Antagomirs are chemically modified antisense oligonucleotides that can target an paRNA. For example, an antagomir for use in the methods described herein can include a nucleotide sequence sufficiently complementary to hybridize to an paRNA target sequence of about 12 to 25 nucleotides, preferably about 15 to 23 nucleotides.

In some embodiments, antagomirs include a cholesterol moiety, e.g., at the 3'-end. In some embodiments, antagomirs have various modifications for RNase protection and pharmacologic properties such as enhanced tissue and cellular uptake. For example, in addition to the modifications discussed above for antisense oligos, an antagomir can have one or more of complete or partial 2'-O-methylation of sugar and/or a phosphorothioate backbone. Phosphorothioate modifications provide protection against RNase or other nuclease activity and their lipophilicity contributes to enhanced tissue uptake. In some embodiments, the antagomir cam include six phosphorothioate backbone modifications; two phosphorothioates are located at the 5'-end and four at the 3'-end, but other patterns of phosphorothioate modification are also commonly employed and effective. See, e.g., Krutzfeldt et al., Nature 438, 685-689 (2005); Czech, N Engl J Med 2006; 354:1194-1195 (2006); Robertson et al., Silence. 1:10 (2010); Marquez and McCaffrey, Hum Gene Ther. 19(1):27-38 (2008); van Rooij et al., Circ Res. 103(9):919-928 (2008); and Liu et al., Int. J. Mol. Sci. 9:978-999 (2008). Krutzfeld et al. (2005) describe chemically engineered oligonucleotides, termed 'antagomirs', that are reported to be efficient and specific silencers of endogenous miRNAs in mice.

In general, the design of an antagomir avoids target RNA degradation due to the modified sugars present in the molecule. The presence of an unbroken string of unmodified sugars supports RNAseH recruitment and enzymatic activity. Thus, typically the design of an antagomir will include bases that contain modified sugar (e.g., LNA), at the ends or interspersed with natural ribose or deoxyribose nucleobases.

Antagomirs useful in the present methods can also be modified with respect to their length or otherwise the number of nucleotides making up the antagomir. In some embodiments, the antagomirs must retain specificity for their target, i.e., must not directly bind to, or directly significantly affect expression levels of, transcripts other than the intended target. In some embodiments, antagomirs may exhibit nonspecific binding that does not produce significant undesired biologic effect, e.g., the antagomirs do not affect expression levels of non-target transcripts or their association with regulatory proteins or regulatory RNAs.

Interfering RNA, Including siRNA/shRNA

In some embodiments, the inhibitory nucleic acid sequence that is complementary to an paRNA can be an interfering RNA, including but not limited to a small interfering RNA ("siRNA") or a small hairpin RNA ("shRNA"). Methods for constructing interfering RNAs are well known in the art. For example, the interfering RNA can be assembled from two separate oligonucleotides, where one strand is the sense strand and the other is the antisense strand, wherein the antisense and sense strands are self-complementary (i.e., each strand comprises nucleotide sequence that is complementary to nucleotide sequence in the other strand; such as where the antisense strand and sense strand form a duplex or double stranded structure); the antisense strand comprises nucleotide sequence that is complementary to a nucleotide sequence in a target nucleic acid molecule or a portion thereof (i.e., an undesired gene) and the sense strand comprises nucleotide sequence corresponding to the target nucleic acid sequence or a portion thereof. Alternatively, interfering RNA is assembled from a single oligonucleotide, where the self-complementary sense and antisense regions are linked by means of nucleic acid based or non-nucleic acid-based linker(s). The interfering RNA can be a polynucleotide with a duplex, asymmetric duplex, hairpin or asymmetric hairpin secondary structure, having self-complementary sense and antisense regions, wherein the antisense region comprises a nucleotide sequence that is complementary to nucleotide sequence in a separate target nucleic acid molecule or a portion thereof and the sense region having nucleotide sequence corresponding to the target nucleic acid sequence or a portion thereof. The interfering can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNA interference.

In some embodiments, the interfering RNA coding region encodes a self-complementary RNA molecule having a sense region, an antisense region and a loop region. Such an RNA molecule when expressed desirably forms a "hairpin" structure, and is referred to herein as an "shRNA." The loop region is generally between about 2 and about 10 nucleotides in length. In some embodiments, the loop region is from about 6 to about 9 nucleotides in length. In some embodiments, the sense region and the antisense region are between about 15 and about 20 nucleotides in length. Following post-transcriptional processing, the small hairpin RNA is converted into a siRNA by a cleavage event mediated by the enzyme Dicer, which is a member of the RNase III family. The siRNA is then capable of inhibiting the expression of a gene with which it shares homology. For details, see Brummelkamp et al., Science 296:550-553, (2002); Lee et al, Nature Biotechnol., 20, 500-505, (2002): Miyagishi and Taira, Nature Biotechnol 20:497-500, (2002); Paddison et al. Genes & Dev. 16:948-958, (2002); Paul, Nature Biotechnol, 20, 505-508, (2002); Sui, Proc. Natl.

Acad. Sd. USA, 99(6), 5515-5520, (2002); Yu et al. Proc NatlAcadSci USA 99:6047-6052, (2002).

The target RNA cleavage reaction guided by siRNAs is highly sequence specific. In general, siRNA containing a nucleotide sequences identical to a portion of the target nucleic acid are preferred for inhibition. However, 100% sequence identity between the siRNA and the target gene is not required to practice the present invention. Thus the invention has the advantage of being able to tolerate sequence variations that might be expected due to genetic mutation, strain polymorphism, or evolutionary divergence. For example, siRNA sequences with insertions, deletions, and single point mutations relative to the target sequence have also been found to be effective for inhibition. Alternatively, siRNA sequences with nucleotide analog substitutions or insertions can be effective for inhibition. In general the siRNAs must retain specificity for their target, i.e., must not directly bind to, or directly significantly afftect expression levels of, transcripts other than the intended target.

Ribozymes

In some embodiments, the inhibitory nucleic acids are ribozymes. Trans-cleaving enzymatic nucleic acid molecules can also be used; they have shown promise as therapeutic agents for human disease (Usman & McSwiggen, 1995 Ann. Rep. Med. Chem. 30, 285-294; Christoffersen and Marr, 1995 J. Med. Chem. 38, 2023-2037). Enzymatic nucleic acid molecules can be designed to cleave specific paRNA targets within the background of cellular RNA. Such a cleavage event renders the paRNA non-functional.

In general, enzymatic nucleic acids with RNA cleaving activity act by first binding to a target RNA. Such binding occurs through the target binding portion of an enzymatic nucleic acid which is held in close proximity to an enzymatic portion of the molecule that acts to cleave the target RNA. Thus, the enzymatic nucleic acid first recognizes and then binds a target RNA through complementary base pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

Several approaches such as in vitro selection (evolution) strategies (Orgel, 1979, Proc. R. Soc. London, B 205, 435) have been used to evolve new nucleic acid catalysts capable of catalyzing a variety of reactions, such as cleavage and ligation of phosphodiester linkages and amide linkages, (Joyce, 1989, Gene, 82, 83-87; Beaudry et al., 1992, Science 257, 635-641; Joyce, 1992, Scientific American 267, 90-97; Breaker et al, 1994, TIBTECH 12, 268; Bartel et al, 1993, Science 261:1411-1418; Szostak, 1993, TIBS 17, 89-93; Kumar et al, 1995, FASEB J., 9, 1183; Breaker, 1996, Curr. Op. Biotech., 1, 442). The development of ribozymes that are optimal for catalytic activity would contribute significantly to any strategy that employs RNA-cleaving ribozymes for the purpose of regulating gene expression. The hammerhead ribozyme, for example, functions with a catalytic rate (kcat) of about 1 $min^{-1}$ in the presence of saturating (10 MM) concentrations of $Mg^{2+}$ cofactor. An artificial "RNA ligase" ribozyme has been shown to catalyze the corresponding self-modification reaction with a rate of about 100 $min^{-1}$. In addition, it is known that certain modified hammerhead ribozymes that have substrate binding arms made of DNA catalyze RNA cleavage with multiple turn-over rates that approach 100 $min^{-1}$.

Making and Using Inhibitory Nucleic Acids

The nucleic acid sequences used to practice the methods described herein, whether RNA, cDNA, genomic DNA, vectors, viruses or hybrids thereof, can be isolated from a variety of sources, genetically engineered, amplified, and/or expressed/generated recombinantly. If desired, nucleic acid sequences of the invention can be inserted into delivery vectors and expressed from transcription units within the vectors. The recombinant vectors can be DNA plasmids or viral vectors. Generation of the vector construct can be accomplished using any suitable genetic engineering techniques well known in the art, including, without limitation, the standard techniques of PCR, oligonucleotide synthesis, restriction endonuclease digestion, ligation, transformation, plasmid purification, and DNA sequencing, for example as described in Sambrook et al. Molecular Cloning: A Laboratory Manual. (1989)), Coffin et al. (Retroviruses. (1997)) and "RNA Viruses: A Practical Approach" (Alan J. Cann, Ed., Oxford University Press, (2000)).

Preferably, inhibitory nucleic acids of the invention are synthesized chemically. Nucleic acid sequences used to practice this invention can be synthesized in vitro by well-known chemical synthesis techniques, as described in, e.g., Adams (1983) J. Am. Chem. Soc. 105:661; Belousov (1997) Nucleic Acids Res. 25:3440-3444: Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066; WO/2008/043753 and WO/2008/049085, and the references cited therein.

Nucleic acid sequences of the invention can be stabilized against nucleolytic degradation such as by the incorporation of a modification, e.g., a nucleotide modification. For example, nucleic acid sequences of the invention includes a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O-NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom (see, e.g., Kaupinnen et al., Drug Disc. Today 2(3):287-290 (2005); Koshkin et al., J. Am. Chem. Soc., 120(50):13252-13253 (1998)). For additional modifications see US 20100004320, US 20090298916, and US 20090143326.

It is understood that any of the modified chemistries or formats of inhibitory nucleic acids described herein can be combined with each other, and that one, two, three, four, five, or more different types of modifications can be included within the same molecule.

Techniques for the manipulation of nucleic acids used to practice this invention, such as, e.g., subcloning, labeling probes (e.g., random-primer labeling using Klenow polymerase, nick translation, amplification), sequencing, hybridization and the like are well described in the scientific and patent literature, see, e.g., Sambrook et al., Molecular Cloning: A Laboratory Manual 3d ed. (2001); Current Protocols in Molecular Biology, Ausubel et al., eds. (John Wiley & Sons, Inc., New York 2010); Kriegler, Gene Transfer and Expression: A Laboratory Manual (1990); Laboratory Techniques In Biochemistry And Molecular Biology: Hybridization With Nucleic Acid Probes, Part 1. Theory and Nucleic Acid Preparation, Tijssen, ed. Elsevier, N.Y. (1993).

Modification Patterns

In some embodiments, the inhibitory oligonucleotide comprises locked nucleic acids (LNA), ENA modified nucleotides, 2'-O-methyl nucleotides, or 2'-fluoro-deoxyribonucleotides. In some embodiments, the inhibitory oligonucleotide comprises alternating deoxyribonucleotides and 2'-fluoro-deoxyribonucleotides. In some embodiments, the inhibitory oligonucleotide comprises alternating deoxyribonucleotides and 2'-O-methyl nucleotides. In some embodiments, the inhibitory oligonucleotide comprises alternating deoxyribonucleotides and ENA modified nucleotides. In some embodiments, the inhibitory oligonucleotide comprises alternating deoxyribonucleotides and locked nucleic acid nucleotides. In some embodiments, the inhibitory oligonucleotide comprises alternating locked nucleic acid nucleotides and 2'-O-methyl nucleotides.

The oligonucleotide may comprise deoxyribonucleotides flanked by at least one bridged nucleotide (e.g., a LNA nucleotide, cEt nucleotide, ENA nucleotide) on each of the 5' and 3' ends of the deoxyribonucleotides. The oligonucleotide may comprise deoxyribonucleotides flanked by 1, 2, 3, 4, 5, 6, 7, 8 or more bridged nucleotides (e.g., LNA nucleotides, cEt nucleotides, ENA nucleotides) on each of the 5' and 3' ends of the deoxyribonucleotides. In some embodiments, the 5' nucleotide of the oligonucleotide is a deoxyribonucleotide. In some embodiments, the 5' nucleotide of the oligonucleotide is a locked nucleic acid nucleotide. In some embodiments, the nucleotides of the oligonucleotide comprise deoxyribonucleotides flanked by at least one locked nucleic acid nucleotide on each of the 5' and 3' ends of the deoxyribonucleotides. In some embodiments, the nucleotide at the 3' position of the oligonucleotide has a 3' hydroxyl group or a 3' thiophosphate.

In some embodiments, the inhibitory oligonucleotide comprises phosphorothioate internucleotide linkages. In some embodiments, the single stranded oligonucleotide comprises phosphorothioate internucleotide linkages between at least two nucleotides. In some embodiments, the single stranded oligonucleotide comprises phosphorothioate internucleotide linkages between all nucleotides.

It should be appreciated that the oligonucleotide can have any combination of modifications as described herein.

As an example, the oligonucleotide may comprise a nucleotide sequence having one or more of the following modification patterns.

(a) (X)Xxxxxx, (X)xXxxxx, (X)xxXxxx, (X)xxxXxx, (X)xxxxXx and (X)xxxxxX, (b) (X)XXxxxx, (X)XxXxxx, (X)XxxXxx, (X)XxxxXx, (X)XxxxxX, (X)xXXxxx, (X)xXxXxx, (X)xXxxXx, (X)xXxxxX, (X)xxXXxx, (X)xxXxXx, (X)xxXxxX, (X)xxxXXx, (X)xxxXxX and (X)xxxxXX, (c) (X)XXXxxx, (X)xXXXxx, (X)xxXXXx, (X)xxxXXX, (X)XXxXxx, (X)XXxxXx, (X)XXxxxX, (X)xXXxXx, (X)xXXxxX, (X)xxXXxX, (X)XxXXxx, (X)xxXxXX, (X)xXxxXX, (X)xxXXxX, (X)xXxXXx, (X)xXxXxX, (X)xxXxXX, (X)xXxXxX and (X)XxXxXx, (d) (X)xxXXXX, (X)xXxXXX, (X)xXXxXX, (X)xXXXxX, (X)xXXXXx, (X)XxxXXX, (X)XxXxXX, (X)XxXXxX, (X)XxXXXx, (X)XxXXx, (X)XXxxXX, (X)XXxXxX, (X)XXxXXx, (X)XXXxxX, (X)XXXxXx, and (X)XXXXxx, (e) (X)xXXXXX, (X)XxXXXX, (X)XXxXXX, (X)XXXxXX, (X)XXXXxX and (X)XXXXXx, and (f) XXXXXX, XxXXXXX, XXxXXXX, XXXxXXX, XXXXxXX, XXXXXxX and XXXXXXx, in which "X" denotes a nucleotide analogue, (X) denotes an optional nucleotide analogue, and "x" denotes a DNA or RNA nucleotide unit. Each of the above listed patterns may appear one or more times within an oligonucleotide, alone or in combination with any of the other disclosed modification patterns.

In some embodiments, the oligonucleotide is a gapmer (contain a central stretch (gap) of DNA monomers sufficiently long to induce RNase H cleavage, flanked by blocks of LNA modified nucleotides: see, e.g., Stanton et al., Nucleic Acid Ther. 2012. 22: 344-359; Nowotny et al., Cell, 121:1005-1016, 2005; Kurreck, European Journal of Biochemistry 270: 1628-1644, 2003; FLuiter et al., Mol Biosyst. 5(8):838-43, 2009). In some embodiments, the oligonucleotide is a mixmer (includes alternating short stretches of LNA and DNA; Naguibneva et al., Biomed Pharmacother. 2006 November; 60(9):633-8; Orom et al., Gene. 2006 May 10; 3720:137-41).

Additional Sequence Structural Information

The inhibitory oligonucleotides described herein may have a sequence that does not contain guanosine nucleotide stretches (e.g., 3 or more, 4 or more, 5 or more, 6 or more consecutive guanosine nucleotides). In some embodiments, oligonucleotides having guanosine nucleotide stretches have increased non-specific binding and/or off-target effects, compared with oligonucleotides that do not have guanosine nucleotide stretches.

The inhibitory oligonucleotides have a sequence that has less than a threshold level of sequence identity with every sequence of nucleotides, of equivalent length, that map to a genomic position encompassing or in proximity to an off-target gene. For example, an oligonucleotide may be designed to ensure that it does not have a sequence that maps to genomic positions encompassing or in proximity with all known genes (e.g., all known protein coding genes) other than the gene of interest. The oligonucleotide is expected to have a reduced likelihood of having off-target effects. The threshold level of sequence identity may be 50%, 60%, 70%, 80%, 85%, 90%, 95%, 99% or 100% sequence identity.

The inhibitory oligonucleotides may have a sequence that is complementary to a region that encodes an RNA that forms a secondary structure comprising at least two single stranded loops. In some embodiments, oligonucleotides that are complementary to a region that encodes an RNA that forms a secondary structure comprising one or more single stranded loops (e.g., at least two single stranded loops) have a greater likelihood of being active (e.g., of being capable of activating or enhancing expression of a target gene) than a randomly selected oligonucleotide. In some cases, the secondary structure may comprise a double stranded stem between the at least two single stranded loops. Accordingly, the area of complementarity between the oligonucleotide and the nucleic acid region may be at a location of the PRC2 associated region that encodes at least a portion of at least one of the loops. In some embodiments, the predicted secondary structure RNA (e.g., paRNA) containing the nucleic acid region is determined using RNA secondary structure prediction algorithms, e.g., RNAfold, mfold. In some embodiments, oligonucleotides are designed to target a region of the RNA that forms a secondary structure comprising one or more single stranded loop (e.g., at least two single stranded loops) structures which may comprise a double stranded stem between the at least two single stranded loops.

The inhibitory oligonucleotide may have a sequence that is has greater than 30% G-C content, greater than 40% G-C content, greater than 50% G-C content, greater than 60% G-C content, greater than 70% G-C content, or greater than 80% G-C content. The inhibitory oligonucleotide may have a sequence that has up to 100% G-C content, up to 95% G-C content, up to 90% G-C content, or up to 80% G-C content.

The inhibitory oligonucleotide may be complementary to a chromosome of a different species (e.g., a mouse, rat, rabbit, goat, monkey, etc.) at a position that encompasses or that is in proximity to that species' homolog of the gene of interest. The inhibitory oligonucleotide may be complementary to a human genomic region encompassing or in proximity to the target gene and also be complementary to a mouse genomic region encompassing or in proximity to the mouse homolog of the target gene. Oligonucleotides having these characteristics may be tested in vivo or in vitro for efficacy in multiple species (e.g., human and mouse). This approach also facilitates development of clinical candidates for treating human disease by selecting a species in which an appropriate animal exists for the disease. In some embodiments, the region of complementarity of the inhibitory oligonucleotide is complementary with at least 8 to 15, 8 to 30, 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive nucleotides of a paRNA disclosed in the tables provided herein. In some embodiments, the region of complementarity is complementary with at least 8 consecutive nucleotides of a paRNA disclosed in the tables provided herein.

Pharmaceutical Compositions

The methods described herein can include the administration of pharmaceutical compositions and formulations comprising inhibitory nucleic acid sequences designed to target an paRNA. In some embodiments, the compositions are formulated with a pharmaceutically acceptable carrier. The pharmaceutical compositions and formulations can be administered parenterally, topically, orally or by local administration, such as by aerosol or transdermally. The pharmaceutical compositions can be formulated in any way and can be administered in a variety of unit dosage forms depending upon the condition or disease and the degree of illness, the general medical condition of each patient, the resulting preferred method of administration and the like. Details on techniques for formulation and administration of pharmaceuticals are well described in the scientific and patent literature, see, e.g., Remington: The Science and Practice of Pharmacy, 21st ed., 2005.

The inhibitory nucleic acids can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Formulations of the compositions of the invention include those suitable for intradermal, inhalation, oral/nasal, topical, parenteral, rectal, and/or intravaginal administration. The formulations may conveniently be presented in unit dosage form and may be prepared by any methods well known in the art of pharmacy. The amount of active ingredient (e.g., nucleic acid sequences of this invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g., an antigen specific T cell or humoral response.

Pharmaceutical formulations of this invention can be prepared according to any method known to the art for the manufacture of pharmaceuticals. Such drugs can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations for oral administration can be formulated using pharmaceutically acceptable carriers well known in the art in appropriate and suitable dosages. Such carriers enable the pharmaceuticals to be formulated in unit dosage forms as tablets, pills, powder, dragees, capsules, liquids, lozenges, gels, syrups, slurries, suspensions, etc., suitable for ingestion by the patient. Pharmaceutical preparations for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethyl-cellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., nucleic acid sequences of the invention) in admixture with excipients suitable for the manufacture of aqueous suspensions, e.g., for aqueous intradermal injections. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethylene oxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolarity.

In some embodiments, oil-based pharmaceuticals are used for administration of nucleic acid sequences of the invention. Oil-based suspensions can be formulated by suspending an active agent in a vegetable oil, such as *arachis* oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations can be preserved by the addition of an antioxidant such as ascorbic acid. As an example of an injectable oil vehicle, see Minto (1997) J. Pharmacol. Exp. Ther. 281:93-102.

Pharmaceutical formulations can also be in the form of oil-in-water emulsions. The oily phase can be a vegetable oil or a mineral oil, described above, or a mixture of these. Suitable emulsifying agents include naturally-occurring gums, such as gum *acacia* and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent. In alternative embodiments, these injectable oil-in-water emulsions of the invention comprise a paraffin oil, a sorbitan monooleate, an ethoxylated sorbitan monooleate and/or an ethoxylated sorbitan trioleate.

The pharmaceutical compounds can also be administered by in intranasal, intraocular and intravaginal routes including suppositories, insufflation, powders and aerosol formulations (for examples of steroid inhalants, see e.g., Rohatagi (1995) J. Clin. Pharmacol. 35:1187-1193; Tjwa (1995) Ann. Allergy Asthma Immunol. 75:107-111). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In some embodiments, the pharmaceutical compounds can be delivered transdermally, by a topical route, formulated as applicator sticks, solutions, suspensions, emulsions, gels, creams, ointments, pastes, jellies, paints, powders, and aerosols.

In some embodiments, the pharmaceutical compounds can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In some embodiments, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables. These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

In some embodiments, the pharmaceutical compounds and formulations can be lyophilized. Stable lyophilized formulations comprising an inhibitory nucleic acid can be made by lyophilizing a solution comprising a pharmaceutical of the invention and a bulking agent, e.g., mannitol, trehalose, raffinose, and sucrose or mixtures thereof. A process for preparing a stable lyophilized formulation can include lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. 20040028670.

The compositions and formulations can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587. As used in the present invention, the term "liposome" means a vesicle composed of amphiphilic lipids arranged in a bilayer or bilayers. Liposomes are unilamellar or multilamellar vesicles that have a membrane formed from a lipophilic material and an aqueous interior that contains the composition to be delivered. Cationic liposomes are positively charged liposomes that are believed to interact with negatively charged DNA molecules to form a stable complex. Liposomes that are pH-sensitive or negatively-charged are believed to entrap DNA rather than complex with it. Both cationic and noncationic liposomes have been used to deliver DNA to cells.

Liposomes can also include "sterically stabilized" liposomes, i.e., liposomes comprising one or more specialized lipids. When incorporated into liposomes, these specialized lipids result in liposomes with enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG) moiety. Liposomes and their uses are further described in U.S. Pat. No. 6,287,860.

The formulations of the invention can be administered for prophylactic and/or therapeutic treatments. In some embodiments, for therapeutic applications, compositions are administered to a subject who is at risk of or has a disorder described herein, in an amount sufficient to cure, alleviate or partially arrest the clinical manifestations of the disorder or its complications; this can be called a therapeutically effective amount.

The amount of pharmaceutical composition adequate to accomplish this is a therapeutically effective dose. The dosage schedule and amounts effective for this use, i.e., the dosing regimen, will depend upon a variety of factors, including the stage of the disease or condition, the severity of the disease or condition, the general state of the patient's health, the patient's physical status, age and the like. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:611-617; Groning (1996) Pharmazie 51:337-341; Fotherby (1996) Contraception 54:59-69; Johnson (1995) J. Pharm. Sci. 84:1144-1146; Rohatagi (1995) Pharmazie 50:610-613; Brophy (1983) Eur. J. Clin. Pharmacol. 24:103-108; Remington: The Science and Practice of Pharmacy, 21st ed., 2005). The state of the art allows the clinician to determine the dosage regimen for each individual patient, active agent and disease or condition treated. Guidelines provided for similar compositions used as pharmaceuticals can be used as guidance to determine the dosage regiment, i.e., dose schedule and dosage levels, administered practicing the methods of the invention are correct and appropriate.

Single or multiple administrations of formulations can be given depending on for example: the dosage and frequency as required and tolerated by the patient, the degree and amount of therapeutic effect generated after each administration (e.g., effect on tumor size or growth), and the like. The formulations should provide a sufficient quantity of active agent to effectively treat, prevent or ameliorate conditions, diseases or symptoms.

In alternative embodiments, pharmaceutical formulations for oral administration are in a daily amount of between about 1 to 100 or more mg per kilogram of body weight per day. Lower dosages can be used, in contrast to administration orally, into the blood stream, into a body cavity or into a lumen of an organ. Substantially higher dosages can be used in topical or oral administration or administering by powders, spray or inhalation.

In some embodiments, the methods described herein can include co-administration with other drugs or pharmaceuticals, e.g., compositions for providing cholesterol homeostasis. For example, the inhibitory nucleic acids can be co-administered with drugs for treating or reducing risk of a disorder described herein.

EXAMPLES

The invention is further described in the following examples, which do not limit the scope of the invention described in the claims.

Methods

The following methods were used in the Examples set forth below.

Cell Culture and ES Cell Differentiation

For MEFs, female F1(129S1×CAST/EiJ) embryos were harvested on E13.5 and fibroblasts were outgrown, immortalized with SV40 large T antigen, cloned, and those carrying an inactive $X^{129}$ were used. Female 16.7 ES cells (Lee et al., 1999) and $Tsix^{TST}/+$ (Ogawa et al., 2008) have been described. Differentiating ES cells were grown without LIF for 4 days, then plated for outgrowth until on d7.

ChIP-seq

ChIP samples were prepared and immunoprecipitated as described (Lee et al., 2006) using antibodies against H3K4me3 (Abcam, ab8580), H3K36me3 (Abcam, ab9050), H3K27me3 (Abcam, ab6002), EZH2 (Active Motif, 39639) and RNA polymerase II phosphorylated on Serine 5 of the C-terminal domain (Abeam, ab5131). ChIP DNA concentration was measured using the Quant-iT Picogreen dsDNA Assay kit (Invitrogen). DNA for Illumina sequencing was prepared according to Illumina instructions with minor modifications (ultrapure T4 DNA ligase (Enzymatics) for ligation, room-temperature purification of gel slices using QIAquick (Qiagen) spin columns and amplification using Phusion (NEB) GC buffer). Paired-end sequencing was carried out for 2× 36 cycles on a Genome Analyzer II (Illumina).

Allele-Specific Analysis

Mouse genome sequencing data (129S1/SvImJ and CAST/EiJ) from the Wellcome Trust Sanger Institute (sanger.ac.uk/resources/mouse/genomes/) aligned to the C57BL/6J reference genome (NCBI mm9) was screened for high quality single nucleotide polymorphisms (SNPs) and insertions/deletions indels. Variant genomes were constructed from mm9 using a total of 17,879,569 SNPs, 726,387 indels for CAST/EiJ, and 4,551,690 SNPs, 224,271 indels for 129S1/SvImJ. In total, the resulting CAST/EiJ and 129S1/SvImJ genomes differ in 22,095,665 SNPs and 948,567 indels. Read pairs were aligned to both genomes allowing for up to ~5 mismatches at high-quality bases or 2-4 small gaps using novoalign (Keightley et al., Genome Res. July 2009 19: 1195-1201). Each uniquely aligned pair to the CAST/EiJ genome was compared to the corresponding pair aligned to the 129S1/SvImJ genome. Pairs that differed significantly in alignment score due mismatches/gaps were classified as allele-specific and the better alignment retained. Pairs with identical alignment scores or scores that differed only slightly due to fragment length penalties were classified as neutral. Each experiment yields three tracks: Cast, 129, and composite (neutral, 129, Cast combined).

Generation of Coverage Maps and Enrichment Segments

Alignment coordinates were mapped to mm9 to permit comparisons to mm9 annotations. To calculate coverage, fragments defined by paired reads were included, discarding duplicate fragments. Coverage was normalized by input. Chromosomal segments that are likely to be enriched for a chromatin epitope were defined by analyzing significantly enriched overlapping 1 kb windows. The significance of the coverage enrichment in a window was determined based on the null model of paired-end fragments randomly shuffled across the chromosome.

To calculate coverage, fragments defined by paired reads were included, discarding duplicate fragments. The average fragment length was approximately 300-400 bp. The resulting positional coverage in each sample was normalized by the corresponding input coverage, with a pseudocount of 1: $n_{norm}=[(n+1)/(n_I+1)]*[N_I/N]$, where n, $n_I$, N, and $N_i$ are positional coverages in experiment and input, and total genome coverages in experiment and input, respectively.

To determine the likely regions of enrichment for chromatin modifications and EZH2, we used a window of 1 kb sliding over the chromosome length with the step of 50 bp. The significance of the window coverage at each position was assessed using the null model of randomly redistributed fragments. Specifically, each paired-end fragment at the given chromosome was assigned to a random location within this chromosome, followed by input normalization. The resulting normalized coverage of 1 Kb windows over all chromosomes was used to construct the random coverage distribution. Based on this distribution, P-value was assigned to the real window coverages. Windows with P-value below the significance cutoff were merged into segments, with up to 1 kb gap allowed between windows. The cutoff for calling significant window coverage was selected based on manual inspection of the segments produced at different cutoff values. The determined cutoffs showed high robustness between independent simulations.

Strongly covered segments for K4me3 and EZH2 were identified with the P-value cutoff of $10^{-5}$. Moderately covered segments for H3K27me3 and EZH2 were identified with absolute coverage cutoffs of 4.0 and 3.0 per position, respectively. Bivalent segments were identified in a similar fashion, with the requirement of a significant K4me3 coverage and a moderate K27me3 coverage within the same window.

Segments were classified as overlapping with K4me3 peaks, bivalent segments, and CpG islands if the corresponding feature occurred within 1 kb from the segment. CpG islands were defined by running EMBOSS 6.3.1 on unmasked genome with default parameters.

Chromosomal segments that are likely to be enriched for a chromatin modification or a DNA-binding protein were defined by merging adjacent significantly enriched 1 kb windows. The significance of the coverage enrichment in a window was determined based on the null model of originally aligned paired-end fragments being randomly shuffled across the chromosome.

Metagene and Metasite Profiles

The profiles of average coverage density over genes (metagene profiles) and over segments (metasite profiles) were constructed using normalization of profile densities so that the area under curve was proportional to the average gene/segment coverage at this chromosome. The profiles of average coverage density over genes (metagene profiles) and over sites were constructed as described before, with the exception for a different normalization that allows for the comparison of total gene/site coverage between alleles, chromosomes, and differentiation stages. Specifically, profile densities were normalized by the number of genes/sites at a given chromosome, so that the area under the curve is not equal to 1.0 but proportional to the average gene/site coverage at this chromosome.

Estimates of Density Map Correlations

Correlations between chromosomal density maps were calculated as Pearson correlation coefficients of coverages in non-overlapping windows, with estimates of statistical significance based on random permutation null model.

Correlations between chromosomal density maps were calculated based on the coverages of non-overlapping 1-5 kb windows over the entire chromosome. For the two compared marks, Pearson correlation coefficient was calculated on the sets of window coverages, and its statistical significance was estimated using random permutation null model. Specifically, $10^5$ simulations of random window shuffling were performed, resulting in the background distribution of Pearson correlation coefficients. This distribution was very well approximated by normal distribution (data not shown). The significance of the actual correlation of estimated as a Z-score based on the background distribution. We selected Z-score as a measure since many P-values for highly correlated marks were below computational precision and would appear as zero in the plots. Using Spearman rank correlation coefficients produced very similar results. Correlations between densities of different EZH2 and H3K27me3 sites were calculated in a similar fashion.

Estimates of Allelic Skew

Allelic skew of coverage at a given segment was analyzed by comparing allele-specific coverages at this segment. The significance of skew was estimated based on the normal distribution of effective numbers of allele-specific fragments.

Allelic skew of coverage at a given segment was analyzed by comparing allele-specific coverages at this segment. The significance of skew was estimated based on the normal distribution of effective numbers of allele-specific fragments. P-values were based on normal approximation of binomial distribution $N(np, np(1-p))$ where $p=0.5$ and n is the total effective number of fragments estimated from total coverage cov and average paired-end fragment length $<L>$: $n=cov/<L>$.

Repeat Enrichment Analysis

The significance of repeat enrichment or depletion was estimated against the distribution of RepeatMasker repeat numbers in the segments shuffled along the chromosome. Among the segments enriched for EZH2, we counted the number of segments overlapping different types of repeats defined by RepeatMasker in mm9 mouse genome. The significance of repeat enrichment or depletion was estimated against the distribution of repeat numbers in the segments shuffled along the chromosome (100 simulations).

Analysis of Coverage in Long-Range Vicinity of EZH2 Sites

The analysis of coverage trends in the megabase-scale vicinity of strong EZH2 sites was based on the coverage of 1 kb windows with 200 bp shift over the entire chromosome. For each window, the closest strong EZH2 segment was determined, and the window coverage was plotted against the distance to the closest segment. The trends of moderate site coverage around the strong sites were analyzed in a similar fashion.

Allele-Specific ChIP-qPCR

ChIPs were carried out as described above in biological triplicate for EZH2 and H3K27me3 from d0, d7 and MEF cells. Allele-specific primers were designed to discriminate at least 2 out the last 4 terminal (3') positions of the primer annealing site, and allele-specificity was confirmed using genomic DNA from pure Cast and 129 mice. Amplification was performed using 2× iQ Sybr green (Biorad) on a CFX96 instrument (Biorad) with the following protocol: 3 min at 95° C., then 45 cycles of 15 sec at 95° C., 15 sec at 58° C. and 30 sec at 72° C. Reactions using 129- and Cast-specific primers were set up in parallel from the same ChIP DNA dilution and contained one universal primer and one of two allele-specific primers (mus for 129, cas for Cast in primer name) at 250 nM:

| PRC2 site | Allele-specific primers | SEQUENCE | SEQ ID NO: |
|---|---|---|---|
| m-13: | p267-13m631musF: | GGC AGG GGT TAC TAC AGT AGA GTG | 3151 |
| | p268-13m631casF: | GGC AGG GGT TAC TAC AGT AGA GAA | 3152 |
| | p269-13m631R: | CAG CTC TGG GAA GGT TTT GTA TG | 3153 |
| c-13: | p270-13c47F | CCT GGT AGA GTC ACC TCC GGA CAG | 3154 |
| | p271-13c47musR | GAA CCT TTT CCC TCC AAG CCC AGA | 3155 |
| | p272-13c47casR | GAA CCT TTT CCC TCC AAG CCC CGC | 3156 |
| c-X1: | p276-Xc10F | CCT GCG ATC CGG CGC TTT G | 3157 |
| | p277-Xc10musR | CTC TCC CGA CCC CGC ACA CAT T | 3158 |
| | p278-Xc10casR | CTC TCC CGA CCC CGC ACA CGT C | 3159 |
| m-X1: | p283-Xm269musF | GGC TCA CAT TTG CAC TTT TTG CTA CG | 3160 |
| | p284-Xm269casF | GGC TCA CAT TTG CAC TTT TTG CTA AA | 3161 |
| | p285-Xm269R | GGG ATG AGG CGT CTG TGT TGG GTC | 3162 |
| a-X2: | p286-Xa76musF | CAC ATA AAA CAT CAA ACA GAA CAT GTG AGC | 3163 |
| | p287-Xa76casF | CAC ATA AAA CAT CAA ACA GAA CAT GTT AGA | 3164 |
| | p288-Xa76R | GGA CAC ACA AAT AGT GAC CTG GTG GC | 3165 |
| c-X2: | p289-Xc77musF | GCT TAG CGG ATT CCA TAC CCC AA | 3166 |
| | p290-Xc77casF | GCT TAG CGG ATT CCA TAC CCC CC | 3167 |
| | p291-Xc77R | GAG CAC ATT TTT AAG AAA ACC GAT GAC AG | 3168 |
| m-X2: | p295-Xm2240musF | GGA AGG GAA GTA ATT AAG CAA ACA CAA ACA | 3169 |
| | p296-Xm2240casF | GGA AGG GAA GTA ATT AAG CAA ACA CAT GG | 3170 |
| | p297-Xm2240R | CTC AAA GAA AAA AAA TAT CAT AAA AAC CAA ACT GTT TC | 3171 |
| Jarid1: | p298-intrJarid1cF | CAC TTC TTT TGT GCC TTA AGC ATT AGC | 3172 |
| | p299-intrJarid1cmusR | TCA CAC AGG TCA GAT ACA AAA AGT ATA GTT | 3173 |
| | p300-intrJarid1ccasR | TCA CAC AGG TCA GAT ACA AAA AGT ATA GCA | 3174 |

Example 1

Allele-Specific ChIP-seq

Figure 8A:
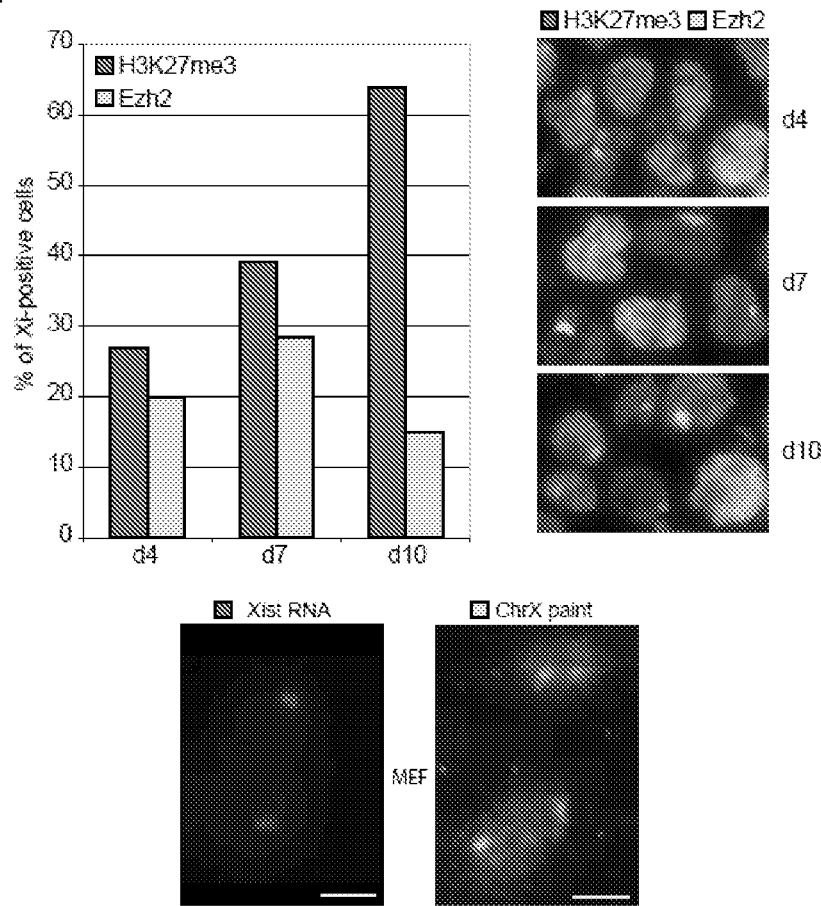
Figure 8B:
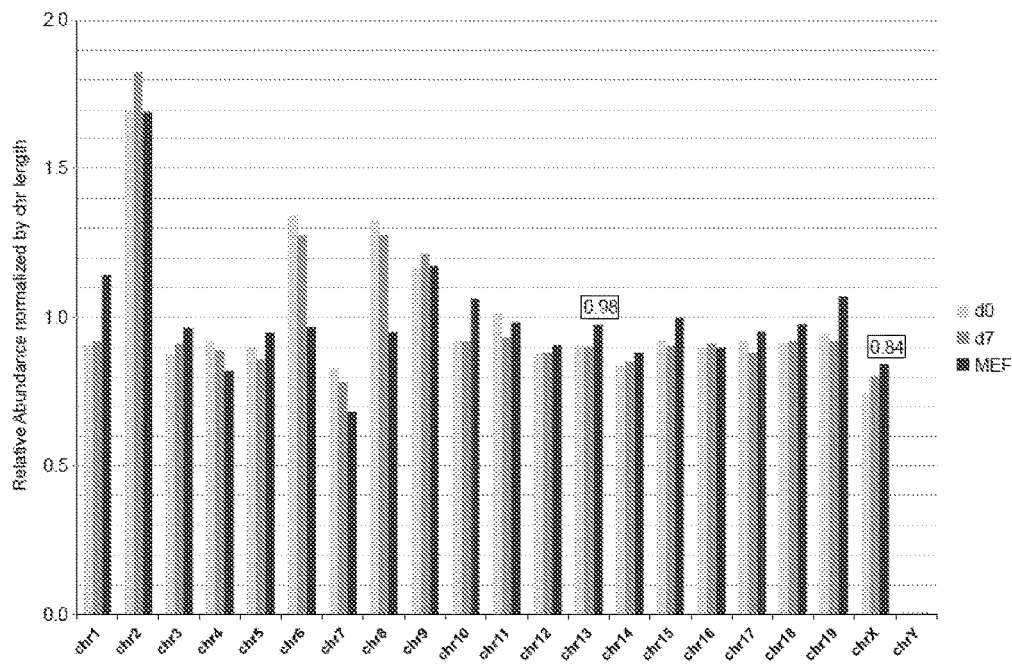
Figure 8C:
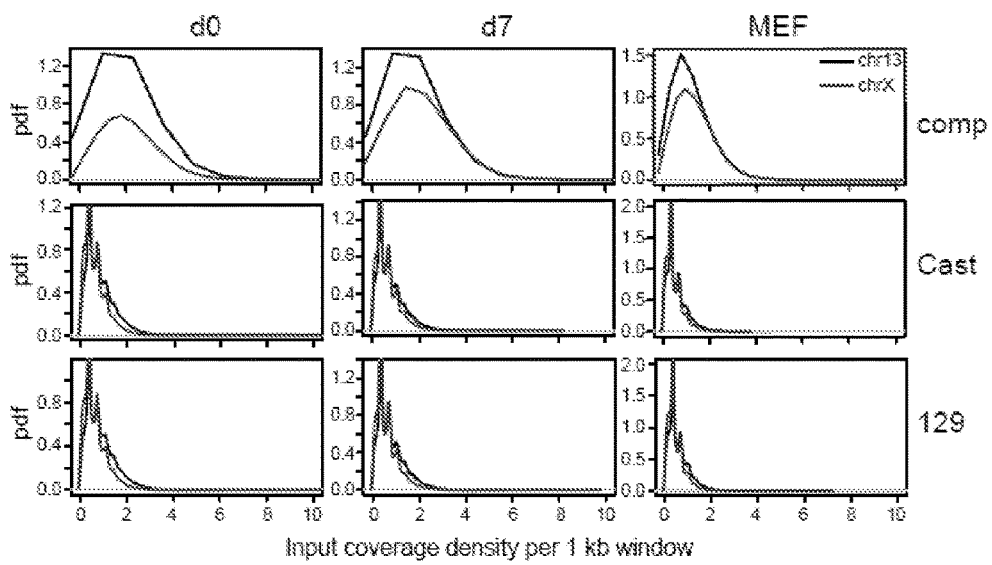

Mammalian PRC2 contains four core subunits, EED, SUZ12, RBAP48 (RBBP4 in mouse), and EZH2, the subunit responsible for trimethylating H3K27. Because Polycomb recruitment is a central feature of XCI (Plath et al., 2003; Silva et al., 2003; Zhao et al., 2008), we obtained allele-specific ChIP-seq profiles for EZH2 and H3K27me3 and compared them to those for activating marks, including holoenzyme POL-II-S5P (active POL-II), H3K4me3 (transcriptional initiation), and H3K36me3 (transcriptional elongation). To distinguish Xi from Xa, we used female cell lines carrying one X of Mus castaneus origin ($X^{Cast}$) and one of M. musculus 129 origin ($X^{129}$), and analyzed three developmental stages. First, we examined undifferentiated female ES cells (d0), which carry two Xa but recapitulate XCI during differentiation. Second, we examined differentiating ES cells on day 7 (d7), a timepoint corresponding to a mid-XCI state where ~40% of cells are establishing XCI (FIG. 8A). Disabling the Tsix allele on $X^{129}$ ($Tsix^{TST}$/+) (Ogawa et al., 2008) ensured inactivation of $X^{129}$ in the ES line. Third, we examined post-XCI, clonal hybrid female mouse embryonic fibroblasts (MEF; F1, ♂$X^{Cast}$×♀$X^{129}$) which have inactivated $X^{129}$. Approximately 0.6 million SNPs and insertions/deletions (indels) of ~23 million genomewide SNPs/indels between M. castaneus and M. musculus were used to distinguish $X^{Cast}$ and $X^{129}$ (Keane et al., 2011).

Using paired-end sequencing, 283% of all read pairs aligned uniquely and ~36% provided allele-specific information (Table I). All tracks (Cast, 129, Composite) were first normalized to their corresponding input controls to minimize potential artifacts stemming from differential chromosome compaction, crosslinking or sonication efficiencies, with ES and MEF input data mapping proportionally to chromosome length (FIG. 8B) and equally well to both homologs of ChrX and Chr13 (FIG. 8C); this showed that experimental bias between Xi and Xa was negligible. The composite track (comp) represents total epitope abundance, whereas Cast and 129 tracks reflect relative allelic abundance and local SNP densities (see Supplemental Methods). To validate our approach, we inspected loci with established mono- or bi-allelic expression (FIG. 9). At the imprinted Dlk1-Meg3 and Zim1-Peg3 loci, allele-specific H3K4me3 and POL-II-S5P profiles were consistent with known parent-of-origin effects. At the Xist promoter, H3K4me3 and POL-II-S5P were specifically enriched on $X^{129}$ (Xi). The opposite pattern was observed at Iqsec2, a gene subject to XCI. By contrast, biallelic H3K4me3 and POL-II-S5P enrichment was seen at the neighboring Jarid1c (Kdm5c), a gene known to escape XCI (Greenfield et al., 1998; Carrel and Willard, 2005). These results demonstrate the allele-specific nature of our ChIP-seq.

et al., 2010). Eight out of 11 genes appeared on both lists (e.g., Utx (Kdm6a), Jarid1c). Three noncoding genes, including Jpx (Enox), Ftx (B230206F22Rik) and 5530601H04Rik (FIG. 10B), appeared only in our study, though they had been shown by others to be biallelically expressed (Johnston et al., 2002; Reinius et al., 2010; Chureau et al., 2011). These results suggest that allele-specific ChIP-seq could be an effective method of identifying monoallelically expressed genes on a genome-wide scale.

Example 3

Allelic Profiles of Xa and Xi

We then performed metagene analysis to examine average epitope densities within genes on chromosomes X (ChrX) and 13 (Chr13). In 16.7 ES cells, Chr13 was the only autosome that is fully *M. castaneus* for one homologue and fully 129 for the other in $Tsix^{TST}/+$ ES cells (other autosomes have meiotically recombined in the F1 germline). For Chr13 genes, the marks of gene activation remained relatively constant and there was little allele-specific distinction before (d0 ES), during (d7 ES), and after (MEF) XCI. On both homologues, POL-II-S5P and H3K4me3 were enriched over promoters, and H3K36me3 occurred along the gene body, as expected.

By contrast, ChrX showed dynamic changes. While $X^{Cast}$ and $X^{129}$ profiles were similar on d0 (pre-XCI), they diverged significantly at d7 (mid-XCI) and remained distinct in MEFs (post-XCI)(FIG. 1A). Active marks (POL-11-S5P, H3K4me3, and H3K36me3) showed stereotypical enrichment on both homologues in the pre-XCI state (d0), but became substantially depleted on Xi ($X^{129}$) allele in d7 cells, dropping to about half of Xa ($X^{Cast}$) levels, as might be expected for a mid-XCI stage. In MEFs (post-XCI) the average composite values were reduced by ~50% and the Xi trace flatlined, consistent with complete loss of POL-II-S5P, H3K4me3, and H3K36me3 from Xi. Conversely, EZH2

TABLE I

Statistics for sequencing of input and indicated epitopes. ChIP-seq results for MEF, d0, and d7 ES cells showing all clusters and reads that are aligned, repetitive or unique, and allelic or neutral in millions and percent.

| celltype | epitope | clusters | aligned | | unique | | allelic | | neutral | |
|---|---|---|---|---|---|---|---|---|---|---|
| MEF | input 1 | 19.5 | 18.6 | 95% | 15.5 | 83% | 5.6 | 36% | 9.9 | 64% |
| MEF | input 2 | 28.7 | 27.5 | 96% | 23.1 | 84% | 8.5 | 37% | 14.6 | 63% |
| MEF | H3K27me3 | 17.9 | 17.0 | 95% | 15.2 | 89% | 5.5 | 36% | 9.7 | 64% |
| MEF | EZH2 | 21.9 | 19.8 | 90% | 16.8 | 85% | 6.1 | 36% | 10.7 | 64% |
| MEF | H3K4me3 | 20.4 | 19.4 | 95% | 17.9 | 93% | 5.5 | 31% | 12.5 | 69% |
| MEF | H3K36me3 | 17.2 | 16.5 | 96% | 14.4 | 87% | 5.1 | 36% | 9.2 | 64% |
| MEF | POL-II-S5 | 26.0 | 24.3 | 93% | 21.6 | 89% | 7.6 | 35% | 14.0 | 65% |
| ES d0 | input 1 | 32.5 | 31.3 | 96% | 26.0 | 83% | 9.5 | 36% | 16.5 | 64% |
| ES d0 | input 2 | 23.0 | 21.1 | 92% | 18.3 | 87% | 6.9 | 38% | 11.4 | 62% |
| ES d0 | H3K27me3 | 27.1 | 25.8 | 95% | 22.5 | 87% | 8.1 | 36% | 14.3 | 64% |
| ES d0 | EZH2 | 27.7 | 26.1 | 94% | 21.9 | 84% | 7.8 | 35% | 14.2 | 65% |
| ES d0 | H3K4me3 | 25.6 | 23.9 | 93% | 20.6 | 86% | 6.5 | 31% | 14.2 | 69% |
| ES d0 | H3K36me3 | 24.3 | 23.1 | 95% | 18.9 | 82% | 6.6 | 35% | 12.3 | 65% |
| ES d0 | POL-II-S5 | 29.3 | 27.9 | 95% | 24.4 | 88% | 8.5 | 35% | 16.0 | 65% |
| ES d7 | input | 29.7 | 28.6 | 96% | 23.7 | 83% | 8.4 | 35% | 15.3 | 65% |
| ES d7 | H3K27me3 | 30.6 | 28.8 | 94% | 25.3 | 88% | 8.6 | 34% | 16.7 | 66% |
| ES d7 | EZH2 | 29.1 | 27.5 | 94% | 23.0 | 84% | 8.2 | 36% | 14.8 | 64% |
| ES d7 | H3K4me3 | 26.2 | 24.8 | 95% | 22.7 | 92% | 7.1 | 31% | 15.6 | 69% |
| ES d7 | H3K36me3 | 29.5 | 28.2 | 96% | 21.6 | 77% | 6.8 | 32% | 14.8 | 68% |
| ES d7 | POL-II-S5 | 28.4 | 26.7 | 94% | 22.6 | 85% | 8.1 | 36% | 14.6 | 64% |
| | Average | 25.7 | 24.3 | 94.5% | 20.8 | 85.7% | 7.2 | 34.9% | 13.6 | 65.1% |
| | Stdev | 4.4 | 4.3 | 1.5% | 3.5 | 3.6% | 1.3 | 2.1% | 2.3 | 2.1% |

Example 2

Genes that Escape XCI

We used allele-specific profiles to identify genes that escape XCI by scoring H3K4me3 peaks within 3 kb of annotated transcriptional start sites (TSS) and noting allelic skews with statistical significance (p<0.05, normal approximation of binomial). Genes with significant $X^{Cast}$ (Xa) skewing were considered monoallelic. Genes with insignificant skewing or two-allele H3K4me3 enrichment were designated biallelic. Genes lacking H3K4me3 peaks within 3 kb of annotated promoters were considered repressed ("off"). Those lacking sufficient SNP density were excluded (not determined, "n/d"). On Chr13, ~400 out of 843 genes were biallelic, ~300 genes were off, ~100 were indeterminate (n/d), and few were monoallelic (FIG. 10A).

$X^{Cast}$ skewing was evident for almost all MEF genes (FIG. 10A), consistent with the genes being subject to XCI (Carrel and Willard, 2005; Berletch et al., 2010). Eleven genes showed biallelic H3K4me3 marks (FIG. 10B,C), in excellent agreement with recent expression analysis (Yang binding increased 2-fold on Xi between d0 and d7, and H3K27me3 levels increased 3-fold. On Xa ($X^{Cast}$), EZH2 and H3K27me3 levels stayed relatively constant. These results demonstrated de novo recruitment of EZH2 and H3K27 trimethylation en masse to X-genes during XCI. In post-XCI MEFs, however, allelic differences remained for H3K27me3 but EZH2 binding was not significantly enriched in genes on Xi over Xa. These results indicate that massive PRC2 recruitment occurs during the establishment phase of XCI, but maintenance does not require large amounts of genic PRC2, consistent with the already trimethylated state of H3K27 in post-XCI cells. It is possible that PRC2 on Xi is concentrated in nongenic regions.

Figure 1B:
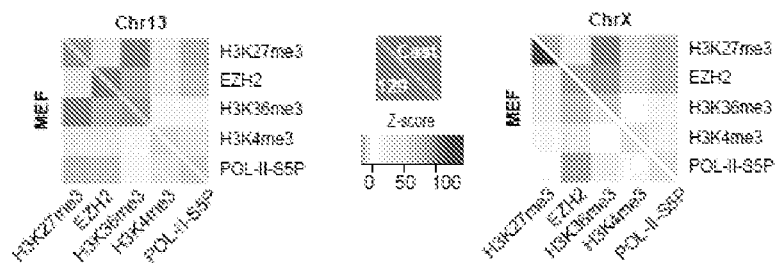
Figure 1C:
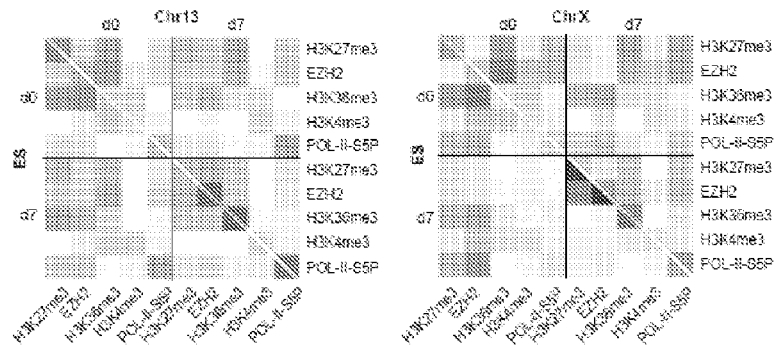

We then examined whole-chromosome coverages. Allelic heatmaps displayed positional correlations between different epitopes at different timepoints, with color-coded Z-scores representing the significance of the correlation estimated using a permutation-based random model (FIG. 1B,C). In MEF (FIG. 1B), allelic profiles for Chr13 were essentially identical (colors mirrored across the diagonal) with strong positive correlations of POL-II-S5P with H3K4me3 and H3K36me3, and good anti-correlations between POL-II-S5P/H3K36me3 and H3K27me3/EZH2. However, allelic profiles for ChrX were significantly different for a number of epitopes (discordant colors across the diagonal), consistent with XCI having occurred in MEFs. To ask what happens during XCI establishment, we examined d0 and d7 ES cells (FIG. 1C). Chr13 showed almost no allelic differences for any chromatin epitope, but significant allelic deviations were seen on ChrX. First, while the positive correlation between H3K27me3 and EZH2 on Xi was significant on d0 (Z-score=15), the correlation grew very strong on d7 (Z-score=96). Second, whereas H3K27me3/EZH2 were anti-correlated with active marks on d0, they became unexpectedly positively correlated on d7. Notably, the active marks showed high correlation between d0 and d7, suggesting that their density maps did not change dramatically. This dynamic of active versus repressive marks raised the intriguing possibility that, during XCI, EZH2 and H3K27me3 appear in domains marked by active POL-II and H3K4me3. This feature was Xi-specific, and absent on Xa and Chr13.

Example 4

Strong EZH2 Recruiting Sites on Xi are Bivalent Domains

Chromatin regions marked concurrently by H3K4me3 and H3K27me3 have been termed 'bivalent domains', typically associated with transcriptionally poised developmental genes in ES cells (Bernstein et al., 2006). In undifferentiated ES cells, CpG islands associated with bivalent domains account for most EZH2 sites (Ku et al., 2008), and H3K27me3 is rarely detected in the absence of H3K4me3 (Mikkelsen et al., 2007). We asked if EZH2 localization and H3K27me3 followed similar patterns on ChrX during XCI. On d0, most 'strong' EZH2 sites—defined as sites with significant EZH2 ChIP-seq coverage ($p<10^{-5}$ according to a permutation-based random model)—were often found within canonical bivalent domains (FIG. 2A), frequently coinciding with CpG islands (striped), as well as a few that were solely H3K27me3-marked. This was true for both ChrX and Chr13 and consistent with previous reports (Bernstein et al., 2006; Mikkelsen et al., 2007; Ku et al., 2008).

Figure 2A:
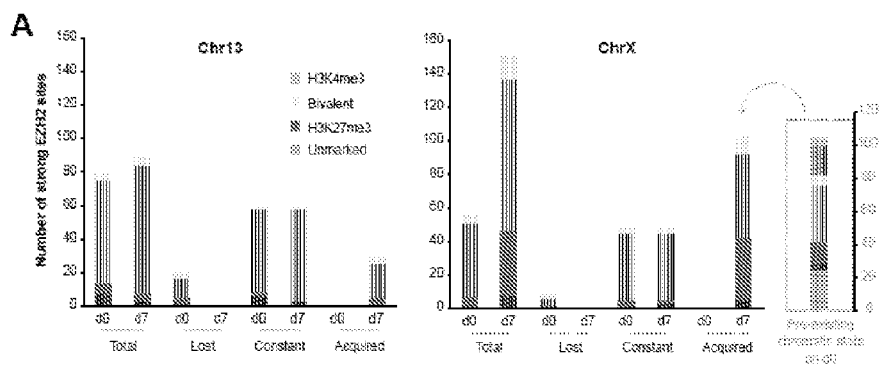
Figure 2B:
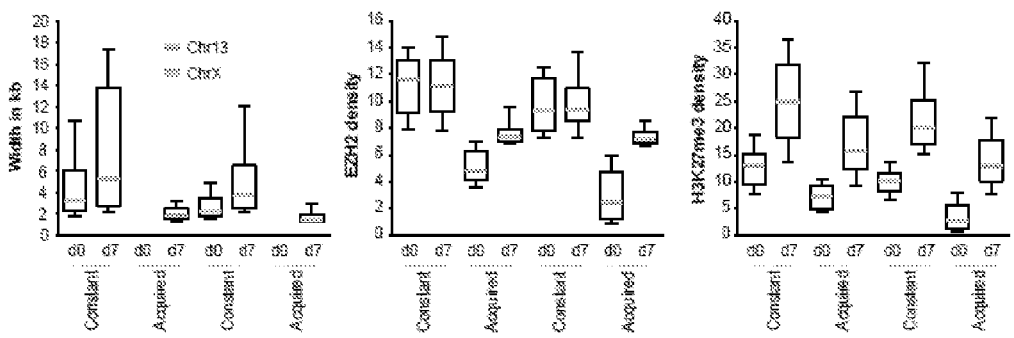
Figure 2C:
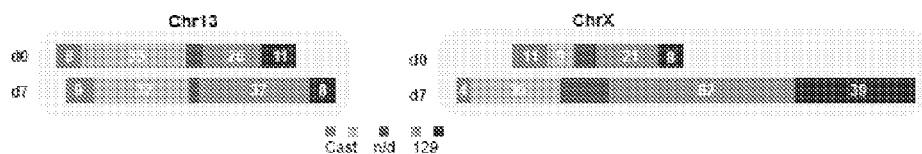

However, during cell differentiation and XCI, the chromatin composition and number of strong EZH2 sites diverged dramatically between ChrX and Chr13. On Chr13, 20 out of 79 of d0 EZH2 sites were lost and few new EZH2 sites were acquired (30). Almost all d7 sites were still bivalent domains associated with CpG islands (FIG. 2A). On the other hand, ChrX lost very few sites (8/48) and a large number (>100) of new EZH2 sites was acquired on d7. In contrast to constant sites, many acquired sites on ChrX were neither bivalent nor CpG islands. Among acquired sites, about half were already marked weakly by H3K27me3 on d0 but were below the significance cutoff for EZH2: the rest was previously marked solely by H3K4me3 or unmarked by either epitope (FIG. 2A, sidebar). Interestingly, strong EZH2 sites on both Chr13 and ChrX showed changes in widths of the sites, EZH2 densities, and H3K27me3 densities (FIG. 2B), which suggest a genome-wide increase in PRC2 activity from d0 and d7. Acquired sites on ChrX, however, may be key regulators of XCI, because they appear primarily on Xi during differentiation, as shown by allelic skewing of coverage (FIG. 2C).

Therefore, ChrX and Chr13 differed in several respects during XCI. First, ChrX gained a large number of EZH2 sites. Second, EZH2 binding on ChrX was allelically skewed (to future Xi). Third, whereas acquired and constant Chr13 sites were mostly bivalent, only about half of acquired X-linked sites were bivalent before XCI. Fourth, acquired sites on ChrX experienced larger increases in EZH2 and H3K27me3 densities than on Chr13. Given that many new EZH2 sites did not conform to the established paradigm of being bivalent, we suspected that non-canonical EZH2-binding sites may be central to the spread of XCI.

Example 5

Non-Canonical EZH2 Sites on Xi for Spreading

Figure 2D:
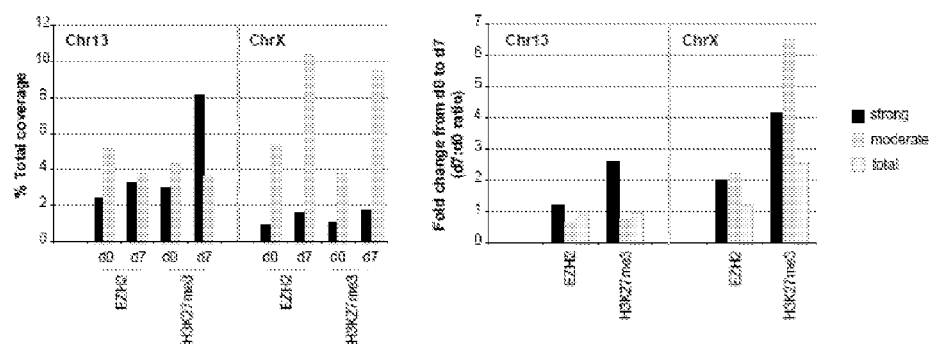
Figure 3A:
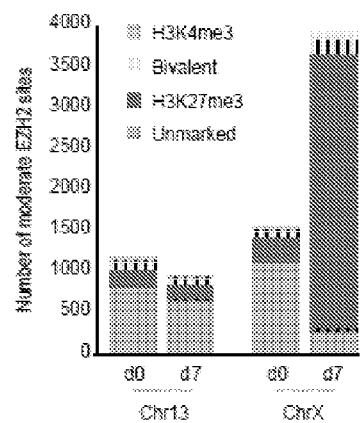
Figure 3B:
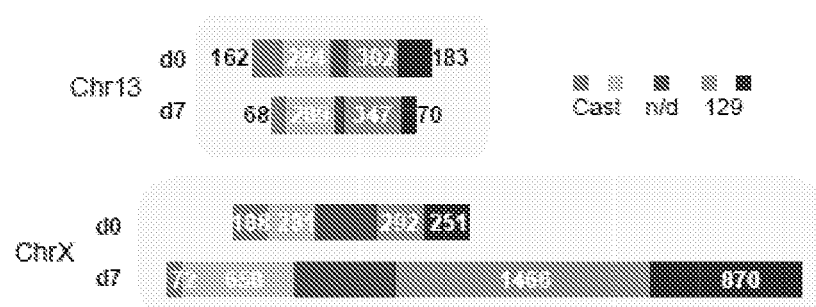
Figure 3C:
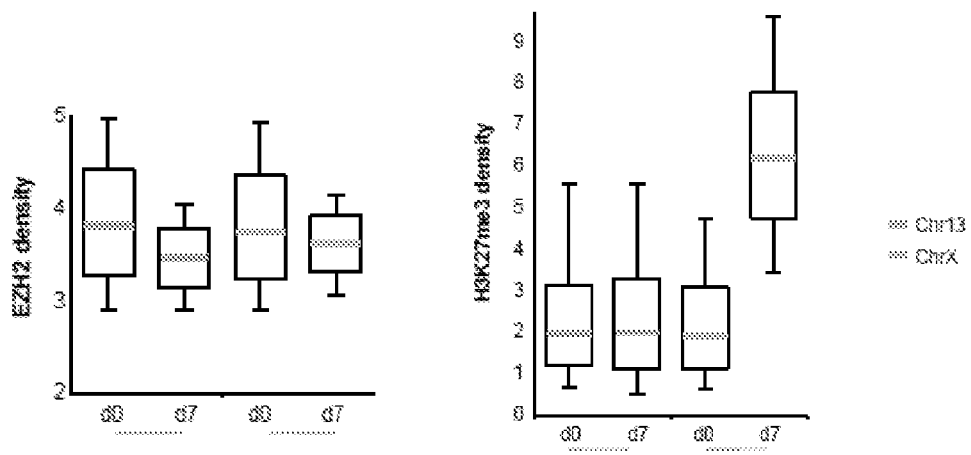
Figure 3D:
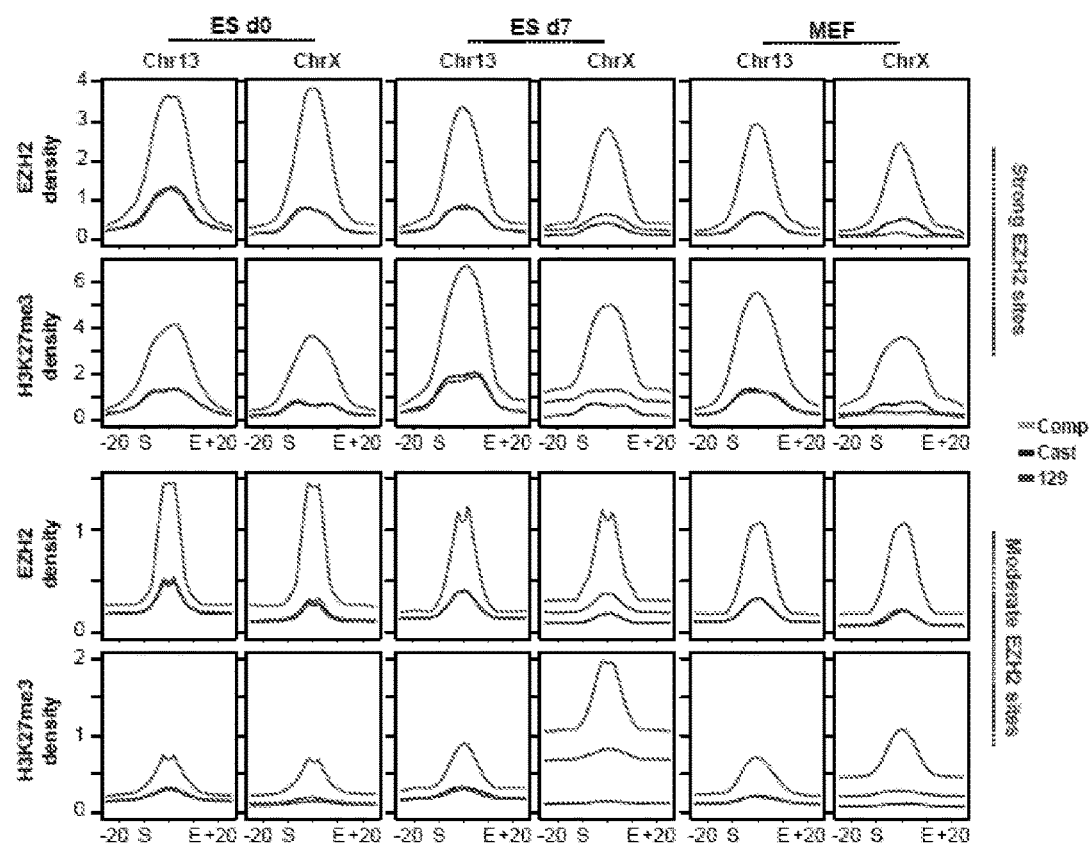
Figure 4A:
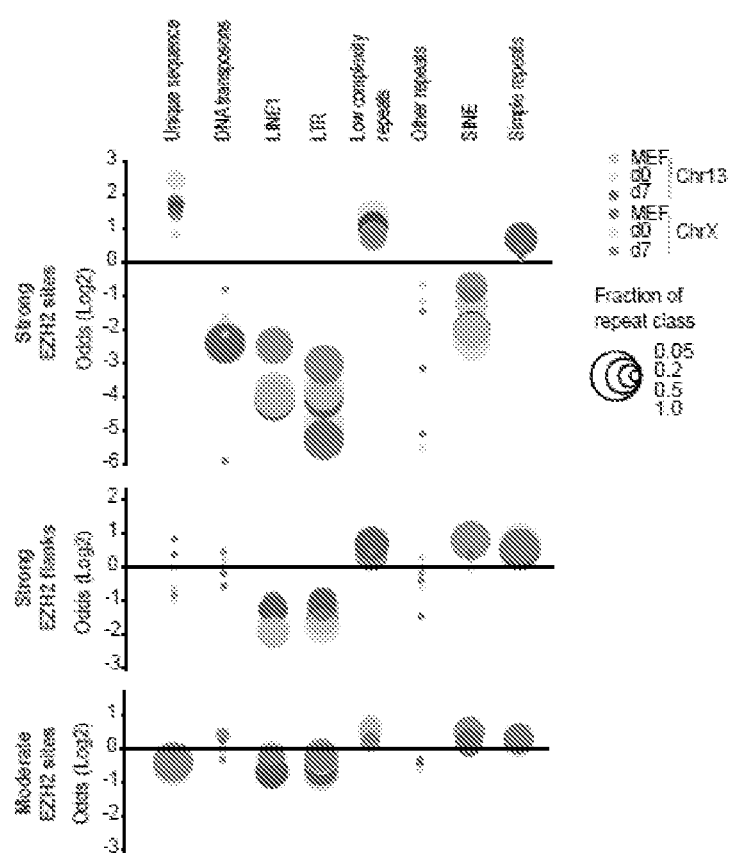
Figure 4B:
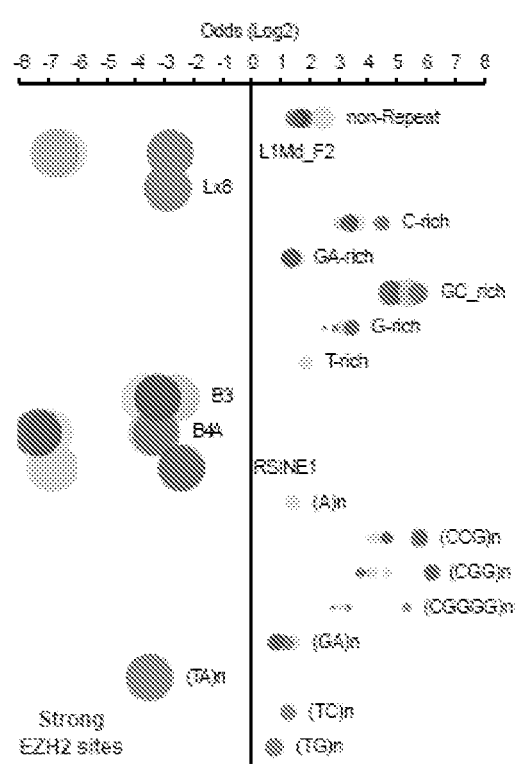
Figure 4C:
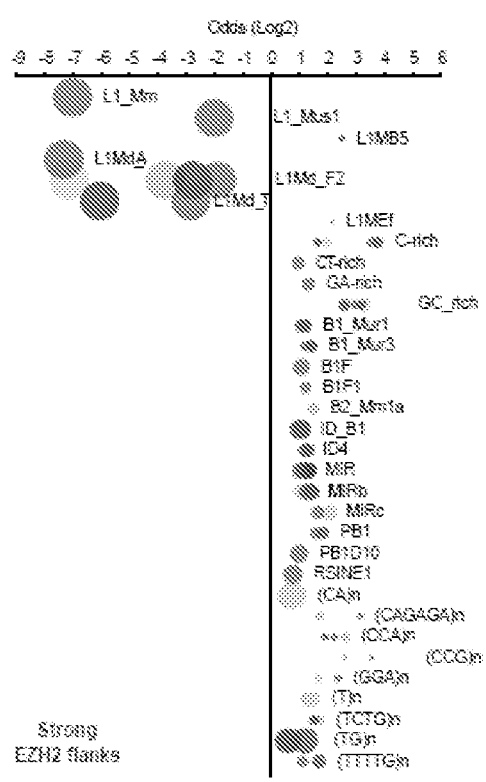
Figure 4D:
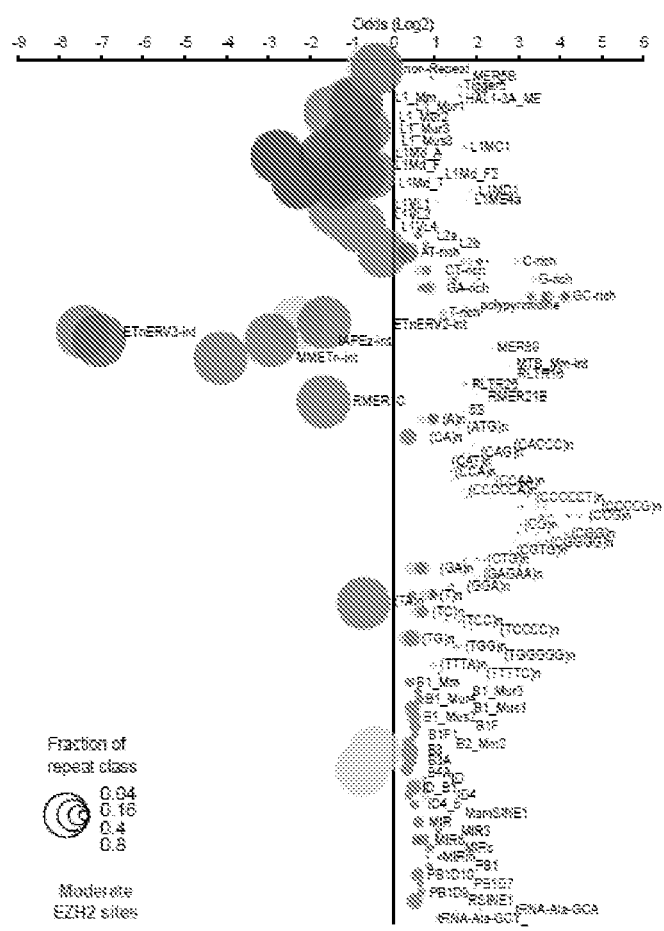

In light of de novo recruitment of non-canonical sites and the finding that many such sites were already weakly H3K27me3-positive (but below cutoff) on d0, we asked whether we might find additional functional EZH2 sites by relaxing the EZH2 enrichment threshold (FIG. 11A). We also noted that, although chromosome-wide coverages of EZH2 and H3K27me3 were greater for ChrX than Chr13 (d7), the cumulative coverages over strong sites accounted for a small fraction of total and were actually less for ChrX than Chr13 (FIG. 2D). By relaxing the cutoff to a density of >3/bp over a 1 kb window (equivalent top <0.03 according to random model) and excluding strong EZH2 sites ($p<10^{-5}$), we observed a large number of previously undetected sites, almost all of which were neither bivalent domains nor CpG islands (FIG. 3A). On ChrX, such 'moderate' or 'non-canonical' sites numbered at ~1500 on d0 and grew to ~4000 during XCI (d7). Moderate sites greatly exceeded strong sites in number and were mostly intergenic (~⅔, data not shown). Allelic profiles showed that the greatest gain occurred on $X^{129}$ (Xi) FIG. 3B). Although non-canonical sites also occurred on Chr13, their number was smaller and remained constant during cell differentiation. Furthermore, Chr13 sites showed little evidence of productive H3K27 trimethylation, whereas moderate ChrX sites were almost exclusively H3K27me3-marked (FIG. 3A,C). In fact, moderate sites on ChrX represented the lion's share of EZH2 activity during XCI. EZH2 and H3K27me3 levels summed over moderate sites far exceeded those over strong sites (FIG. 2D, left panel). The greatest change in H3K27me3 coverage between d0 and d7 was observed on these non-canonical sites (FIG. 2D, 3C, right panel). Taken together, these data indicate that massive acquisition of non-canonical EZH2 sites—both strong and moderate— defines XCI, and that non-canonical EZH2 sites (rather than bivalent sites) distinguish Xi from Xa and from autosomes. Though both bivalent and non-canonical sites are recruited during XCI, the latter best reflects the XCI-specific spread of PRC2 during cell differentiation.

Next, we experimentally validated the bioinformatically defined strong and moderate sites by performing allele-specific ChIP-qPCR on select loci from Chr13 and ChrX in d0/d7 ES cells and in MEF (FIG. 12, 13). Analysis of strong (constant and acquired) sites and moderate sites, revealed clear concordance between the ChIP-seq and ChIP-qPCR results for all tested epitopes, including EZH2, H3K27me3, and H3K4me3. First, strong sites (c-13, c-X1, c-X2) showed significantly greater enrichment by ChIP-qPCR than nearby moderate sites (m-13, m-X1, m-X2)(p<0.05, one-tailed Mann-Whitney U test). Second, allelic differences observed by ChIP-seq were reproduced by allelic-specific ChIP-qPCR. Finally, results from three biological replicates were consistent and showed significantly higher EZH2 and H3K27me3 binding at both strong and moderate sites than observed for an IgG pulldown control and the negative control escapee locus, Jaridlc (FIG. 13, * p<0.05, one-tailed Mann-Whitney U test). Thus, the ChIP-qPCR results validated our general approach to allele-specific ChIP-seq analysis.

To assess local spreading at strong and moderate sites, we plotted average EZH2 and H3K27me3 densities at binding sites ±20 kb of flanking sequence (FIG. 3D), with EZH2 sites being scaled from 0 to 1 between its start (S) and end (E) (metasite profile). On d0, no allelic differences were observed on ChrX and Chr13. On d7, strong allelic skew was observed on ChrX at both strong and moderate sites, and EZH2 and H3K27me3 densities were consistently greater on $X^{129}$ (Xi) than on $X^{Cast}$ (Xa), as expected. Interestingly, a flipped allelic skew was observed for strong sites in MEFs, occurring only in EZH2 levels and not in H3K27me3 levels. This is consistent with the notion that maintenance of H3K27me3 levels after the establishment of XCI requires only low levels of EZH2 at strong sites; on Xa, by contrast, higher levels of EZH2 may be continuously required for dynamic responses in X-linked gene expression. Most intriguingly, however, changes in EZH2 and H3K27me3 densities on d7 were greater at moderate than strong X-linked sites and occurred not only within the sites but also across >20 kb of flanking sequence bi-directionally (FIG. 3D), supporting the idea that non-canonical moderate sites are central to spreading of XCI.

Example 6

Relationship of EZH2 Sites to Repetitive Elements

We investigated whether the PRC2 sites share underlying sequence motifs. Given hypothesized roles for repetitive elements in spreading (Bailey et al., 2000; Lyon, 2000; Wang et al., 2006; Chow et al., 2010), we examined correlations with repeat classes (FIG. 4). Our paired-end sequencing approach enabled unique alignments of a large number of repeat-containing reads by virtue of being paired with a non-repetitive read. Strong sites were generally enriched in low-complexity repeats (d0, d7)(Z>2.5, permutation-based random model) and simple repeats (d7), but most simple repeats were GC-rich motifs typically found at CpG islands and bivalent domains (FIG. 4A,B; Tables II, III)(Ku et al., 2008). Short interspersed nuclear elements (SINE), long interspersed nuclear elements (LINE), and long-terminal repeats (LTR) were significantly under-represented. (TC)n and (TG)n repeats were over-represented specifically on ChrX, but <20% of strong EZH2 sites contained such repeats. Because flanking regions may play a role in spreading, we examined 3-kb flanks to either side of a strong site. Again, low-complexity and simple repeats were over-represented, and LINE1 and LTR were under-represented on both ChrX and Chr13 (FIG. 4A,C; Tables II, III). However, SINEs as a class were 1.7-fold enriched on ChrX in flanking regions, with enrichment occurring in >80% of flanking regions. This enrichment correlated with progression through XCI from d0 to d7. Moderate EZH2 sites similarly showed under-representation of LINE Is and LTRs, and modest over-representation of SINEs, low-complexity, and simple repeats (FIG. 4A,D; Tables II, III).

We performed similar analyses with known transcription factor consensus motifs. Several motifs were over-represented in EZH2 sites, but none were significantly enriched over a random model that took into account CpG content and proximity to gene promoters. De novo motif discovery using MEME (Bailey et al., 2006) retrieved only simple and low-complexity motifs, consistent with our repeat analysis. Taken together, while these data do not exclude a role for LINEs in other aspects of XCI (Chow et al., 2010; Namekawa et al., 2010), they do not support a direct role of LINEs in spreading EZH2. Positive association is instead seen for SINEs, low-complexity, and simple repeats.

TABLE II

Enriched and depleted repeat classes at EZH2 sites
Repeat classes significantly enriched or depleted at strong, strong-flanking (+/−3 kb) and moderate sites on d0, d7 and MEF are listed with odds ratios (inverted negative for depleted classes) and percentage of EZH2 sites containing (in case of enriched) or lacking (in case of depleted) a given repeat class. Only significantly enriched or depleted (Z ≥ 2.5) classes are listed with percentage, all others (Z < 2.5) are set to 0.0%.

|  | d0 odds ratio | % d0 sites | d7 odds ratio | % of d7 sites | MEF odds ratio | % of MEF sites |
|---|---|---|---|---|---|---|
| chr13-strong | | | | | | |
| Non-repeat | 1.8 | 0.0 | 3.4 | 17.3 | 1.8 | 0.0 |
| DNA transposon | −5.0 | 94.9 | −5.3 | 95.1 | −3.1 | 0.0 |
| LINE | −17.4 | 92.4 | −17.5 | 90.1 | −14.2 | 90.4 |
| LTR | −28.3 | 94.9 | −16.6 | 90.1 | −15.1 | 91.6 |
| Low_complexity | 2.6 | 60.8 | 2.1 | 51.9 | 2.1 | 56.6 |
| Others | −2.2 | 0.0 | −8.9 | 0.0 | −1.6 | 0.0 |
| SINE | −5.1 | 75.9 | −3.9 | 74.1 | −2.3 | 62.7 |
| Simple_repeat | 1.2 | 0.0 | 1.2 | 0.0 | 1.1 | 0.0 |
| chrX-strong | | | | | | |
| Non-repeat | 5.5 | 23.2 | 2.7 | 12.9 | 3.1 | 14.0 |
| DNA transposon | −4.4 | 0.0 | −1.8 | 3.0 | −68.6 | 0.0 |
| LINE | −15.9 | 92.9 | −5.5 | 78.9 | −16.4 | 90.0 |
| LTR | −13.8 | 94.6 | −8.2 | 91.2 | −38.3 | 98.0 |
| Low_complexity | 1.7 | 46.4 | 1.7 | 39.5 | 2.1 | 52.0 |
| Others | −45.4 | 0.0 | −2.8 | 3.0 | −34.6 | 0.0 |
| SINE | −4.1 | 78.6 | −1.7 | 58.5 | −4.0 | 82.0 |
| Simple_repeat | 1.4 | 0.0 | 1.6 | 64.6 | 1.6 | 58.0 |

|  | d0 odds ratio | d7 odds ratio | MEF odds ratio |
|---|---|---|---|
| chr13-flanking | | | |
| Non-repeat | −2.0 | 1.3 | −1.6 |
| DNA transposon | −1.5 | −1.5 | 1.1 |
| LINE | −3.5 | −2.4 | −2.4 |
| LTR | −3.4 | −2.0 | −2.2 |
| Low_complexity | 1.5 | 1.6 | 1.2 |

TABLE II-continued

Enriched and depleted repeat classes at EZH2 sites
Repeat classes significantly enriched or depleted at strong, strong-flanking (+/−3 kb) and moderate sites on d0, d7 and MEF are listed with odds ratios (inverted negative for depleted classes) and percentage of EZH2 sites containing (in case of enriched) or lacking (in case of depleted) a given repeat class. Only significantly enriched or depleted (Z ≥ 2.5) classes are listed with percentage, all others (Z < 2.5) are set to 0.0%.

| | | | |
|---|---|---|---|
| Others | −1.0 | −2.8 | 1.2 |
| SINE | −1.1 | 1.2 | 1.2 |
| Simple_repeat | 1.4 | 1.4 | 1.4 |
| chrX-flanking | | | |
| Non-repeat | −1.0 | −1.8 | 1.8 |
| DNA transposon | −1.0 | 1.4 | −1.2 |
| LINE | −3.9 | −2.1 | −3.9 |
| LTR | −3.4 | −2.2 | −2.9 |
| Low_complexity | 1.4 | 1.3 | 1.4 |
| Others | −1.5 | −1.1 | −1.4 |
| SINE | 1.2 | 1.7 | 1.3 |
| Simple_repeat | 1.6 | 1.5 | 1.5 |
| chr13-moderate | | | |
| Non-repeat | −1.2 | −1.1 | −1.1 |
| DNA transposon | −1.1 | −1.3 | 1.1 |
| LINE | −1.2 | −1.6 | −1.6 |
| LTR | −1.4 | −1.5 | −1.6 |
| Low_complexity | 1.4 | 1.4 | 1.6 |
| Others | −1.2 | −1.4 | −1.3 |
| SINE | −1.1 | −1.0 | −1.1 |
| Simple_repeat | 1.1 | 1.2 | 1.3 |
| chrX-moderate | | | |
| Non-repeat | −1.4 | −1.3 | −1.2 |
| DNA transposon | −1.1 | 1.3 | 1.2 |
| LINE | −1.1 | −1.2 | −1.1 |
| LTR | −1.2 | −1.2 | −1.3 |
| Low_complexity | 1.4 | 1.2 | 1.5 |
| Others | −1.5 | −1.3 | −1.3 |
| SINE | −1.0 | 1.4 | 1.1 |
| Simple_repeat | 1.2 | 1.3 | 1.2 |

TABLE III

Enriched and depleted repeat types at EZH2 sites
Repeat types significantly enriched or depleted at strong, strong-flanking (+/−3 kb) and moderate sites on d0, d7 and MEF are listed with odds ratios (inverted negative for depleted classes) and percentage of EZH2 sites containing (in case of enriched) or lacking (in case of depleted) a given repeat class. Only significantly enriched or depleted (Z ≥ 2.5) classes are listed with percentage, all others (Z < 2.5) are set to 0.0%.

| | Type | d0 odds ratio | % d0 sites | d7 odds ratio | % of d7 sites | MEF odds ratio | % of MEF sites |
|---|---|---|---|---|---|---|---|
| chr13-strong | | | | | | | |
| non-Repeat | . | 1.8 | 0.0 | 3.4 | 17.3 | 1.8 | 0.0 |
| L1Md_F2 | LINE | −90.1 | 100.0 | −109.7 | 100.0 | −82.2 | 0.0 |
| Lx8 | LINE | −83.2 | 0.0 | −10.3 | 0.0 | −6.6 | 0.0 |
| C-rich | Low_complexity | 12.3 | 12.7 | 10.4 | 13.6 | 8.2 | 6.0 |
| GA-rich | Low_complexity | 2.8 | 16.5 | 2.6 | 17.3 | 1.9 | 0.0 |
| GC-rich | Low_complexity | 36.3 | 29.1 | 27.9 | 28.4 | 42.8 | 33.7 |
| G-rich | Low_complexity | 8.9 | 8.9 | 10.9 | 11.1 | 3.1 | 0.0 |
| T-rich | Low_complexity | 3.7 | 7.6 | 2.5 | 0.0 | 1.1 | 0.0 |
| B3 | SINE | −12.8 | 98.7 | −9.5 | 97.5 | −6.0 | 97.6 |
| B4A | SINE | −126.1 | 100.0 | −165.0 | 100.0 | −10.9 | 98.8 |
| RSINE1 | SINE | −122.5 | 100.0 | −5.4 | 97.5 | −112.8 | 100.0 |
| (A)n | Simple_repeat | 2.7 | 10.1 | 1.8 | 0.0 | 2.2 | 0.0 |
| (CCG)n | Simple_repeat | 18.6 | 5.1 | 25.5 | 6.2 | 22.8 | 4.8 |
| (CGG)n | Simple_repeat | 18.2 | 3.8 | 13.5 | 3.7 | 16.2 | 2.4 |
| (CGGGG)n | Simple_repeat | 7.3 | 1.3 | 6.9 | 1.2 | 8.5 | 1.2 |
| (GA)n | Simple_repeat | 2.0 | 13.9 | 1.8 | 12.3 | 1.3 | 0.0 |
| (TA)n | Simple_repeat | −2.5 | 0.0 | −2.4 | 0.0 | −3.5 | 0.0 |
| (TC)n | Simple_repeat | 1.6 | 0.0 | 1.1 | 0.0 | −1.5 | 0.0 |
| (TG)n | Simple_repeat | −1.3 | 0.0 | −1.1 | 0.0 | 1.1 | 0.0 |
| chrX-strong | | | | | | | |
| non-Repeat | . | 5.5 | 23.2 | 2.7 | 12.9 | 3.1 | 14.0 |
| L1Md_F2 | LINE | −113.1 | 100.0 | −7.0 | 98.0 | −8.2 | 0.0 |
| Lx8 | LINE | −63.1 | 0.0 | −7.4 | 99.3 | −4.3 | 0.0 |
| C-rich | Low_complexity | 23.2 | 8.9 | 23.1 | 7.5 | 22.2 | 10.0 |
| GA-rich | Low_complexity | 2.7 | 0.0 | 2.3 | 5.4 | 2.8 | 0.0 |
| GC-rich | Low_complexity | 43.5 | 23.2 | 53.9 | 17.0 | 46.8 | 22.0 |
| G-rich | Low_complexity | 5.8 | 1.8 | 5.7 | 1.4 | 7.3 | 2.0 |
| T-rich | Low_complexity | −1.2 | 0.0 | −1.4 | 0.0 | 1.2 | 0.0 |
| B3 | SINE | −3.7 | 0.0 | −2.0 | 0.0 | −1.9 | 0.0 |
| B4A | SINE | −43.0 | 0.0 | −9.7 | 99.3 | −2.9 | 0.0 |
| RSINE1 | SINE | −5.2 | 0.0 | −2.8 | 0.0 | −3.8 | 0.0 |
| (A)n | Simple_repeat | 2.9 | 0.0 | 1.4 | 0.0 | 3.0 | 0.0 |
| (CCG)n | Simple_repeat | 17.5 | 3.6 | 57.6 | 6.8 | 54.6 | 14.0 |
| (CGG)n | Simple_repeat | 25.8 | 3.6 | 72.1 | 5.4 | 73.6 | 12.0 |
| (CGGGG)n | Simple_repeat | 9.2 | 1.8 | 40.7 | 3.4 | 10.0 | 2.0 |
| (GA)n | Simple_repeat | 2.6 | 10.7 | 2.3 | 8.8 | 1.5 | 0.0 |
| (TA)n | Simple_repeat | −4.6 | 0.0 | −11.4 | 99.3 | −36.1 | 0.0 |

TABLE III-continued

Enriched and depleted repeat types at EZH2 sites
Repeat types significantly enriched or depleted at strong, strong-flanking (+/−3 kb) and moderate sites on d0, d7 and MEF are listed with odds ratios (inverted negative for depleted classes) and percentage of EZH2 sites containing (in case of enriched) or lacking (in case of depleted) a given repeat class. Only significantly enriched or depleted (Z ≥ 2.5) classes are listed with percentage, all others (Z < 2.5) are set to 0.0%.

| | Type | d0 odds ratio | % d0 sites | d7 odds ratio | % of d7 sites | MEF odds ratio | % of MEF sites |
|---|---|---|---|---|---|---|---|
| (TC)n | Simple_repeat | 1.7 | 0.0 | 2.4 | 10.9 | −2.0 | 0.0 |
| (TG)n | Simple_repeat | 1.2 | 0.0 | 1.7 | 15.0 | 1.1 | 0.0 |
| chr13-flanking | | | | | | | |
| L1_Mm | LINE | −36.1 | 0.0 | −3.3 | 0.0 | −3.4 | 0.0 |
| L1_Mus1 | LINE | −2.8 | 0.0 | −1.5 | 0.0 | −5.6 | 0.0 |
| L1MB5 | LINE | 4.6 | 0.0 | 5.7 | 1.2 | 5.7 | 2.4 |
| L1Md_A | LINE | −1.9 | 0.0 | −40.4 | 0.0 | −3.7 | 0.0 |
| L1Md_F2 | LINE | −140.2 | 100.0 | −6.9 | 98.8 | −13.5 | 98.8 |
| L1Md_T | LINE | −5.9 | 0.0 | −66.7 | 100.0 | −3.3 | 0.0 |
| L1MEf | LINE | −9.5 | 0.0 | −9.8 | 0.0 | −9.9 | 0.0 |
| C-rich | Low_complexity | 4.0 | 6.3 | 3.1 | 4.9 | 1.5 | 0.0 |
| CT-rich | Low_complexity | 1.6 | 0.0 | 1.7 | 0.0 | 1.3 | 0.0 |
| GA-rich | Low_complexity | −1.1 | 0.0 | −1.0 | 0.0 | 1.1 | 0.0 |
| GC-rich | Low_complexity | 9.7 | 12.7 | 6.0 | 8.6 | −1.1 | 0.0 |
| B1_Mur1 | SINE | 1.5 | 0.0 | 2.3 | 12.3 | 1.0 | 0.0 |
| B1_Mur3 | SINE | 1.4 | 0.0 | 2.7 | 9.9 | 1.3 | 0.0 |
| B1F | SINE | −2.0 | 0.0 | −1.0 | 0.0 | 1.1 | 0.0 |
| B1F1 | SINE | −3.2 | 0.0 | −3.2 | 0.0 | 1.1 | 0.0 |
| B2_Mm1a | SINE | 1.1 | 0.0 | 1.4 | 0.0 | 2.8 | 8.4 |
| ID_B1 | SINE | 1.7 | 0.0 | 1.6 | 0.0 | 1.3 | 0.0 |
| ID4 | SINE | 1.8 | 0.0 | −1.1 | 0.0 | 1.7 | 0.0 |
| MIR | SINE | 1.7 | 0.0 | 2.5 | 16.0 | 2.5 | 14.5 |
| MIRb | SINE | 2.0 | 13.9 | 2.7 | 16.0 | 2.1 | 14.5 |
| MIRc | SINE | 4.0 | 12.7 | 1.8 | 0.0 | 4.2 | 14.5 |
| PB1 | SINE | 1.7 | 0.0 | 1.2 | 0.0 | −1.2 | 0.0 |
| PB1D10 | SINE | 1.2 | 0.0 | 1.6 | 0.0 | 1.1 | 0.0 |
| RSINE1 | SINE | −1.7 | 0.0 | −1.7 | 0.0 | 1.0 | 0.0 |
| (CA)n | Simple_repeat | 1.7 | 41.8 | 1.4 | 0.0 | 1.6 | 47.0 |
| (CAGAGA)n | Simple_repeat | 1.8 | 0.0 | 1.7 | 0.0 | 3.3 | 4.8 |
| (CCA)n | Simple_repeat | 2.5 | 0.0 | 3.7 | 3.7 | 6.1 | 6.0 |
| (CCG)n | Simple_repeat | 12.4 | 1.3 | 4.4 | 0.0 | −2.5 | 0.0 |
| (GGA)n | Simple_repeat | 3.2 | 5.1 | 1.6 | 0.0 | 2.3 | 0.0 |
| (T)n | Simple_repeat | 2.7 | 15.2 | 1.9 | 0.0 | 2.4 | 14.5 |
| (TCTG)n | Simple_repeat | 2.3 | 0.0 | 2.8 | 6.2 | 3.3 | 6.0 |
| (TG)n | Simple_repeat | 1.3 | 0.0 | 1.5 | 42.0 | 1.2 | 0.0 |
| (TTTTG)n | Simple_repeat | 1.6 | 0.0 | 2.2 | 0.0 | 1.6 | 0.0 |
| chrX-flanking | | | | | | | |
| L1_Mm | LINE | −48.1 | 0.0 | −129.4 | 100.0 | −41.9 | 0.0 |
| L1_Mus1 | LINE | −2.3 | 0.0 | −4.0 | 96.6 | −2.7 | 0.0 |
| L1MB5 | LINE | 1.5 | 0.0 | 5.7 | 2.7 | 1.6 | 0.0 |
| L1Md_A | LINE | −61.2 | 0.0 | −161.6 | 100.0 | −54.5 | 0.0 |
| L1Md_F2 | LINE | −3.8 | 92.9 | −3.7 | 91.2 | −2.3 | 0.0 |
| L1Md_T | LINE | −7.8 | 0.0 | −7.1 | 98.0 | −3.7 | 0.0 |
| L1MEf | LINE | 3.6 | 0.0 | 4.5 | 1.4 | −4.9 | 0.0 |
| C-rich | Low_complexity | 5.1 | 3.6 | 11.8 | 6.1 | 13.8 | 8.0 |
| CT-rich | Low_complexity | 2.0 | 0.0 | 1.9 | 10.9 | 2.3 | 0.0 |
| GA-rich | Low_complexity | 1.3 | 0.0 | 2.5 | 10.9 | 2.2 | 0.0 |
| GC-rich | Low_complexity | 23.5 | 12.5 | 7.7 | 5.4 | 9.1 | 6.0 |
| B1_Mur1 | SINE | 1.3 | 0.0 | 2.1 | 11.6 | 1.7 | 0.0 |
| B1_Mur3 | SINE | −23.7 | 0.0 | 2.3 | 7.5 | 1.5 | 0.0 |
| B1F | SINE | −1.1 | 0.0 | 2.1 | 18.4 | 2.0 | 0.0 |
| B1F1 | SINE | 1.5 | 0.0 | 2.3 | 8.8 | 1.3 | 0.0 |
| B2_Mm1a | SINE | −1.2 | 0.0 | 1.8 | 0.0 | 2.7 | 0.0 |
| ID_B1 | SINE | −1.0 | 0.0 | 2.0 | 25.9 | 2.1 | 24.0 |
| ID4 | SINE | −1.5 | 0.0 | 2.3 | 12.2 | 2.5 | 12.0 |
| MIR | SINE | 1.8 | 0.0 | 2.0 | 16.3 | 2.3 | 20.0 |
| MIRb | SINE | 2.2 | 17.9 | 2.5 | 21.1 | 1.7 | 0.0 |
| MIRc | SINE | 3.1 | 10.7 | 3.1 | 10.9 | 2.1 | 0.0 |
| PB1 | SINE | 2.7 | 0.0 | 3.0 | 8.8 | 3.5 | 10.0 |
| PB1D10 | SINE | 2.1 | 19.6 | 2.0 | 21.1 | 1.2 | 0.0 |
| RSINE1 | SINE | 1.7 | 0.0 | 1.7 | 24.5 | 1.1 | 0.0 |
| (CA)n | Simple_repeat | 1.3 | 0.0 | 1.1 | 0.0 | 1.0 | 0.0 |
| (CAGAGA)n | Simple_repeat | −10.4 | 0.0 | 8.9 | 2.7 | −9.6 | 0.0 |
| (CCA)n | Simple_repeat | 3.6 | 0.0 | 4.7 | 4.1 | −5.5 | 0.0 |
| (CCG)n | Simple_repeat | 29.0 | 8.9 | 6.0 | 1.4 | 11.7 | 2.0 |
| (GGA)n | Simple_repeat | 3.4 | 0.0 | 5.1 | 4.1 | 2.0 | 0.0 |
| (T)n | Simple_repeat | 2.1 | 0.0 | 1.2 | 0.0 | 2.4 | 0.0 |
| (TCTG)n | Simple_repeat | −6.1 | 0.0 | 2.4 | 0.0 | 1.9 | 0.0 |
| (TG)n | Simple_repeat | 2.5 | 51.8 | 1.6 | 34.0 | 2.3 | 44.0 |
| (TTTTG)n | Simple_repeat | −2.2 | 0.0 | 2.2 | 8.2 | 3.2 | 12.0 |

TABLE III-continued

Enriched and depleted repeat types at EZH2 sites
Repeat types significantly enriched or depleted at strong, strong-flanking (+/−3 kb) and moderate sites
on d0, d7 and MEF are listed with odds ratios (inverted negative for depleted classes) and percentage of EZH2
sites containing (in case of enriched) or lacking (in case of depleted) a given repeat class. Only significantly
enriched or depleted (Z ≥ 2.5) classes are listed with percentage, all others (Z < 2.5) are set to 0.0%.

| | Type | d0 odds ratio | % d0 sites | d7 odds ratio | % of d7 sites | MEF odds ratio | % of MEF sites |
|---|---|---|---|---|---|---|---|
| chr13-moderate | | | | | | | |
| non-Repeat | . | −1.2 | 0.0 | −1.1 | 0.0 | −1.1 | 0.0 |
| MER5B | DNA | 1.5 | 0.0 | 1.1 | 0.0 | 1.0 | 0.0 |
| Tigger5 | DNA | 1.1 | 0.0 | 1.5 | 0.0 | −36.4 | 0.0 |
| HAL1-3A_ME | LINE | −2.4 | 0.0 | −1.2 | 0.0 | −1.3 | 0.0 |
| L1_Mm | LINE | 1.1 | 0.0 | −2.2 | 0.0 | −3.6 | 0.0 |
| L1_Mur1 | LINE | −1.6 | 0.0 | −2.4 | 0.0 | −3.3 | 0.0 |
| L1_Mur2 | LINE | −2.3 | 0.0 | −1.7 | 0.0 | −1.3 | 0.0 |
| L1_Mur3 | LINE | −1.0 | 0.0 | −1.6 | 0.0 | −1.9 | 0.0 |
| L1_Mus3 | LINE | −1.8 | 0.0 | −2.1 | 98.9 | −1.1 | 0.0 |
| L1MC1 | LINE | 1.1 | 0.0 | −1.4 | 0.0 | 1.5 | 0.0 |
| L1Md_A | LINE | −1.8 | 0.0 | −6.9 | 99.7 | −6.8 | 99.7 |
| L1Md_F | LINE | −1.3 | 0.0 | −1.6 | 0.0 | −45.5 | 0.0 |
| L1Md_F2 | LINE | 1.1 | 0.0 | −2.1 | 97.0 | −2.6 | 97.8 |
| L1Md_T | LINE | −1.4 | 0.0 | −4.8 | 99.3 | −4.6 | 99.3 |
| L1MD1 | LINE | −2.6 | 0.0 | 1.2 | 0.0 | −17.0 | 0.0 |
| L1ME4a | LINE | 3.5 | 0.3 | 2.3 | 0.0 | 1.1 | 0.0 |
| L1VL1 | LINE | 1.1 | 0.0 | −28.2 | 0.0 | 1.1 | 0.0 |
| L1VL2 | LINE | 1.4 | 0.0 | −1.2 | 0.0 | −2.9 | 0.0 |
| L1VL4 | LINE | −2.5 | 0.0 | −1.7 | 0.0 | −2.3 | 0.0 |
| L2a | LINE | 1.1 | 0.0 | −1.2 | 0.0 | −1.8 | 0.0 |
| L2b | LINE | 1.3 | 0.0 | 1.4 | 0.0 | 1.1 | 0.0 |
| AT_rich | Low_complexity | 1.0 | 0.0 | 1.0 | 0.0 | 1.1 | 0.0 |
| C-rich | Low_complexity | 3.6 | 1.6 | 4.2 | 1.8 | 3.2 | 1.3 |
| CT-rich | Low_complexity | 1.2 | 0.0 | 1.4 | 0.0 | 1.2 | 0.0 |
| G-rich | Low_complexity | 2.6 | 1.1 | 2.8 | 1.2 | 2.1 | 0.0 |
| GA-rich | Low_complexity | 1.3 | 0.0 | 1.1 | 0.0 | 1.9 | 5.7 |
| GC-rich | Low_complexity | 9.9 | 3.9 | 12.9 | 4.6 | 17.4 | 5.9 |
| polypyrimidine | Low_complexity | 1.6 | 0.0 | 1.4 | 0.0 | 1.7 | 0.0 |
| T-rich | Low_complexity | 1.5 | 0.0 | 1.4 | 0.0 | 2.3 | 2.2 |
| ETnERV2-int | LTR | −7.1 | 0.0 | −1.6 | 0.0 | −42.3 | 0.0 |
| ETnERV3-int | LTR | −16.5 | 0.0 | −14.4 | 0.0 | −9.2 | 0.0 |
| IAPEz-int | LTR | −1.7 | 0.0 | −6.1 | 0.0 | −8.0 | 0.0 |
| MER89 | LTR | 1.6 | 0.0 | −12.2 | 0.0 | −8.4 | 0.0 |
| MMETn-int | LTR | −41.0 | 0.0 | −3.6 | 0.0 | −24.9 | 0.0 |
| MTB_Mm-int | LTR | −1.0 | 0.0 | −9.3 | 0.0 | −6.4 | 0.0 |
| RLTR16 | LTR | 1.2 | 0.0 | −31.1 | 0.0 | 1.7 | 0.0 |
| RLTR26 | LTR | −1.0 | 0.0 | 1.9 | 0.0 | −1.0 | 0.0 |
| RMER21B | LTR | 1.3 | 0.0 | −1.2 | 0.0 | 1.5 | 0.0 |
| RMER1C | Other | −1.1 | 0.0 | −1.8 | 0.0 | −2.2 | 0.0 |
| 5S | rRNA | 2.1 | 0.0 | −9.1 | 0.0 | −5.8 | 0.0 |
| (A)n | Simple_repeat | 1.5 | 0.0 | 1.9 | 4.1 | 1.6 | 0.0 |
| (ATG)n | Simple_repeat | −2.1 | 0.0 | 1.6 | 0.0 | −13.6 | 0.0 |
| (CA)n | Simple_repeat | 1.1 | 0.0 | 1.2 | 0.0 | 1.2 | 0.0 |
| (CACCC)n | Simple_repeat | 1.8 | 0.0 | 1.1 | 0.0 | 1.4 | 0.0 |
| (CAG)n | Simple_repeat | 1.6 | 0.0 | 2.2 | 0.0 | −1.1 | 0.0 |
| (CAT)n | Simple_repeat | −1.5 | 0.0 | 1.2 | 0.0 | −1.6 | 0.0 |
| (CCA)n | Simple_repeat | 1.3 | 0.0 | 2.0 | 0.0 | 2.5 | 0.0 |
| (CCAA)n | Simple_repeat | −1.3 | 0.0 | 1.0 | 0.0 | 1.4 | 0.0 |
| (CCCCCA)n | Simple_repeat | 3.1 | 0.6 | 1.6 | 0.0 | 3.3 | 0.0 |
| (CCCCCT)n | Simple_repeat | 2.8 | 0.0 | 3.4 | 0.3 | 3.6 | 0.0 |
| (CCCCG)n | Simple_repeat | 11.0 | 0.7 | 8.5 | 0.6 | 12.4 | 0.8 |
| (CCG)n | Simple_repeat | 12.1 | 0.9 | 13.7 | 1.0 | 22.4 | 1.2 |
| (CG)n | Simple_repeat | 5.9 | 0.3 | 6.0 | 0.4 | 5.4 | 0.3 |
| (CGG)n | Simple_repeat | 5.1 | 0.3 | 8.0 | 0.5 | 10.8 | 0.5 |
| (CGGGG)n | Simple_repeat | 9.5 | 0.3 | 11.4 | 0.4 | 7.5 | 0.3 |
| (CGTG)n | Simple_repeat | −1.0 | 0.0 | 2.3 | 0.0 | 1.6 | 0.0 |
| (CTG)n | Simple_repeat | 1.7 | 0.0 | 3.3 | 0.5 | 4.1 | 0.5 |
| (GA)n | Simple_repeat | 1.4 | 5.2 | 1.3 | 0.0 | 1.6 | 5.9 |
| (GAGAA)n | Simple_repeat | 4.0 | 0.6 | 2.2 | 0.0 | 2.1 | 0.0 |
| (GGA)n | Simple_repeat | 1.8 | 0.0 | 1.4 | 0.0 | −1.2 | 0.0 |
| (T)n | Simple_repeat | 1.8 | 3.6 | 1.9 | 3.7 | 1.7 | 3.2 |
| (TA)n | Simple_repeat | −1.3 | 0.0 | −1.4 | 0.0 | 1.0 | 0.0 |
| (TC)n | Simple_repeat | 1.2 | 0.0 | 1.1 | 0.0 | 1.3 | 0.0 |
| (TCC)n | Simple_repeat | 1.2 | 0.0 | 1.2 | 0.0 | −1.2 | 0.0 |
| (TCCCC)n | Simple_repeat | 1.3 | 0.0 | 2.3 | 0.0 | 2.3 | 0.0 |
| (TG)n | Simple_repeat | 1.0 | 0.0 | 1.1 | 0.0 | 1.2 | 0.0 |
| (TGG)n | Simple_repeat | 3.0 | 1.0 | 2.8 | 1.0 | 1.8 | 0.0 |
| (TGGGGG)n | Simple_repeat | 2.4 | 0.0 | 2.1 | 0.0 | 1.6 | 0.0 |
| (TTTA)n | Simple_repeat | 1.4 | 0.0 | 1.4 | 0.0 | −1.1 | 0.0 |
| (TTTTC)n | Simple_repeat | 1.1 | 0.0 | 1.2 | 0.0 | −1.8 | 0.0 |

TABLE III-continued

Enriched and depleted repeat types at EZH2 sites
Repeat types significantly enriched or depleted at strong, strong-flanking (+/−3 kb) and moderate sites
on d0, d7 and MEF are listed with odds ratios (inverted negative for depleted classes) and percentage of EZH2
sites containing (in case of enriched) or lacking (in case of depleted) a given repeat class. Only significantly
enriched or depleted (Z ≥ 2.5) classes are listed with percentage, all others (Z < 2.5) are set to 0.0%.

| | Type | d0 odds ratio | % d0 sites | d7 odds ratio | % of d7 sites | MEF odds ratio | % of MEF sites |
|---|---|---|---|---|---|---|---|
| B1_Mm | SINE | −1.2 | 0.0 | 1.3 | 0.0 | −1.2 | 0.0 |
| B1_Mur3 | SINE | 1.1 | 0.0 | 1.1 | 0.0 | −1.3 | 0.0 |
| B1_Mur4 | SINE | −1.1 | 0.0 | 1.1 | 0.0 | −1.0 | 0.0 |
| B1_Mus1 | SINE | 1.1 | 0.0 | −1.1 | 0.0 | −1.4 | 0.0 |
| B1_Mus2 | SINE | 1.1 | 0.0 | −1.1 | 0.0 | −1.2 | 0.0 |
| B1F | SINE | −1.2 | 0.0 | 1.1 | 0.0 | 1.0 | 0.0 |
| B1F1 | SINE | −1.7 | 0.0 | −1.1 | 0.0 | −1.7 | 0.0 |
| B2_Mm2 | SINE | −1.1 | 0.0 | −1.3 | 0.0 | −1.1 | 0.0 |
| B3 | SINE | −1.4 | 93.2 | −1.0 | 0.0 | −1.1 | 0.0 |
| B3A | SINE | −1.1 | 0.0 | −1.0 | 0.0 | −1.2 | 0.0 |
| B4A | SINE | −1.2 | 0.0 | −1.3 | 0.0 | −1.0 | 0.0 |
| ID | SINE | −1.3 | 0.0 | −1.1 | 0.0 | −1.2 | 0.0 |
| ID_B1 | SINE | −1.1 | 0.0 | 1.3 | 0.0 | 1.0 | 0.0 |
| ID4 | SINE | 1.7 | 2.8 | 1.0 | 0.0 | −1.1 | 0.0 |
| ID4_b | SINE | −1.3 | 0.0 | −1.2 | 0.0 | −1.6 | 0.0 |
| MamSINE1 | SINE | −3.9 | 0.0 | −4.0 | 0.0 | 3.8 | 0.0 |
| MIR | SINE | 1.3 | 0.0 | −1.1 | 0.0 | 1.2 | 0.0 |
| MIR3 | SINE | −1.1 | 0.0 | 1.5 | 0.0 | −1.7 | 0.0 |
| MIRb | SINE | 1.0 | 0.0 | −1.2 | 0.0 | −1.4 | 0.0 |
| MIRc | SINE | 1.1 | 0.0 | 1.2 | 0.0 | 1.4 | 0.0 |
| MIRm | SINE | 1.3 | 0.0 | 2.2 | 1.1 | 2.5 | 0.0 |
| PB1 | SINE | 1.0 | 0.0 | 1.3 | 0.0 | −1.8 | 0.0 |
| PB1D10 | SINE | −1.2 | 0.0 | −1.0 | 0.0 | −1.1 | 0.0 |
| PB1D7 | SINE | −1.2 | 0.0 | 1.2 | 0.0 | 1.2 | 0.0 |
| PB1D9 | SINE | −1.1 | 0.0 | −1.3 | 0.0 | −1.4 | 0.0 |
| RSINE1 | SINE | −1.2 | 0.0 | −1.2 | 0.0 | −1.4 | 0.0 |
| tRNA-Ala-GCA | tRNA | 1.2 | 0.0 | −7.6 | 0.0 | −5.8 | 0.0 |
| tRNA-Ala-GCY | tRNA | −2.1 | 0.0 | 2.0 | 0.0 | −1.2 | 0.0 |
| chrX-moderate | | | | | | | |
| non-Repeat | . | −1.4 | 96.4 | −1.3 | 95.8 | −1.2 | 0.0 |
| MER5B | DNA | −1.1 | 0.0 | 1.9 | 0.9 | 1.3 | 0.0 |
| Tigger5 | DNA | −1.3 | 0.0 | −1.1 | 0.0 | 3.0 | 0.4 |
| HAL1-3A_ME | LINE | 1.5 | 0.0 | 1.2 | 0.0 | 3.1 | 0.7 |
| L1_Mm | LINE | −1.4 | 0.0 | −2.0 | 98.7 | −1.9 | 98.7 |
| L1_Mur1 | LINE | −1.1 | 0.0 | −2.8 | 99.6 | −1.4 | 0.0 |
| L1_Mur2 | LINE | −1.1 | 0.0 | −2.0 | 98.8 | −1.3 | 0.0 |
| L1_Mur3 | LINE | −1.1 | 0.0 | −1.6 | 98.1 | 1.1 | 0.0 |
| L1_Mus3 | LINE | −1.4 | 0.0 | −1.9 | 97.8 | −1.9 | 97.9 |
| L1MC1 | LINE | −1.5 | 0.0 | 1.1 | 0.0 | 3.3 | 0.6 |
| L1Md_A | LINE | −1.5 | 0.0 | −2.8 | 98.6 | −3.1 | 99.0 |
| L1Md_F | LINE | −1.4 | 0.0 | −2.0 | 99.2 | −1.1 | 0.0 |
| L1Md_F2 | LINE | 1.1 | 0.0 | −1.5 | 91.7 | −1.7 | 93.1 |
| L1Md_T | LINE | −1.1 | 0.0 | −3.4 | 98.5 | −2.6 | 98.2 |
| L1MD1 | LINE | 3.6 | 0.3 | −1.5 | 0.0 | 1.5 | 0.0 |
| L1ME4a | LINE | 1.0 | 0.0 | 2.1 | 0.3 | −1.8 | 0.0 |
| L1VL1 | LINE | −3.6 | 0.0 | −2.6 | 99.8 | −1.0 | 0.0 |
| L1VL2 | LINE | −1.9 | 0.0 | −2.1 | 99.6 | −2.3 | 0.0 |
| L1VL4 | LINE | −1.1 | 0.0 | −1.8 | 99.3 | −1.9 | 0.0 |
| L2a | LINE | −1.4 | 0.0 | 1.5 | 2.8 | 1.4 | 0.0 |
| L2b | LINE | −1.4 | 0.0 | 1.7 | 1.2 | 1.3 | 0.0 |
| AT-rich | Low_complexity | 1.1 | 0.0 | −1.2 | 87.0 | 1.3 | 15.3 |
| C-rich | Low_complexity | 7.8 | 1.4 | 4.0 | 0.7 | 4.8 | 0.8 |
| CT-rich | Low_complexity | 1.5 | 3.2 | 1.7 | 3.3 | 1.1 | 0.0 |
| G-rich | Low_complexity | 10.4 | 1.2 | 4.2 | 0.6 | 4.0 | 0.4 |
| GA-rich | Low_complexity | 1.8 | 3.5 | 1.8 | 3.5 | 1.6 | 1.8 |
| GC-rich | Low_complexity | 13.9 | 2.1 | 9.9 | 1.7 | 17.5 | 2.1 |
| polypyrimidine | Low_complexity | 3.3 | 0.3 | 1.3 | 0.0 | 2.9 | 0.0 |
| T-rich | Low_complexity | 1.4 | 0.0 | 1.1 | 0.0 | 1.6 | 0.0 |
| ETnERV2-int | LTR | −5.0 | 99.8 | −3.1 | 99.7 | −4.2 | 0.0 |
| ETnERV3-int | LTR | −2.3 | 0.0 | −174.2 | 100.0 | −46.8 | 0.0 |
| IAPEz-int | LTR | −3.1 | 0.0 | −7.6 | 99.9 | −132.8 | 100.0 |
| MER89 | LTR | 1.9 | 0.0 | 5.1 | 0.1 | −4.3 | 0.0 |
| MMETn-int | LTR | −2.4 | 0.0 | −17.6 | 100.0 | −1.7 | 0.0 |
| MTB_Mm-int | LTR | −4.4 | 0.0 | 6.9 | 0.1 | −3.4 | 0.0 |
| RLTR16 | LTR | 4.5 | 0.2 | 1.3 | 0.0 | 1.1 | 0.0 |
| RLTR26 | LTR | −1.7 | 0.0 | 1.1 | 0.0 | 3.3 | 0.7 |
| RMER21B | LTR | 4.1 | 0.2 | 1.9 | 0.0 | 1.3 | 0.0 |
| RMER1C | Other | −1.6 | 0.0 | −3.2 | 99.7 | −2.0 | 0.0 |
| 5S | rRNA | −13.2 | 0.0 | 3.3 | 0.2 | −9.3 | 0.0 |
| (A)n | Simple_repeat | 1.6 | 2.4 | 1.3 | 0.0 | 1.6 | 0.0 |
| (ATG)n | Simple_repeat | 3.0 | 0.4 | −1.1 | 0.0 | −1.5 | 0.0 |

TABLE III-continued

Enriched and depleted repeat types at EZH2 sites
Repeat types significantly enriched or depleted at strong, strong-flanking (+/−3 kb) and moderate sites on d0, d7 and MEF are listed with odds ratios (inverted negative for depleted classes) and percentage of EZH2 sites containing (in case of enriched) or lacking (in case of depleted) a given repeat class. Only significantly enriched or depleted (Z ≥ 2.5) classes are listed with percentage, all others (Z < 2.5) are set to 0.0%.

|  | Type | d0 odds ratio | % d0 sites | d7 odds ratio | % of d7 sites | MEF odds ratio | % of MEF sites |
|---|---|---|---|---|---|---|---|
| (CA)n | Simple_repeat | 1.2 | 0.0 | 1.3 | 9.2 | 1.3 | 0.0 |
| (CACCC)n | Simple_repeat | 3.5 | 0.0 | 3.8 | 0.2 | 4.0 | 0.0 |
| (CAG)n | Simple_repeat | 3.6 | 0.4 | 3.2 | 0.4 | −1.2 | 0.0 |
| (CAT)n | Simple_repeat | 1.4 | 0.0 | 2.4 | 0.3 | −1.2 | 0.0 |
| (CCA)n | Simple_repeat | 1.2 | 0.0 | 1.6 | 0.0 | 2.6 | 0.6 |
| (CCAA)n | Simple_repeat | 1.9 | 0.0 | 2.7 | 0.3 | 1.8 | 0.0 |
| (CCCCCA)n | Simple_repeat | 1.2 | 0.0 | −1.0 | 0.0 | −6.2 | 0.0 |
| (CCCCCT)n | Simple_repeat | 1.8 | 0.0 | 5.1 | 0.2 | 2.7 | 0.0 |
| (CCCCG)n | Simple_repeat | 10.7 | 0.2 | 8.1 | 0.1 | 8.4 | 0.2 |
| (CCG)n | Simple_repeat | 11.4 | 0.6 | 12.0 | 0.6 | 18.5 | 0.8 |
| (CG)n | Simple_repeat | 6.5 | 0.3 | 4.5 | 0.2 | 8.4 | 0.3 |
| (CGG)n | Simple_repeat | 13.3 | 0.5 | 13.3 | 0.5 | 17.8 | 0.6 |
| (CGGGG)n | Simple_repeat | 12.4 | 0.3 | 10.7 | 0.2 | 12.8 | 0.3 |
| (CGTG)n | Simple_repeat | −5.1 | 0.0 | 7.1 | 0.2 | 2.6 | 0.0 |
| (CTG)n | Simple_repeat | 2.2 | 0.0 | 4.6 | 0.4 | 4.0 | 0.4 |
| (GA)n | Simple_repeat | 1.4 | 4.1 | 1.6 | 4.7 | 1.5 | 0.0 |
| (GAGAA)n | Simple_repeat | −1.7 | 0.0 | −1.3 | 0.0 | 2.6 | 0.0 |
| (GGA)n | Simple_repeat | 1.7 | 0.0 | 2.6 | 0.7 | 2.7 | 0.7 |
| (T)n | Simple_repeat | 1.7 | 2.7 | 1.4 | 2.2 | 1.3 | 0.0 |
| (TA)n | Simple_repeat | −1.0 | 0.0 | −1.6 | 96.9 | −1.2 | 0.0 |
| (TC)n | Simple_repeat | 1.5 | 4.5 | 1.6 | 5.1 | 1.3 | 0.0 |
| (TCC)n | Simple_repeat | 1.6 | 0.0 | 2.4 | 0.7 | 3.0 | 0.7 |
| (TCCCC)n | Simple_repeat | 1.4 | 0.0 | 3.7 | 0.1 | 2.2 | 0.0 |
| (TG)n | Simple_repeat | 1.2 | 8.7 | 1.4 | 9.8 | 1.1 | 0.0 |
| (TGG)n | Simple_repeat | 1.7 | 0.0 | 1.6 | 0.0 | −1.2 | 0.0 |
| (TGGGGG)n | Simple_repeat | 2.4 | 0.0 | 3.5 | 0.1 | 1.9 | 0.0 |
| (TTTA)n | Simple_repeat | 2.0 | 1.8 | −1.1 | 0.0 | 1.5 | 0.0 |
| (TTTTC)n | Simple_repeat | −2.2 | 0.0 | 2.2 | 0.6 | 1.3 | 0.0 |
| B1_Mm | SINE | −1.1 | 0.0 | 1.3 | 3.4 | 1.1 | 0.0 |
| B1_Mur3 | SINE | −1.1 | 0.0 | 1.5 | 2.0 | 1.2 | 0.0 |
| B1_Mur4 | SINE | −1.1 | 0.0 | 1.6 | 3.3 | −1.2 | 0.0 |
| B1_Mus1 | SINE | −1.0 | 0.0 | 1.4 | 7.6 | 1.2 | 0.0 |
| B1_Mus2 | SINE | 1.0 | 0.0 | 1.4 | 5.4 | −1.0 | 0.0 |
| B1F | SINE | 1.1 | 0.0 | 1.4 | 4.6 | −1.1 | 0.0 |
| B1F1 | SINE | −1.6 | 0.0 | 1.4 | 2.0 | 1.0 | 0.0 |
| B2_Mm2 | SINE | 1.2 | 0.0 | 1.3 | 5.3 | 1.2 | 0.0 |
| B3 | SINE | −1.0 | 0.0 | 1.3 | 10.1 | 1.2 | 0.0 |
| B3A | SINE | −1.0 | 0.0 | 1.3 | 5.7 | 1.1 | 0.0 |
| B4A | SINE | −1.7 | 97.3 | 1.3 | 5.4 | −1.0 | 0.0 |
| ID | SINE | −1.5 | 0.0 | 1.7 | 0.9 | −1.9 | 0.0 |
| ID_B1 | SINE | −1.0 | 0.0 | 1.4 | 8.1 | −1.1 | 0.0 |
| ID4 | SINE | −1.4 | 0.0 | 1.3 | 2.2 | 1.4 | 0.0 |
| ID4_b | SINE | 1.0 | 0.0 | 1.4 | 2.8 | 1.1 | 0.0 |
| MamSINE1 | SINE | −11.8 | 0.0 | 2.6 | 0.2 | −8.9 | 0.0 |
| MIR | SINE | 1.3 | 0.0 | 1.5 | 4.4 | 1.2 | 0.0 |
| MIR3 | SINE | 1.4 | 0.0 | 2.1 | 1.7 | 1.3 | 0.0 |
| MIRb | SINE | 1.1 | 0.0 | 1.7 | 4.4 | 1.5 | 3.3 |
| MIRc | SINE | 1.4 | 0.0 | 1.8 | 2.5 | 1.3 | 0.0 |
| MIRm | SINE | 1.5 | 0.0 | 1.8 | 0.8 | 1.2 | 0.0 |
| PB1 | SINE | −1.1 | 0.0 | 1.8 | 1.7 | −1.4 | 0.0 |
| PB1D10 | SINE | −1.1 | 0.0 | 1.5 | 5.8 | 1.3 | 0.0 |
| PB1D7 | SINE | 1.1 | 0.0 | 1.6 | 2.1 | 1.3 | 0.0 |
| PB1D9 | SINE | 1.2 | 0.0 | 1.6 | 2.4 | 1.1 | 0.0 |
| RSINE1 | SINE | −1.1 | 0.0 | 1.4 | 8.0 | 1.1 | 0.0 |
| tRNA-Ala-GCA | tRNA | −1.0 | 0.0 | 2.9 | 0.1 | 4.3 | 0.2 |
| tRNA-Ala-GCY | tRNA | −1.5 | 0.0 | 2.1 | 0.4 | 1.6 | 0.0 |

Example 7

A Hierarchy of EZH2 Sites

Figure 5B:
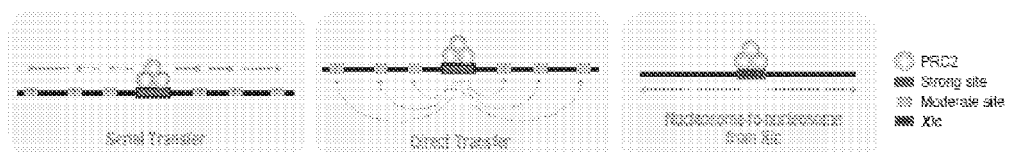

What is the relationship between strong and moderate sites and how does spreading occur between them? Exemplified by the Slc16a2-Rnf12 (Rlim) region (FIG. 5A) and the MamId1 locus (FIG. 14), bivalent domains show high EZH2 coverage on d0. During XCI, new strong sites were acquired (non-bivalent for MamId1 in FIG. 14, two bivalent ones in FIG. 5) and multiple closely-spaced moderate sites appeared near pre-existing strong sites, concurrently with increased density of H3K27me3. With one strong site for every 20-40 moderate sites, we hypothesize that strong sites might serve as recruiting 'hubs' from which EZH2 is passed onto adjacent moderate sites. Three models of spreading are possible (FIG. 5B). EZH2 may be relayed from a strong site to multiple adjacent moderate sites through 'serial transfer'. Alternatively, a strong site could relay EZH2 to moderate sites via 'direct transfer' through long-range 3D interactions. Finally, moderate and strong sites may not be functionally linked and spreading could instead occur nucleosome-by-nucleosome from the Xic.

To gain insight, densities of strong and moderate EZH2 sites and H3K27me3 were calculated over the lengths of Chr13 and ChrX (FIG. 6A) and analyzed positional correlations and significance (Pearson R and Z) between moderate EZH2 sites and strong sites, as well as moderate sites and H3K27me3. On d0, these correlations had only borderline significance on both Chr13 and ChrX. On d7, correlations were unchanged for Chr13 but increased greatly on ChrX (Note overlapping red, orange, and black lines from d0 to d7). The correlation of H3K27me3 with moderate sites was especially strong (black R=0.76, Z=13.2) and was highly significant even at small bin sizes (0.5 Mb). These data contain two separable observations regarding possible modes of XCI spreading: First, the presence of distinct peaks lacking height order (i.e. largest to smallest from Xic to telomere) in EZH2 and H3K27me3 densities over ChrX on d7 argues against nucleosome-by-nucleosome spreading of XCI, which might be expected to manifest as a continuous chromosomal gradient descending from the Xic. Second, the XCI-specific increase in positional correlation illustrates that moderate sites cluster near strong sites on ChrX on d7, an event highly unlikely to be due to chance (Z=8.2). Thus, we suggest a functional link between strong and moderate EZH2 sites, perhaps with strong sites seeding moderate sites in their vicinity to spread H3K27me3.

Figure 6B:
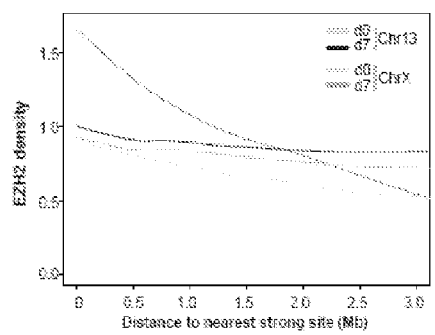
Figure 6C:
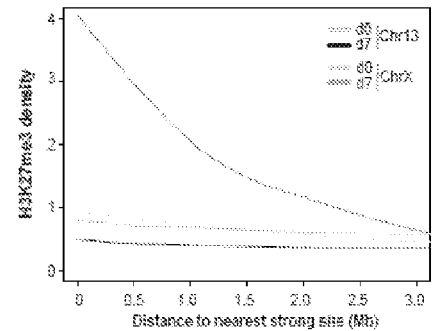
Figure 7A:
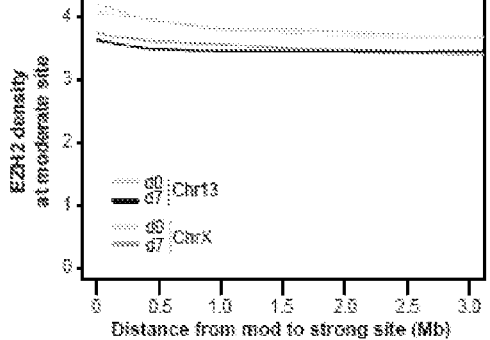

Both serial and direct transfer models (FIG. 5B) might predict a sensitivity of spreading to physical distance. To ask how EZH2 and H3K27me3 densities of a sliding window change as a function of distance from the nearest strong EZH2 site, we plotted trendlines of EZH2 and H3K27me3 densities over megabase-scale distances (FIGS. 6B,C). On Chr13, EZH2 and H3K27me3 densities did not correlate with distance from the nearest strong site on either d0 or d7. The d0 ChrX profile looked nearly identical to those of Chr13. On d7 however, EZH2 and H3K27me3 densities increased dramatically around strong sites (near 0, FIG. 6B,C), consistent with metagene and metasite profiles (FIG. 1,3). Intriguingly, these densities decayed with distance from the nearest strong site. EZH2 densities dropped 3-fold down to baseline by 3 Mb, and H3K27me3 densities dropped 4-fold over the same distance. These observations revealed a gradient of EZH2 binding and catalytic activity around strong sites, arguing for distance-dependent effects at the megabase-scale specific to ChrX during XCI. Are EZH2 and H3K27me3 densities of a given moderate site also sensitive to physical distance between strong and moderate sites? On Chr13, similar to trendlines for overall coverage densities (FIGS. 6B,C), EZH2 and H3K27me3 densities at moderate sites did not correlate with distance to the nearest strong site on either d0 or d7 (FIG. 7A,B). This was also the case for ChrX on d0. Analysis of ChrX on d7 revealed that the H3K27me3 trendline for moderate sites (FIG. 7B) displayed a similar decay (FIG. 6C) in H3K27me3 density with increasing distance to the nearest strong site. Importantly, the EZH2 trendline showed no significant distance-dependent effect at all over 0-3 Mb (FIG. 7A,B).

Figure 6A:
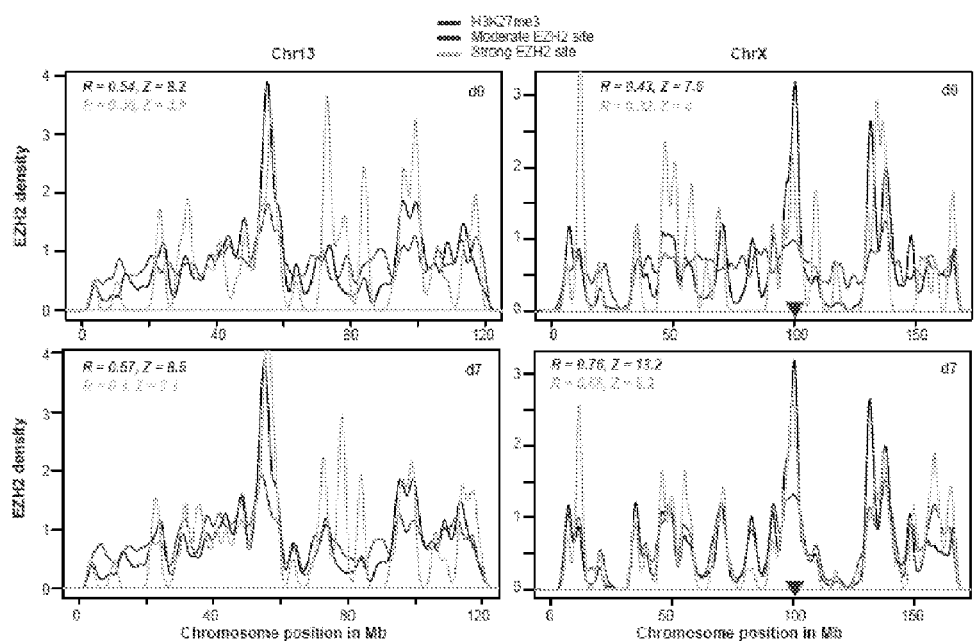
Figure 7B:
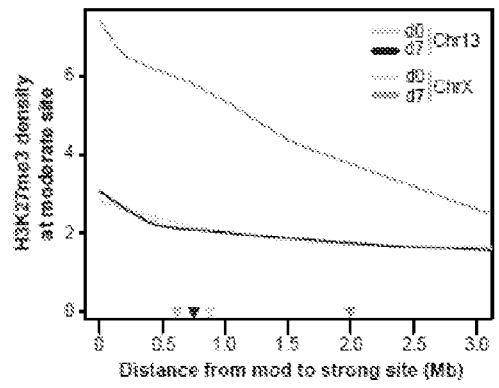
Figure 7C:
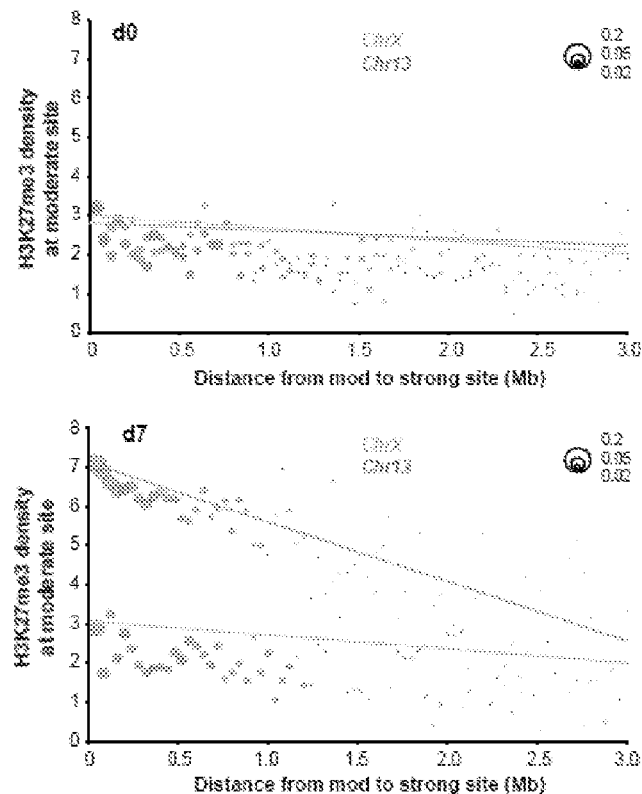
Figure 7D:
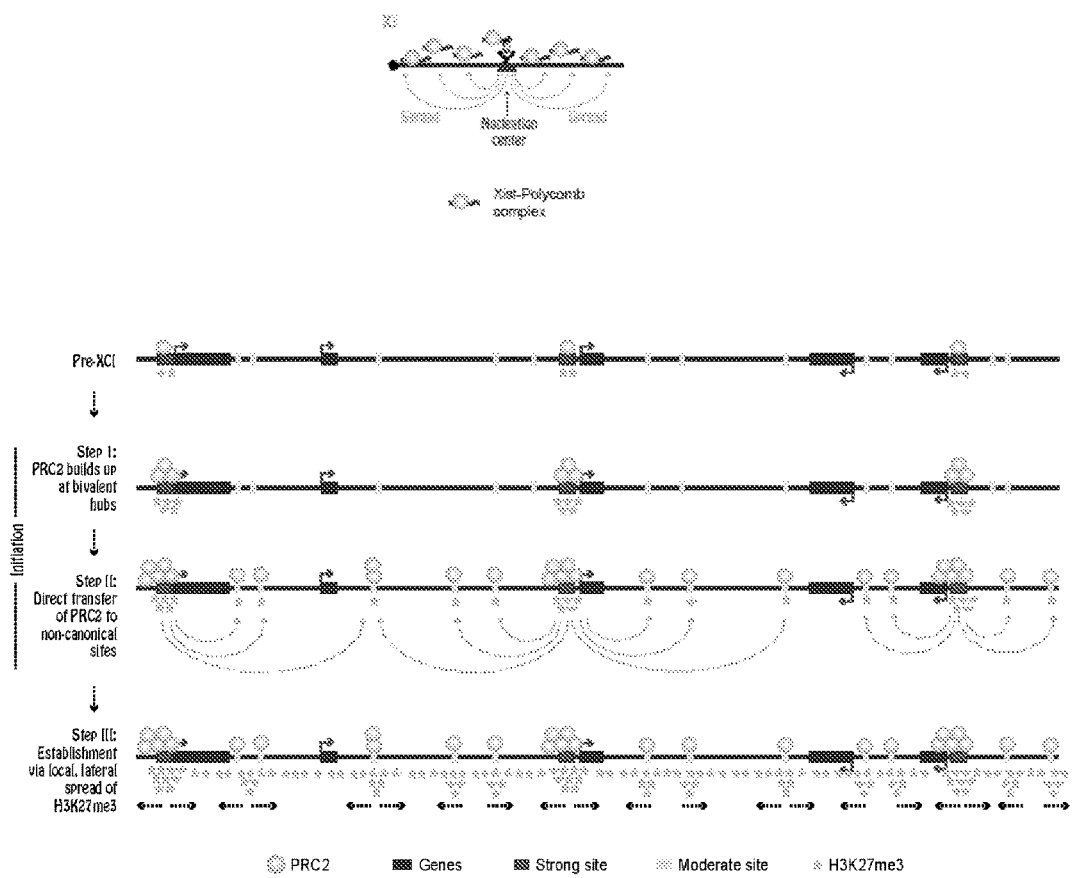

Moderate sites tend to be located close (<1 Mb) to strong sites (FIG. 6A, 7C). This trend was especially pronounced on ChrX on d7 (FIG. 7C, with the largest fraction of all sites clustered within a distance of 0.5 Mb from closest strong site), suggesting acquisition of moderate sites during XCI in the vicinity of strong sites. Importantly, H3K27me3 densities of moderate sites decay with increasing distance to the closest strong site only on ChrX on d7, as seen for both trendlines fitted to raw data (FIG. 7A,B) as well as medians of densities binned over a set distances (FIG. 7C, 40-kb bins). For a numerical characteristic of this long-range effect, we conservatively estimated the radius of the "sphere of influence" of strong EZH2 sites on neighboring moderate sites by calculating the distance-at-half-maximum for the density trendlines. For Chr13 on both days and ChrX on d0, the range was small (0.6-0.8 Mb; FIG. 7B triangles). In contrast, the range for ChrX on d7 was 3-fold greater (2.0 Mb). These data show that, during XCI, there is significant growth of moderate sites around strong sites and that, furthermore, there is substantial increase in the sphere of influence of a given strong site. The general EZH2 and H3K27me3 gradient (FIG. 6B,C) likely resulted from clustering of as moderate sites around strong sites (FIG. 7C). Importantly, the H3K27me3 density of each moderate site decreased with increasing distance from the closest strong site, specifically on ChrX on d7 (FIG. 7B,C). The lack of a similar gradient for EZH2 (FIG. 7A) suggests that EZH2 is not relayed in serial fashion from strong site to proximal moderate site and on to distal moderate site, because EZH2 densities of moderate sites would decay with increasing distance. Instead, the data are most consistent with the notion that strong sites are directly seeding moderate sites nearby, transferring discrete quantities of EZH2 directly from strong to moderate site, rather than spreading EZH2 linearly in a nucleosome-to-nucleosome fashion. Therefore, of the three potential models in FIG. 5B, we favor a direct transfer model in which XCI spreading occurs in a three-step process (FIG. 7D).

Tables IVA-C present the full list of strong (TVA) and moderate (IVB and IVC) EZH2 sites on mouse ChrX. Table IVB presents those mouse moderate binding sites with human liftover sites, and the SEQ ID NOs. corresponding to those human liftover sites. Table IVC presents mouse moderate binding sites without human liftover sites.

For Table IVA: 0, day 0 ES cells: 7, day 7 ES cells; M, MEF cells.

TABLE IVA

| | mouse | | human | | | HUMAN |
|---|---|---|---|---|---|---|
| Day/cell | start | stop | start | stop | name | SEQ ID NO: |
| 0 | 6355750 | 6357250 | 50212545 | 50213682 | X__d0seg__1 | 5933 |
| 0 | 11581050 | 11582400 | 39870650 | 39872160 | X__d0seg__2 | 5934 |
| 0 | 11654250 | 11656500 | 39953733 | 39956003 | X__d0seg__3 | 5935 |
| 0 | 11658000 | 11659650 | 39957538 | 39959198 | X__d0seg__4 | 5936 |
| 0 | 11661300 | 11669900 | 39960989 | 39970382 | X__d0seg__5 | 5937 |
| 0 | 11702200 | 11711600 | 40002293 | 40012108 | X__d0seg__6 | 5938 |
| 0 | 13063000 | 13064350 | 41332668 | 41334037 | X__d0seg__7 | 5939 |
| 0 | 19636150 | 19637850 | 46432902 | 46434381 | X__d0seg__8 | 5940 |
| 0 | 34588150 | 34590950 | 118891849 | 118895631 | X__d0seg__9 | 5941 |
| 0 | 35603800 | 35605650 | 119443498 | 119445332 | X__d0seg__10 | 5942 |
| 0 | 45387450 | 45388650 | 128788385 | 128789539 | X__d0seg__11 | 5943 |

TABLE IVA-continued

| | mouse | | human | | | HUMAN |
|---|---|---|---|---|---|---|
| Day/cell | start | stop | start | stop | name | SEQ ID NO: |
| 0 | 46837700 | 46839500 | 130206324 | 130208164 | X__d0seg__12 | 5944 |
| 0 | 46845400 | 46846850 | 130214751 | 130216122 | X__d0seg__13 | 5945 |
| 0 | 47252550 | 47253750 | none | none | X__d0seg__14 | |
| 0 | 49032200 | 49035300 | 132089948 | 132093140 | X__d0seg__15 | 5946 |
| 0 | 50411050 | 50413200 | 133684370 | 133686238 | X__d0seg__16 | 5947 |
| 0 | 51077050 | 51079600 | none | none | X__d0seg__17 | |
| 0 | 51278000 | 51279750 | none | none | X__d0seg__18 | |
| 0 | 55170850 | 55174500 | 136507747 | 136511479 | X__d0seg__19 | 5948 |
| 0 | 56819550 | 56821700 | 138285559 | 138287629 | X__d0seg__20 | 5949 |
| 0 | 58143800 | 58145750 | 139584389 | 139586382 | X__d0seg__21 | 5950 |
| 0 | 58147400 | 58150150 | 139588021 | 139591349 | X__d0seg__22 | 5951 |
| 0 | 63905800 | 63907600 | 144902694 | 144904464 | X__d0seg__23 | 5952 |
| 0 | 68302550 | 68306150 | 149530837 | 149534342 | X__d0seg__24 | 5953 |
| 0 | 68914200 | 68919300 | 150342031 | 150347910 | X__d0seg__25 | 5954 |
| 0 | 70666600 | 70668850 | 152685724 | 152687813 | X__d0seg__26 | 5955 |
| 0 | 90526850 | 90544850 | 25020529 | 25039134 | X__d0seg__27 | 5956 |
| 0 | 91610450 | 91612400 | 23925910 | 23927984 | X__d0seg__28 | 5957 |
| 0 | 95343200 | 95348050 | 66762975 | 66767942 | X__d0seg__29 | 5958 |
| 0 | 96331100 | 96333000 | 68048502 | 68050400 | X__d0seg__30 | 5959 |
| 0 | 98890350 | 98893700 | 70798488 | 70799686 | X__d0seg__31 | 5960 |
| 0 | 99043550 | 99046750 | 71129147 | 71132812 | X__d0seg__32 | 5961 |
| 0 | 99445650 | 99449150 | 71524940 | 71528621 | X__d0seg__33 | 5962 |
| 0 | 101015800 | 101017750 | 73640853 | 73642890 | X__d0seg__34 | 5963 |
| 0 | 102957600 | 102962150 | 76703692 | 76705284 | X__d0seg__35 | 5964 |
| 0 | 108010200 | 108013400 | 82763729 | 82767068 | X__d0seg__36 | 5965 |
| 0 | 109009250 | 109010600 | none | none | X__d0seg__37 | |
| 0 | 109715300 | 109716400 | 84499950 | 84501037 | X__d0seg__38 | 5966 |
| 0 | 117403550 | 117406500 | 91033972 | 91036917 | X__d0seg__39 | 5967 |
| 0 | 130219100 | 130222100 | 99660982 | 99663892 | X__d0seg__40 | 5968 |
| 0 | 130223500 | 130226150 | 99665247 | 99667700 | X__d0seg__41 | 5969 |
| 0 | 133633250 | 133635300 | none | none | X__d0seg__42 | |
| 0 | 133638650 | 133640400 | none | none | X__d0seg__43 | |
| 0 | 133652750 | 133658500 | 103498701 | 103501568 | X__d0seg__44 | 5970 |
| 0 | 134102600 | 134106900 | 103808481 | 103812486 | X__d0seg__45 | 5971 |
| 0 | 135446700 | 135448600 | 105064204 | 105066146 | X__d0seg__46 | 5972 |
| 0 | 136595250 | 136597000 | none | none | X__d0seg__47 | |
| 0 | 136811000 | 136814500 | 106691670 | 106694899 | X__d0seg__48 | 5973 |
| 0 | 137131700 | 137133550 | 107017375 | 107019086 | X__d0seg__49 | 5974 |
| 0 | 138155450 | 138160200 | 107975156 | 107980031 | X__d0seg__50 | 5975 |
| 0 | 152058400 | 152060300 | 23350696 | 23352468 | X__d0seg__51 | 5976 |
| 0 | 154479100 | 154481450 | 21392303 | 21394736 | X__d0seg__52 | 5977 |
| 0 | 158345400 | 158346750 | 17673909 | 17675213 | X__d0seg__53 | 5978 |
| 0 | 164560750 | 164562150 | 12155682 | 12157098 | X__d0seg__54 | 5979 |
| 0 | 165232450 | 165234650 | 11682453 | 11684741 | X__d0seg__55 | 5980 |
| 0 | 166317850 | 166318900 | 10587335 | 10588320 | X__d0seg__56 | 5981 |
| 7 | 6355950 | 6357900 | 50211824 | 50213570 | X__d7seg__1 | 5982 |
| 7 | 7121100 | 7122700 | none | none | X__d7seg__2 | |
| 7 | 7498450 | 7502200 | 48687634 | 48692237 | X__d7seg__3 | 5983 |
| 7 | 10294900 | 10296300 | 38663737 | 38665158 | X__d7seg__4 | 5984 |
| 7 | 11241850 | 11243350 | 39548159 | 39549617 | X__d7seg__5 | 5985 |
| 7 | 11382900 | 11384550 | 39678763 | 39680514 | X__d7seg__6 | 5986 |
| 7 | 11576800 | 11584500 | 39866133 | 39874292 | X__d7seg__7 | 5987 |
| 7 | 11618350 | 11619550 | 39916154 | 39916960 | X__d7seg__8 | 5988 |
| 7 | 11642600 | 11648900 | 39941590 | 39948337 | X__d7seg__9 | 5989 |
| 7 | 11650000 | 11672900 | 39949546 | 39972450 | X__d7seg__10 | 5990 |
| 7 | 11699450 | 11718900 | 39999868 | 40018589 | X__d7seg__11 | 5991 |
| 7 | 11727350 | 11738450 | 40025540 | 40037252 | X__d7seg__12 | 5992 |
| 7 | 12338750 | 12340000 | 40594595 | 40595937 | X__d7seg__13 | 5993 |
| 7 | 13062600 | 13063900 | 41332467 | 41333587 | X__d7seg__14 | 5994 |
| 7 | 13423950 | 13425200 | 41782998 | 41784181 | X__d7seg__15 | 5995 |
| 7 | 19636100 | 19638650 | 46432902 | 46435184 | X__d7seg__16 | 5996 |
| 7 | 20194000 | 20195500 | 47003630 | 47005197 | X__d7seg__17 | 5997 |
| 7 | 33430850 | 33432050 | 117631803 | 117632878 | X__d7seg__18 | 5998 |
| 7 | 33867300 | 33870050 | 118107473 | 118110151 | X__d7seg__19 | 5999 |
| 7 | 34587350 | 34590550 | 118891276 | 118894307 | X__d7seg__20 | 6000 |
| 7 | 35533400 | 35534750 | none | none | X__d7seg__21 | |
| 7 | 35603700 | 35606500 | 119443375 | 119446145 | X__d7seg__22 | 6001 |
| 7 | 38753650 | 38755500 | 122317397 | 122319184 | X__d7seg__23 | 6002 |
| 7 | 39878950 | 39880250 | none | none | X__d7seg__24 | |
| 7 | 40779750 | 40784250 | 124335918 | 124340213 | X__d7seg__25 | 6003 |
| 7 | 45385700 | 45389400 | 128786671 | 128790322 | X__d7seg__26 | 6004 |
| 7 | 45638750 | 45640750 | 129066389 | 129068773 | X__d7seg__27 | 6005 |
| 7 | 45693200 | 45698600 | 129112930 | 129118262 | X__d7seg__28 | 6006 |
| 7 | 45805150 | 45807500 | 129242747 | 129244939 | X__d7seg__29 | 6007 |
| 7 | 46079400 | 46080700 | none | none | X__d7seg__30 | |
| 7 | 46829050 | 46830450 | 130197943 | 130199420 | X__d7seg__31 | 6008 |

TABLE IVA-continued

| Day/cell | mouse start | mouse stop | human start | human stop | name | HUMAN SEQ ID NO: |
|---|---|---|---|---|---|---|
| 7 | 46845400 | 46848150 | 130214751 | 130217434 | X__d7seg__32 | 6009 |
| 7 | 48647950 | 48648950 | none | none | X__d7seg__33 | |
| 7 | 49033400 | 49035850 | 132091169 | 132093740 | X__d7seg__34 | 6010 |
| 7 | 49515800 | 49517700 | 132546731 | 132548722 | X__d7seg__35 | 6011 |
| 7 | 49966800 | 49968050 | 133119292 | 133120452 | X__d7seg__36 | 6012 |
| 7 | 50410150 | 50413500 | 133683549 | 133686542 | X__d7seg__37 | 6013 |
| 7 | 51077150 | 51079700 | none | none | X__d7seg__38 | |
| 7 | 51277000 | 51280800 | none | none | X__d7seg__39 | |
| 7 | 54755800 | 54757950 | 136114934 | 136117115 | X__d7seg__40 | 6014 |
| 7 | 54924750 | 54926300 | none | none | X__d7seg__41 | |
| 7 | 55031150 | 55032750 | 136362871 | 136364401 | X__d7seg__42 | 6015 |
| 7 | 55169850 | 55176350 | 136506771 | 136513469 | X__d7seg__43 | 6016 |
| 7 | 55279850 | 55281950 | 136644296 | 136646423 | X__d7seg__44 | 6017 |
| 7 | 55283050 | 55287350 | 136647551 | 136651893 | X__d7seg__45 | 6018 |
| 7 | 56818750 | 56823950 | 138284776 | 138290162 | X__d7seg__46 | 6019 |
| 7 | 57428850 | 57430650 | 138771932 | 138772950 | X__d7seg__47 | 6020 |
| 7 | 58052150 | 58053850 | 139471899 | 139473730 | X__d7seg__48 | 6021 |
| 7 | 58143750 | 58152800 | 139584340 | 139594145 | X__d7seg__49 | 6022 |
| 7 | 66613300 | 66615500 | 147581916 | 147584207 | X__d7seg__50 | 6023 |
| 7 | 68301750 | 68305800 | 149530084 | 149534002 | X__d7seg__51 | 6024 |
| 7 | 68334300 | 68335700 | 149578687 | 149580006 | X__d7seg__52 | 6025 |
| 7 | 68914500 | 68919750 | 150342370 | 150348293 | X__d7seg__53 | 6026 |
| 7 | 70666200 | 70668550 | 152685054 | 152687512 | X__d7seg__54 | 6027 |
| 7 | 70880850 | 70883000 | 152907833 | 152909967 | X__d7seg__55 | 6028 |
| 7 | 70884700 | 70886100 | 152912593 | 152913737 | X__d7seg__56 | 6029 |
| 7 | 71124850 | 71126000 | 153150311 | 153151480 | X__d7seg__57 | 6030 |
| 7 | 71597850 | 71598950 | 153706412 | 153707323 | X__d7seg__58 | 6031 |
| 7 | 72387600 | 72388700 | none | none | X__d7seg__59 | |
| 7 | 74677100 | 74678400 | 9309273 | 9310019 | X__d7seg__60 | 6032 |
| 7 | 80732150 | 80733300 | none | none | X__d7seg__61 | |
| 7 | 83217150 | 83218700 | 30494898 | 30495893 | X__d7seg__62 | 6033 |
| 7 | 90526600 | 90546650 | 25018602 | 25039378 | X__d7seg__63 | 6034 |
| 7 | 91610200 | 91612500 | 23925811 | 23928130 | X__d7seg__64 | 6035 |
| 7 | 91881050 | 91882300 | 51486154 | 51487415 | X__d7seg__65 | 6036 |
| 7 | 94121300 | 94122300 | none | none | X__d7seg__66 | |
| 7 | 95343750 | 95348350 | 66763547 | 66768258 | X__d7seg__67 | 6037 |
| 7 | 95361600 | 95362800 | 66783391 | 66784225 | X__d7seg__68 | 6038 |
| 7 | 96638500 | 96639900 | 68356970 | 68358498 | X__d7seg__69 | 6039 |
| 7 | 96662350 | 96663600 | 68381596 | 68382930 | X__d7seg__70 | 6040 |
| 7 | 97170850 | 97172350 | 68835881 | 68837401 | X__d7seg__71 | 6041 |
| 7 | 97280900 | 97282650 | 68948351 | 68949247 | X__d7seg__72 | 6042 |
| 7 | 98577750 | 98581100 | 70441491 | 70445186 | X__d7seg__73 | 6043 |
| 7 | 98834700 | 98835950 | 70752200 | 70753489 | X__d7seg__74 | 6044 |
| 7 | 98890600 | 98894100 | 70798488 | 70799686 | X__d7seg__75 | 6045 |
| 7 | 99041000 | 99042800 | 71126674 | 71128573 | X__d7seg__76 | 6046 |
| 7 | 99044000 | 99047000 | 71129999 | 71133070 | X__d7seg__77 | 6047 |
| 7 | 99264900 | 99267200 | 71350158 | 71352516 | X__d7seg__78 | 6048 |
| 7 | 99440900 | 99449050 | 71520048 | 71528514 | X__d7seg__79 | 6049 |
| 7 | 99640600 | 99641850 | 71731757 | 71733094 | X__d7seg__80 | 6050 |
| 7 | 100516300 | 100519250 | 72666458 | 72669490 | X__d7seg__81 | 6051 |
| 7 | 100549750 | 100551250 | 72780982 | 72782399 | X__d7seg__82 | 6052 |
| 7 | 100643850 | 100646150 | 73014340 | 73015090 | X__d7seg__83 | 6053 |
| 7 | 100889450 | 100891200 | 73755360 | 73757355 | X__d7seg__84 | 6054 |
| 7 | 101014850 | 101017550 | 73641056 | 73643867 | X__d7seg__85 | 6055 |
| 7 | 101175150 | 101176800 | 73832957 | 73834636 | X__d7seg__86 | 6056 |
| 7 | 102315250 | 102317050 | 75647562 | 75649460 | X__d7seg__87 | 6057 |
| 7 | 102957400 | 102962250 | 76703692 | 76705391 | X__d7seg__88 | 6058 |
| 7 | 103414650 | 103415900 | 77394772 | 77395913 | X__d7seg__89 | 6059 |
| 7 | 104871650 | 104873100 | 79277162 | 79278723 | X__d7seg__90 | 6060 |
| 7 | 106380700 | 106381950 | 80604122 | 80604916 | X__d7seg__91 | 6061 |
| 7 | 108009100 | 108013200 | 82762609 | 82766870 | X__d7seg__92 | 6062 |
| 7 | 109714550 | 109716500 | 84499233 | 84501149 | X__d7seg__93 | 6063 |
| 7 | 117403500 | 117405800 | 91033931 | 91036207 | X__d7seg__94 | 6064 |
| 7 | 126283950 | 126284950 | 95939522 | 95940514 | X__d7seg__95 | 6065 |
| 7 | 130218250 | 130227050 | 99660156 | 99668596 | X__d7seg__96 | 6066 |
| 7 | 130515100 | 130516400 | 99985953 | 99987187 | X__d7seg__97 | 6067 |
| 7 | 131291750 | 131293650 | 100878751 | 100880488 | X__d7seg__98 | 6068 |
| 7 | 131498150 | 131499850 | none | none | X__d7seg__99 | |
| 7 | 133201000 | 133202800 | 102862894 | 102864714 | X__d7seg__100 | 6069 |
| 7 | 133633550 | 133635650 | none | none | X__d7seg__101 | |
| 7 | 133638950 | 133640150 | none | none | X__d7seg__102 | |
| 7 | 133652000 | 133656050 | 103497966 | 103500889 | X__d7seg__103 | 6070 |
| 7 | 134103900 | 134107150 | 103809534 | 103812755 | X__d7seg__104 | 6071 |
| 7 | 135269700 | 135271350 | 104892432 | 104893265 | X__d7seg__105 | 6072 |
| 7 | 135642200 | 135643400 | 105302644 | 105303360 | X__d7seg__106 | 6073 |
| 7 | 136594950 | 136598150 | none | none | X__d7seg__107 | |

TABLE IVA-continued

| Day/cell | mouse start | mouse stop | human start | human stop | name | HUMAN SEQ ID NO: |
|---|---|---|---|---|---|---|
| 7 | 136810300 | 136814100 | 106690970 | 106694548 | X__d7seg__108 | 6074 |
| 7 | 137131450 | 137137100 | 107017134 | 107022121 | X__d7seg__109 | 6075 |
| 7 | 137199700 | 137201550 | 107069547 | 107072468 | X__d7seg__110 | 6076 |
| 7 | 137586800 | 137587850 | none | none | X__d7seg__111 | |
| 7 | 137950500 | 137951900 | none | none | X__d7seg__112 | |
| 7 | 138155350 | 138161850 | 107975050 | 107981731 | X__d7seg__113 | 6077 |
| 7 | 138739450 | 138740600 | 108867092 | 108868281 | X__d7seg__114 | 6078 |
| 7 | 139827900 | 139829450 | 110038531 | 110040094 | X__d7seg__115 | 6079 |
| 7 | 140152250 | 140153450 | none | none | X__d7seg__116 | |
| 7 | 141121300 | 141125200 | 111324058 | 111328035 | X__d7seg__117 | 6080 |
| 7 | 143394550 | 143398700 | 113816106 | 113820202 | X__d7seg__118 | 6081 |
| 7 | 148578700 | 148580800 | 53348416 | 53350615 | X__d7seg__119 | 6082 |
| 7 | 149406500 | 149407950 | none | none | X__d7seg__120 | |
| 7 | 149412300 | 149413650 | none | none | X__d7seg__121 | |
| 7 | 150022350 | 150023850 | none | none | X__d7seg__122 | |
| 7 | 150194300 | 150195450 | none | none | X__d7seg__123 | |
| 7 | 152056300 | 152061350 | 23349575 | 23354523 | X__d7seg__124 | 6083 |
| 7 | 154381450 | 154382500 | none | none | X__d7seg__125 | |
| 7 | 154478950 | 154481700 | 21392077 | 21394905 | X__d7seg__126 | 6084 |
| 7 | 155693950 | 155696050 | 20282889 | 20284842 | X__d7seg__127 | 6085 |
| 7 | 155852450 | 155854200 | 20133605 | 20135150 | X__d7seg__128 | 6086 |
| 7 | 156828250 | 156830300 | 19138526 | 19141115 | X__d7seg__129 | 6087 |
| 7 | 157347550 | 157349050 | 18539561 | 18540409 | X__d7seg__130 | 6088 |
| 7 | 157378650 | 157380150 | 18508174 | 18509130 | X__d7seg__131 | 6089 |
| 7 | 158154950 | 158158400 | 17875998 | 17879464 | X__d7seg__132 | 6090 |
| 7 | 158163800 | 158164950 | 17869593 | 17870743 | X__d7seg__133 | 6091 |
| 7 | 158346050 | 158347950 | 17672666 | 17674598 | X__d7seg__134 | 6092 |
| 7 | 158478550 | 158479650 | 17524940 | 17526056 | X__d7seg__135 | 6093 |
| 7 | 158596100 | 158598350 | 17392900 | 17395147 | X__d7seg__136 | 6094 |
| 7 | 160197550 | 160199400 | none | none | X__d7seg__137 | |
| 7 | 160345550 | 160347000 | 15873003 | 15874465 | X__d7seg__138 | 6095 |
| 7 | 160682000 | 160683400 | 15530416 | 15532882 | X__d7seg__139 | 6096 |
| 7 | 162675550 | 162678650 | 13955103 | 13958196 | X__d7seg__140 | 6097 |
| 7 | 163645450 | 163647650 | 12992638 | 12994912 | X__d7seg__141 | 6098 |
| 7 | 164318000 | 164319200 | 12379109 | 12380073 | X__d7seg__142 | 6099 |
| 7 | 164513650 | 164514900 | 12203435 | 12204396 | X__d7seg__143 | 6100 |
| 7 | 165222300 | 165223600 | 11689875 | 11691335 | X__d7seg__144 | 6101 |
| 7 | 165232500 | 165235950 | 11680989 | 11684700 | X__d7seg__145 | 6102 |
| 7 | 165474950 | 165476250 | 11444197 | 11445529 | X__d7seg__146 | 6103 |
| 7 | 166425950 | 166427250 | 10417297 | 10418060 | X__d7seg__147 | 6104 |
| M | 6354500 | 6357650 | 50212150 | 50214751 | Mseg__1 | 6105 |
| M | 11383500 | 11385150 | 39679408 | 39681127 | Mseg__2 | 6106 |
| M | 11663400 | 11667900 | 39963187 | 39967867 | Mseg__3 | 6107 |
| M | 11716850 | 11718450 | 40017048 | 40018389 | Mseg__4 | 6108 |
| M | 33867050 | 33870000 | 118107246 | 118110101 | Mseg__5 | 6109 |
| M | 34588050 | 34590250 | 118891747 | 118894003 | Mseg__6 | 6110 |
| M | 36147950 | 36149450 | 119915712 | 119916185 | Mseg__7 | 6111 |
| M | 48194000 | 48195550 | 131156656 | 131158215 | Mseg__8 | 6112 |
| M | 49965700 | 49968450 | 133118192 | 133121172 | Mseg__9 | 6113 |
| M | 51278600 | 51280350 | none | none | Mseg__10 | |
| M | 55170200 | 55172300 | 136507079 | 136509288 | Mseg__11 | 6114 |
| M | 55173350 | 55174750 | 136510352 | 136511728 | Mseg__12 | 6115 |
| M | 55271400 | 55273350 | 136631672 | 136633482 | Mseg__13 | 6116 |
| M | 55280300 | 55287050 | 136644722 | 136651581 | Mseg__14 | 6117 |
| M | 55290550 | 55292350 | 136655150 | 136657164 | Mseg__15 | 6118 |
| M | 57431400 | 57432800 | 138773758 | 138774995 | Mseg__16 | 6119 |
| M | 58144150 | 58149000 | 139584764 | 139589645 | Mseg__17 | 6120 |
| M | 68914150 | 68919150 | 150341980 | 150347692 | Mseg__18 | 6121 |
| M | 70747800 | 70749800 | 152782594 | 152784456 | Mseg__19 | 6122 |
| M | 85396250 | 85397400 | none | none | Mseg__20 | |
| M | 90492700 | 90494500 | 25071294 | 25072254 | Mseg__21 | 6123 |
| M | 90526400 | 90527900 | 25038048 | 25039598 | Mseg__22 | 6124 |
| M | 90529250 | 90530700 | 25035237 | 25036755 | Mseg__23 | 6125 |
| M | 90532900 | 90536800 | 25028850 | 25032991 | Mseg__24 | 6126 |
| M | 90539250 | 90544950 | 25020386 | 25026336 | Mseg__25 | 6127 |
| M | 98579350 | 98580950 | 70443345 | 70445034 | Mseg__26 | 6128 |
| M | 99044100 | 99046300 | 71130118 | 71132470 | Mseg__27 | 6129 |
| M | 99445250 | 99447450 | 71524416 | 71526952 | Mseg__28 | 6130 |
| M | 100380800 | 100382350 | 72433479 | 72435048 | Mseg__29 | 6131 |
| M | 100517100 | 100518450 | 72667291 | 72668591 | Mseg__30 | 6132 |
| M | 100642000 | 100644900 | none | none | Mseg__31 | |
| M | 101394600 | 101397000 | 74143561 | 74145754 | Mseg__32 | 6133 |
| M | 117405950 | 117407000 | 91036360 | 91037375 | Mseg__33 | 6134 |
| M | 119510000 | 119511250 | 92927719 | 92928844 | Mseg__34 | 6135 |
| M | 127858650 | 127859800 | 97533217 | 97534152 | Mseg__35 | 6136 |
| M | 133651850 | 133655750 | 103497517 | 103500629 | Mseg__36 | 6137 |

TABLE IVA-continued

| Day/cell | mouse start | mouse stop | human start | human stop | name | HUMAN SEQ ID NO: |
|---|---|---|---|---|---|---|
| M | 136595100 | 136597800 | none | none | Mseg_37 | |
| M | 136811700 | 136813750 | 106692325 | 106694186 | Mseg_38 | 6138 |
| M | 137134350 | 137135400 | 107019665 | 107020545 | Mseg_39 | 6139 |
| M | 138155700 | 138161850 | 107975434 | 107981731 | Mseg_40 | 6140 |
| M | 141123000 | 141124650 | 111325775 | 111327435 | Mseg_41 | 6141 |
| M | 143397150 | 143398250 | 113818658 | 113819740 | Mseg_42 | 6142 |
| M | 152056200 | 152059650 | 23351204 | 23354627 | Mseg_43 | 6143 |
| M | 154479800 | 154481850 | 21391910 | 21394015 | Mseg_44 | 6144 |
| M | 155851900 | 155854000 | 20133820 | 20135681 | Mseg_45 | 6145 |
| M | 158154850 | 158156600 | 17877847 | 17879563 | Mseg_46 | 6146 |
| M | 158345700 | 158347450 | 17673177 | 17674917 | Mseg_47 | 6147 |
| M | 159080700 | 159082100 | 16964311 | 16965735 | Mseg_48 | 6148 |
| M | 160197950 | 160200150 | none | none | Mseg_49 | |
| M | 165232950 | 165234750 | 11682353 | 11684132 | Mseg_50 | 6149 |

For Table IIVB: 0, day 0 ES cells; 7, day 7 ES cells; M, MEF cells. The SEQ NOs. are for the human liftover sequences corresponding to the empirically identified mouse binding sites.

TABLE IVB

Mouse Binding Sites with Human Liftovers

| Cell/Day | Mouse Start | Mouse end | Human start | Human end | Segment name | SEQ ID NO: |
|---|---|---|---|---|---|---|
| 0 | 5498050 | 5499850 | 51384621 | 51385743 | d0Mseg12 | 6150 |
| 0 | 5626750 | 5628600 | 51237102 | 51237727 | d0Mseg15 | 6151 |
| 0 | 5658250 | 5660100 | 51150260 | 51151798 | d0Mseg16 | 6152 |
| 0 | 5668400 | 5670100 | 51138480 | 51140100 | d0Mseg17 | 6153 |
| 0 | 5748000 | 5749900 | 51075870 | 51076838 | d0Mseg18 | 6154 |
| 0 | 6269800 | 6271650 | 50271710 | 50272155 | d0Mseg21 | 6155 |
| 0 | 6311700 | 6313400 | 50259828 | 50260498 | d0Mseg22 | 6156 |
| 0 | 6355350 | 6359100 | 50210609 | 50214087 | d0Mseg23 | 6157 |
| 0 | 6439500 | 6441200 | 50178893 | 50180814 | d0Mseg24 | 6158 |
| 0 | 6621650 | 6623350 | 49967916 | 49968685 | d0Mseg25 | 6159 |
| 0 | 6894000 | 6895750 | 49687889 | 49689724 | d0Mseg26 | 6160 |
| 0 | 6926950 | 6928600 | 49664202 | 49664943 | d0Mseg27 | 6161 |
| 0 | 6943500 | 6945150 | 49652496 | 49653779 | d0Mseg28 | 6162 |
| 0 | 6951300 | 6952700 | 49644353 | 49645597 | d0Mseg29 | 6163 |
| 0 | 6954450 | 6956600 | 49640185 | 49642591 | d0Mseg30 | 6164 |
| 0 | 7192150 | 7194200 | 49079555 | 49082334 | d0Mseg31 | 6165 |
| 0 | 7216650 | 7218550 | 49053974 | 49055791 | d0Mseg32 | 6166 |
| 0 | 7248700 | 7250350 | 49025447 | 49028034 | d0Mseg33 | 6167 |
| 0 | 7542700 | 7544550 | 48645436 | 48646897 | d0Mseg34 | 6168 |
| 0 | 8713600 | 8714850 | 37377045 | 37377723 | d0Mseg44 | 6169 |
| 0 | 8819600 | 8821400 | 37507349 | 37511839 | d0Mseg45 | 6170 |
| 0 | 9113750 | 9115350 | 37576100 | 37576664 | d0Mseg46 | 6171 |
| 0 | 9645550 | 9647250 | 38032241 | 38034190 | d0Mseg50 | 6172 |
| 0 | 9651300 | 9653000 | 38037944 | 38039779 | d0Mseg51 | 6173 |
| 0 | 9692900 | 9694950 | 38078201 | 38080297 | d0Mseg53 | 6174 |
| 0 | 9755150 | 9756900 | 38149973 | 38150474 | d0Mseg54 | 6175 |
| 0 | 9867700 | 9869400 | 38249973 | 38251585 | d0Mseg55 | 6176 |
| 0 | 10020200 | 10022150 | 38364806 | 38366637 | d0Mseg56 | 6177 |
| 0 | 10061900 | 10063850 | 38420306 | 38422352 | d0Mseg57 | 6178 |
| 0 | 10076700 | 10077700 | 38438460 | 38439366 | d0Mseg58 | 6179 |
| 0 | 10078900 | 10080600 | 38439858 | 38441923 | d0Mseg59 | 6180 |
| 0 | 10121350 | 10122750 | 38480547 | 38482022 | d0Mseg60 | 6181 |
| 0 | 10279550 | 10281150 | 38649265 | 38650920 | d0Mseg62 | 6182 |
| 0 | 10386900 | 10388750 | 38765167 | 38766457 | d0Mseg63 | 6183 |
| 0 | 10538600 | 10540100 | 38899029 | 38900549 | d0Mseg64 | 6184 |
| 0 | 10561550 | 10563100 | 38912277 | 38913350 | d0Mseg65 | 6185 |
| 0 | 10626900 | 10628650 | 38981715 | 38982441 | d0Mseg66 | 6186 |
| 0 | 10874500 | 10876100 | 39220834 | 39221777 | d0Mseg67 | 6187 |
| 0 | 10981850 | 10983550 | 39298806 | 39300497 | d0Mseg68 | 6188 |
| 0 | 11068300 | 11070450 | 39375066 | 39377627 | d0Mseg69 | 6189 |
| 0 | 11240150 | 11243650 | 39546298 | 39549617 | d0Mseg70 | 6190 |
| 0 | 11283650 | 11285000 | 39588385 | 39589768 | d0Mseg71 | 6191 |
| 0 | 11354250 | 11356100 | 39645601 | 39653225 | d0Mseg73 | 6192 |
| 0 | 11375100 | 11376200 | 39670709 | 39671699 | d0Mseg74 | 6193 |
| 0 | 11383350 | 11385400 | 39679261 | 39681394 | d0Mseg75 | 6194 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 11387500 | 11390550 | 39687004 | 39690176 | d0Mseg76 | 6195 |
| 0 | 11413850 | 11415500 | 39711808 | 39713462 | d0Mseg77 | 6196 |
| 0 | 11506750 | 11508550 | 39800944 | 39802652 | d0Mseg78 | 6197 |
| 0 | 11510300 | 11511900 | 39804787 | 39806020 | d0Mseg79 | 6198 |
| 0 | 11516600 | 11518550 | 39808913 | 39810205 | d0Mseg80 | 6199 |
| 0 | 11573900 | 11584350 | 39862889 | 39874130 | d0Mseg81 | 6200 |
| 0 | 11645350 | 11646550 | 39944588 | 39945914 | d0Mseg82 | 6201 |
| 0 | 11652900 | 11671400 | 39952327 | 39971371 | d0Mseg83 | 6202 |
| 0 | 11701800 | 11718950 | 40001909 | 40018589 | d0Mseg84 | 6203 |
| 0 | 11731500 | 11733350 | 40030026 | 40032134 | d0Mseg85 | 6204 |
| 0 | 11735400 | 11737750 | 40034243 | 40036599 | d0Mseg86 | 6205 |
| 0 | 11828200 | 11830050 | 40124432 | 40126931 | d0Mseg87 | 6206 |
| 0 | 11874350 | 11876050 | 40171654 | 40173026 | d0Mseg88 | 6207 |
| 0 | 11919050 | 11920800 | 40222540 | 40225263 | d0Mseg89 | 6208 |
| 0 | 13062550 | 13064850 | 41332467 | 41334385 | d0Mseg93 | 6209 |
| 0 | 13127000 | 13128000 | 41413718 | 41414777 | d0Mseg94 | 6210 |
| 0 | 13169700 | 13171350 | 41478429 | 41480000 | d0Mseg95 | 6211 |
| 0 | 13228200 | 13230000 | 41561029 | 41563513 | d0Mseg96 | 6212 |
| 0 | 13260850 | 13262550 | 41605553 | 41608150 | d0Mseg97 | 6213 |
| 0 | 13423650 | 13425450 | 41782693 | 41784443 | d0Mseg98 | 6214 |
| 0 | 13498950 | 13500800 | 41843824 | 41845252 | d0Mseg99 | 6215 |
| 0 | 13702300 | 13704050 | 41957723 | 41959332 | d0Mseg100 | 6216 |
| 0 | 13847550 | 13849400 | 42072561 | 42073365 | d0Mseg101 | 6217 |
| 0 | 14115400 | 14117050 | 42256207 | 42258188 | d0Mseg104 | 6218 |
| 0 | 14250650 | 14252100 | 42385818 | 42386012 | d0Mseg105 | 6219 |
| 0 | 14686750 | 14688450 | 42634126 | 42637274 | d0Mseg107 | 6220 |
| 0 | 14828200 | 14829850 | 42697133 | 42697663 | d0Mseg109 | 6221 |
| 0 | 14830900 | 14832600 | 42692356 | 42692645 | d0Mseg110 | 6222 |
| 0 | 14924600 | 14926300 | 42763595 | 42771532 | d0Mseg111 | 6223 |
| 0 | 15457800 | 15459500 | 43085068 | 43086778 | d0Mseg115 | 6224 |
| 0 | 15488400 | 15490100 | 43093809 | 43094667 | d0Mseg116 | 6225 |
| 0 | 16064950 | 16066500 | 43437190 | 43438047 | d0Mseg118 | 6226 |
| 0 | 16098550 | 16100350 | 145890788 | 145891496 | d0Mseg119 | 6227 |
| 0 | 16291950 | 16293550 | 43630279 | 43634460 | d0Mseg120 | 6228 |
| 0 | 16467700 | 16469700 | 43814337 | 43816308 | d0Mseg121 | 6229 |
| 0 | 16512450 | 16514150 | 43855852 | 43856472 | d0Mseg122 | 6230 |
| 0 | 17462100 | 17463800 | 102931764 | 102931959 | d0Mseg125 | 6231 |
| 0 | 17565900 | 17566950 | 44622555 | 44623924 | d0Mseg126 | 6232 |
| 0 | 17733350 | 17734550 | 44724938 | 44726299 | d0Mseg127 | 6233 |
| 0 | 18828500 | 18830200 | 45722726 | 45724726 | d0Mseg138 | 6234 |
| 0 | 18957250 | 18958850 | 45817006 | 45832328 | d0Mseg140 | 6235 |
| 0 | 19558200 | 19559450 | 46284530 | 46285072 | d0Mseg144 | 6236 |
| 0 | 19633850 | 19638150 | 46432902 | 46434681 | d0Mseg147 | 6237 |
| 0 | 19779950 | 19781600 | 46539229 | 46541241 | d0Mseg149 | 6238 |
| 0 | 20088800 | 20090600 | 46914256 | 46916022 | d0Mseg151 | 6239 |
| 0 | 20124450 | 20127600 | 46937281 | 46940639 | d0Mseg152 | 6240 |
| 0 | 21131900 | 21133650 | 115398655 | 115400110 | d0Mseg156 | 6241 |
| 0 | 21172800 | 21174400 | 115457948 | 115472259 | d0Mseg157 | 6242 |
| 0 | 21293650 | 21295250 | 115569207 | 115571604 | d0Mseg158 | 6243 |
| 0 | 21859100 | 21861000 | 116088373 | 116089315 | d0Mseg163 | 6244 |
| 0 | 22127700 | 22129500 | 116379235 | 116380628 | d0Mseg168 | 6245 |
| 0 | 22140050 | 22141700 | 116393220 | 116393816 | d0Mseg169 | 6246 |
| 0 | 22176700 | 22178250 | 116444897 | 116445300 | d0Mseg170 | 6247 |
| 0 | 22214750 | 22216350 | 116504858 | 116506369 | d0Mseg171 | 6248 |
| 0 | 22439500 | 22440700 | 116681128 | 116681830 | d0Mseg173 | 6249 |
| 0 | 22653150 | 22654700 | 116890499 | 116897650 | d0Mseg174 | 6250 |
| 0 | 22669150 | 22670750 | 116904891 | 116906150 | d0Mseg175 | 6251 |
| 0 | 22673300 | 22675100 | 116909986 | 116911046 | d0Mseg176 | 6252 |
| 0 | 22821650 | 22822700 | 117051368 | 117051896 | d0Mseg177 | 6253 |
| 0 | 22935400 | 22936800 | 117244223 | 117246416 | d0Mseg178 | 6254 |
| 0 | 22938700 | 22940600 | 117247748 | 117249078 | d0Mseg179 | 6255 |
| 0 | 23051650 | 23053550 | 117330906 | 117331130 | d0Mseg180 | 6256 |
| 0 | 23264800 | 23266550 | 117474321 | 117475532 | d0Mseg182 | 6257 |
| 0 | 23519450 | 23521100 | 127076727 | 127077736 | d0Mseg183 | 6258 |
| 0 | 33649800 | 33653650 | 117860276 | 117862945 | d0Mseg200 | 6259 |
| 0 | 33864350 | 33870000 | 118103194 | 118110101 | d0Mseg201 | 6260 |
| 0 | 34284900 | 34286250 | 118534368 | 118535141 | d0Mseg204 | 6261 |
| 0 | 34476050 | 34477400 | 118777825 | 118778830 | d0Mseg206 | 6262 |
| 0 | 34587050 | 34591300 | 118890977 | 118896264 | d0Mseg208 | 6263 |
| 0 | 34670100 | 34671800 | 119072042 | 119073223 | d0Mseg209 | 6264 |
| 0 | 35564300 | 35565300 | 119403850 | 119405074 | d0Mseg221 | 6265 |
| 0 | 35598700 | 35600500 | 119438010 | 119439841 | d0Mseg222 | 6266 |
| 0 | 35603150 | 35606150 | 119442759 | 119445796 | d0Mseg223 | 6267 |
| 0 | 35611300 | 35613100 | 119451846 | 119453474 | d0Mseg224 | 6268 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 35690850 | 35691850 | 119517726 | 119518291 | d0Mseg225 | 6269 |
| 0 | 35754350 | 35756050 | 119561427 | 119562856 | d0Mseg226 | 6270 |
| 0 | 35819150 | 35820850 | 119614477 | 119615648 | d0Mseg227 | 6271 |
| 0 | 36039400 | 36041250 | 119842373 | 119842929 | d0Mseg228 | 6272 |
| 0 | 36173350 | 36174900 | 119932892 | 119933252 | d0Mseg230 | 6273 |
| 0 | 36654450 | 36656100 | 120330537 | 120332343 | d0Mseg236 | 6274 |
| 0 | 36876550 | 36878100 | 120528235 | 120530237 | d0Mseg238 | 6275 |
| 0 | 37793150 | 37794800 | 121250458 | 121253285 | d0Mseg242 | 6276 |
| 0 | 37844400 | 37846150 | 121330934 | 121337734 | d0Mseg244 | 6277 |
| 0 | 38469450 | 38470650 | 122066574 | 122067437 | d0Mseg251 | 6278 |
| 0 | 38594850 | 38596500 | 122206545 | 122207118 | d0Mseg253 | 6279 |
| 0 | 38753000 | 38757450 | 122316744 | 122321135 | d0Mseg254 | 6280 |
| 0 | 38815700 | 38817400 | 122375517 | 122378159 | d0Mseg255 | 6281 |
| 0 | 38868850 | 38870550 | 122423590 | 122427671 | d0Mseg256 | 6282 |
| 0 | 39067900 | 39069500 | 122660711 | 122661389 | d0Mseg257 | 6283 |
| 0 | 39302700 | 39304500 | 122883575 | 122883897 | d0Mseg259 | 6284 |
| 0 | 39616700 | 39618350 | 123221188 | 123223377 | d0Mseg262 | 6285 |
| 0 | 39625200 | 39626900 | 123230623 | 123233048 | d0Mseg263 | 6286 |
| 0 | 39686050 | 39687600 | 123343412 | 123345001 | d0Mseg265 | 6287 |
| 0 | 39714050 | 39715750 | 123364511 | 123365673 | d0Mseg266 | 6288 |
| 0 | 40013950 | 40015100 | 123633862 | 123635113 | d0Mseg267 | 6289 |
| 0 | 40098550 | 40100400 | 123708500 | 123709575 | d0Mseg268 | 6290 |
| 0 | 40143600 | 40145300 | 123750446 | 123751745 | d0Mseg269 | 6291 |
| 0 | 40151400 | 40153000 | 123759059 | 123762887 | d0Mseg270 | 6292 |
| 0 | 40186550 | 40188250 | 123794765 | 123795552 | d0Mseg271 | 6293 |
| 0 | 40210550 | 40211550 | 123809222 | 123809677 | d0Mseg272 | 6294 |
| 0 | 40407600 | 40409250 | 124006420 | 124007290 | d0Mseg274 | 6295 |
| 0 | 40472500 | 40474400 | 124062911 | 124063665 | d0Mseg275 | 6296 |
| 0 | 40558600 | 40560400 | 124137181 | 124146965 | d0Mseg276 | 6297 |
| 0 | 40779800 | 40783250 | 124335968 | 124339222 | d0Mseg279 | 6298 |
| 0 | 40786750 | 40788350 | 124341501 | 124341841 | d0Mseg280 | 6299 |
| 0 | 40806250 | 40807950 | 124361834 | 124362744 | d0Mseg281 | 6300 |
| 0 | 40866400 | 40868350 | 124375759 | 124376574 | d0Mseg282 | 6301 |
| 0 | 40961850 | 40963850 | 124470423 | 124472361 | d0Mseg283 | 6302 |
| 0 | 41039500 | 41041250 | 124511669 | 124513421 | d0Mseg284 | 6303 |
| 0 | 41323900 | 41325550 | 124805056 | 124805341 | d0Mseg285 | 6304 |
| 0 | 41497750 | 41499050 | 124951426 | 124951961 | d0Mseg287 | 6305 |
| 0 | 41720000 | 41721850 | 125298738 | 125300600 | d0Mseg289 | 6306 |
| 0 | 43931600 | 43933350 | 127539134 | 127539717 | d0Mseg306 | 6307 |
| 0 | 44562750 | 44564400 | 128049207 | 128050510 | d0Mseg311 | 6308 |
| 0 | 44584200 | 44585750 | 128061267 | 128061602 | d0Mseg312 | 6309 |
| 0 | 44813650 | 44815200 | 128244188 | 128245366 | d0Mseg313 | 6310 |
| 0 | 44831400 | 44835800 | 128258218 | 128261991 | d0Mseg314 | 6311 |
| 0 | 44885300 | 44887200 | 128287706 | 128288820 | d0Mseg315 | 6312 |
| 0 | 44953550 | 44955250 | 128357475 | 128359345 | d0Mseg316 | 6313 |
| 0 | 45226500 | 45228200 | 128638231 | 128640008 | d0Mseg318 | 6314 |
| 0 | 45297750 | 45299550 | 128704573 | 128708498 | d0Mseg319 | 6315 |
| 0 | 45385750 | 45389250 | 128786719 | 128790159 | d0Mseg320 | 6316 |
| 0 | 45488450 | 45490400 | 128901741 | 128903749 | d0Mseg321 | 6317 |
| 0 | 45505050 | 45506850 | 128918350 | 128920545 | d0Mseg322 | 6318 |
| 0 | 45664900 | 45666900 | 129087730 | 129090199 | d0Mseg323 | 6319 |
| 0 | 45696250 | 45699200 | 129115939 | 129118858 | d0Mseg324 | 6320 |
| 0 | 45807950 | 45809750 | 129245394 | 129247932 | d0Mseg325 | 6321 |
| 0 | 46132200 | 46133450 | 129558859 | 129559167 | d0Mseg328 | 6322 |
| 0 | 46178900 | 46180600 | 129609706 | 129609943 | d0Mseg330 | 6323 |
| 0 | 46223250 | 46224300 | 129641548 | 129642386 | d0Mseg331 | 6324 |
| 0 | 46424000 | 46425650 | 129824019 | 129825338 | d0Mseg332 | 6325 |
| 0 | 46788250 | 46790300 | 130160250 | 130160610 | d0Mseg338 | 6326 |
| 0 | 46792650 | 46794150 | 130162565 | 130164136 | d0Mseg339 | 6327 |
| 0 | 46830500 | 46832150 | 130199469 | 130201066 | d0Mseg340 | 6328 |
| 0 | 46833300 | 46835250 | 130202016 | 130204177 | d0Mseg341 | 6329 |
| 0 | 46837150 | 46840150 | 130205732 | 130208956 | d0Mseg342 | 6330 |
| 0 | 46844900 | 46849150 | 130214214 | 130218472 | d0Mseg343 | 6331 |
| 0 | 47117100 | 47118950 | 130390764 | 130392077 | d0Mseg345 | 6332 |
| 0 | 47163200 | 47165050 | 130431899 | 130432414 | d0Mseg346 | 6333 |
| 0 | 47250800 | 47254300 | 130471174 | 130471612 | d0Mseg347 | 6334 |
| 0 | 47292300 | 47294250 | 130491898 | 130492160 | d0Mseg348 | 6335 |
| 0 | 47296350 | 47297700 | 130493341 | 130494538 | d0Mseg349 | 6336 |
| 0 | 47311250 | 47313150 | 130497500 | 130498116 | d0Mseg350 | 6337 |
| 0 | 47517150 | 47518900 | 130678615 | 130678963 | d0Mseg353 | 6338 |
| 0 | 48215300 | 48217100 | 131179423 | 131181280 | d0Mseg357 | 6339 |
| 0 | 48256150 | 48260450 | 131220943 | 131225525 | d0Mseg358 | 6340 |
| 0 | 48301750 | 48302950 | 131278014 | 131278763 | d0Mseg359 | 6341 |
| 0 | 48418100 | 48419850 | 131426674 | 131427999 | d0Mseg361 | 6342 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 48488050 | 48489200 | 131531145 | 131531727 | d0Mseg362 | 6343 |
| 0 | 48560650 | 48561800 | 131625511 | 131627275 | d0Mseg363 | 6344 |
| 0 | 48579050 | 48580700 | 131643579 | 131643804 | d0Mseg364 | 6345 |
| 0 | 48711450 | 48713150 | 131731336 | 131733099 | d0Mseg365 | 6346 |
| 0 | 49019800 | 49021500 | 132076121 | 132077158 | d0Mseg366 | 6347 |
| 0 | 49030900 | 49035950 | 132088516 | 132093838 | d0Mseg367 | 6348 |
| 0 | 49041550 | 49043400 | 132099266 | 132100904 | d0Mseg368 | 6349 |
| 0 | 49054850 | 49056700 | 132111953 | 132114009 | d0Mseg369 | 6350 |
| 0 | 49115350 | 49116900 | 132166372 | 132167098 | d0Mseg370 | 6351 |
| 0 | 49449550 | 49451250 | 132477256 | 132479068 | d0Mseg373 | 6352 |
| 0 | 49470850 | 49472300 | 132501369 | 132502597 | d0Mseg374 | 6353 |
| 0 | 49516400 | 49519950 | 132547340 | 132550971 | d0Mseg375 | 6354 |
| 0 | 49568750 | 49570250 | 132612063 | 132615648 | d0Mseg376 | 6355 |
| 0 | 49947550 | 49949450 | 133098516 | 133100926 | d0Mseg377 | 6356 |
| 0 | 49965700 | 49967650 | 133118192 | 133120136 | d0Mseg378 | 6357 |
| 0 | 50117350 | 50118350 | 133324614 | 133325151 | d0Mseg380 | 6358 |
| 0 | 50151750 | 50153450 | 133379324 | 133380833 | d0Mseg381 | 6359 |
| 0 | 50389850 | 50391600 | 133646432 | 133647389 | d0Mseg384 | 6360 |
| 0 | 50402300 | 50404150 | 133675065 | 133677098 | d0Mseg385 | 6361 |
| 0 | 50410900 | 50414450 | 133684229 | 133687679 | d0Mseg386 | 6362 |
| 0 | 50426350 | 50427400 | 133702755 | 133703787 | d0Mseg387 | 6363 |
| 0 | 50680600 | 50682400 | 134010628 | 134011331 | d0Mseg389 | 6364 |
| 0 | 51041250 | 51042750 | 134579038 | 134579956 | d0Mseg396 | 6365 |
| 0 | 53613650 | 53615500 | 134492594 | 134493655 | d0Mseg415 | 6366 |
| 0 | 53938600 | 53940400 | 135159035 | 135159827 | d0Mseg417 | 6367 |
| 0 | 53985300 | 53986300 | 135229962 | 135231013 | d0Mseg418 | 6368 |
| 0 | 54085350 | 54088900 | 135343978 | 135347694 | d0Mseg419 | 6369 |
| 0 | 54090400 | 54091450 | 135349194 | 135349917 | d0Mseg420 | 6370 |
| 0 | 54577950 | 54580050 | 135848013 | 135850107 | d0Mseg421 | 6371 |
| 0 | 54755300 | 54757550 | 136114195 | 136116742 | d0Mseg422 | 6372 |
| 0 | 54759150 | 54760800 | 136118238 | 136119738 | d0Mseg423 | 6373 |
| 0 | 54833200 | 54834950 | 136181494 | 136182057 | d0Mseg424 | 6374 |
| 0 | 54857650 | 54859300 | 136196146 | 136196356 | d0Mseg425 | 6375 |
| 0 | 55043850 | 55045500 | 136378478 | 136379954 | d0Mseg426 | 6376 |
| 0 | 55170200 | 55176300 | 136507079 | 136513398 | d0Mseg428 | 6377 |
| 0 | 55269650 | 55271500 | 136629395 | 136631796 | d0Mseg430 | 6378 |
| 0 | 55515950 | 55517600 | 136932196 | 136932407 | d0Mseg433 | 6379 |
| 0 | 55627450 | 55629150 | 137004678 | 137005621 | d0Mseg434 | 6380 |
| 0 | 55825650 | 55827350 | 137217567 | 137219377 | d0Mseg435 | 6381 |
| 0 | 55863150 | 55864900 | 137263518 | 137264410 | d0Mseg436 | 6382 |
| 0 | 55903200 | 55904850 | 137287637 | 137288858 | d0Mseg437 | 6383 |
| 0 | 55972200 | 55974150 | 137369544 | 137371625 | d0Mseg438 | 6384 |
| 0 | 56086950 | 56088600 | 137481110 | 137482124 | d0Mseg439 | 6385 |
| 0 | 56309350 | 56311000 | 137708870 | 137709448 | d0Mseg440 | 6386 |
| 0 | 56371000 | 56372750 | 137779385 | 137780630 | d0Mseg441 | 6387 |
| 0 | 56386200 | 56388200 | 137792166 | 137794140 | d0Mseg442 | 6388 |
| 0 | 56489150 | 56490650 | 137924802 | 137926367 | d0Mseg443 | 6389 |
| 0 | 56693500 | 56695500 | 138159571 | 138161025 | d0Mseg445 | 6390 |
| 0 | 56819200 | 56822050 | 138285209 | 138288246 | d0Mseg446 | 6391 |
| 0 | 56873550 | 56874550 | 138351055 | 138352012 | d0Mseg447 | 6392 |
| 0 | 57038750 | 57040500 | 138470872 | 138471659 | d0Mseg448 | 6393 |
| 0 | 57087450 | 57088900 | 138506335 | 138507792 | d0Mseg449 | 6394 |
| 0 | 57301100 | 57302800 | 138660159 | 138660376 | d0Mseg451 | 6395 |
| 0 | 57393900 | 57397600 | 138716399 | 138721615 | d0Mseg452 | 6396 |
| 0 | 57430250 | 57431950 | 138772601 | 138774240 | d0Mseg453 | 6397 |
| 0 | 57647950 | 57649500 | 139006792 | 139007745 | d0Mseg454 | 6398 |
| 0 | 57659050 | 57661050 | 139016306 | 139018771 | d0Mseg455 | 6399 |
| 0 | 57801250 | 57803450 | 139173958 | 139176577 | d0Mseg457 | 6400 |
| 0 | 57865700 | 57867350 | 139225313 | 139226165 | d0Mseg458 | 6401 |
| 0 | 58013450 | 58015150 | 139427332 | 139427725 | d0Mseg459 | 6402 |
| 0 | 58042800 | 58044650 | 139453825 | 139457542 | d0Mseg460 | 6403 |
| 0 | 58081850 | 58083550 | 139517527 | 139520017 | d0Mseg461 | 6404 |
| 0 | 58127500 | 58129500 | 139570393 | 139571700 | d0Mseg463 | 6405 |
| 0 | 58132850 | 58134850 | 139573188 | 139574373 | d0Mseg464 | 6406 |
| 0 | 58142300 | 58152450 | 139582747 | 139593795 | d0Mseg465 | 6407 |
| 0 | 58737250 | 58739000 | 140549902 | 140551253 | d0Mseg468 | 6408 |
| 0 | 58771150 | 58772950 | 140502362 | 140503638 | d0Mseg469 | 6409 |
| 0 | 59181150 | 59182400 | 140648434 | 140650828 | d0Mseg471 | 6410 |
| 0 | 59283000 | 59284650 | 140729589 | 140730359 | d0Mseg473 | 6411 |
| 0 | 59311400 | 59313150 | 140752455 | 140755267 | d0Mseg474 | 6412 |
| 0 | 59348750 | 59350450 | 140801407 | 140802195 | d0Mseg475 | 6413 |
| 0 | 60103250 | 60105100 | 141547249 | 141548140 | d0Mseg485 | 6414 |
| 0 | 60730100 | 60731850 | 142072550 | 142073142 | d0Mseg492 | 6415 |
| 0 | 61008200 | 61010050 | 142312563 | 142312854 | d0Mseg498 | 6416 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 61151200 | 61152950 | 142400730 | 142401528 | d0Mseg501 | 6417 |
| 0 | 61527650 | 61531700 | 142720286 | 142724493 | d0Mseg503 | 6418 |
| 0 | 61825450 | 61827050 | 143032965 | 143033272 | d0Mseg505 | 6419 |
| 0 | 62320050 | 62321700 | 143568554 | 143570206 | d0Mseg511 | 6420 |
| 0 | 62856500 | 62858100 | 144163597 | 144164556 | d0Mseg515 | 6421 |
| 0 | 62949100 | 62950700 | 144253347 | 144255281 | d0Mseg516 | 6422 |
| 0 | 62996700 | 62998050 | 144301426 | 144302229 | d0Mseg517 | 6423 |
| 0 | 63407100 | 63408750 | 144516735 | 144517061 | d0Mseg523 | 6424 |
| 0 | 63567050 | 63568950 | 144629942 | 144630384 | d0Mseg527 | 6425 |
| 0 | 63778100 | 63779750 | 144808645 | 144810883 | d0Mseg528 | 6426 |
| 0 | 63901200 | 63903850 | 144898111 | 144900677 | d0Mseg530 | 6427 |
| 0 | 63905500 | 63907900 | 144902364 | 144904761 | d0Mseg531 | 6428 |
| 0 | 64136900 | 64138700 | 145221785 | 145223055 | d0Mseg533 | 6429 |
| 0 | 64179400 | 64181150 | 145252196 | 145253968 | d0Mseg534 | 6430 |
| 0 | 64825300 | 64827050 | 145821989 | 145823194 | d0Mseg539 | 6431 |
| 0 | 65072450 | 65074100 | 146034483 | 146035113 | d0Mseg541 | 6432 |
| 0 | 65174700 | 65176100 | 146185425 | 146186095 | d0Mseg543 | 6433 |
| 0 | 65407200 | 65408950 | 146545245 | 146545932 | d0Mseg546 | 6434 |
| 0 | 65503700 | 65505350 | 146614980 | 146616114 | d0Mseg549 | 6435 |
| 0 | 65954350 | 65956200 | 147015185 | 147017317 | d0Mseg551 | 6436 |
| 0 | 66120050 | 66121650 | 147154382 | 147155922 | d0Mseg553 | 6437 |
| 0 | 66203350 | 66205150 | 147214580 | 147215862 | d0Mseg554 | 6438 |
| 0 | 66261200 | 66262650 | 147243281 | 147244824 | d0Mseg555 | 6439 |
| 0 | 66559800 | 66561650 | 147527136 | 147529353 | d0Mseg558 | 6440 |
| 0 | 66575100 | 66576800 | 147544151 | 147544709 | d0Mseg559 | 6441 |
| 0 | 66584550 | 66586300 | 147552460 | 147553518 | d0Mseg560 | 6442 |
| 0 | 66591350 | 66593000 | 147554689 | 147558186 | d0Mseg561 | 6443 |
| 0 | 66612250 | 66615350 | 147580806 | 147584059 | d0Mseg562 | 6444 |
| 0 | 66686400 | 66688000 | 147653591 | 147654308 | d0Mseg563 | 6445 |
| 0 | 66796250 | 66798350 | 147743228 | 147744195 | d0Mseg564 | 6446 |
| 0 | 66864650 | 66866250 | 147809791 | 147811048 | d0Mseg565 | 6447 |
| 0 | 67074300 | 67076100 | 148021921 | 148024772 | d0Mseg566 | 6448 |
| 0 | 67243850 | 67245850 | 148198540 | 148200273 | d0Mseg568 | 6449 |
| 0 | 67449250 | 67450400 | 148406820 | 148406976 | d0Mseg570 | 6450 |
| 0 | 67953150 | 67954850 | 149215097 | 149215558 | d0Mseg572 | 6451 |
| 0 | 68177400 | 68179150 | 149423320 | 149425118 | d0Mseg573 | 6452 |
| 0 | 68241150 | 68242650 | 149468454 | 149469389 | d0Mseg575 | 6453 |
| 0 | 68274550 | 68276250 | 149502014 | 149502544 | d0Mseg576 | 6454 |
| 0 | 68302300 | 68306450 | 149530447 | 149534656 | d0Mseg577 | 6455 |
| 0 | 68912550 | 68919950 | 150340243 | 150348493 | d0Mseg582 | 6456 |
| 0 | 69008800 | 69010950 | 150476931 | 150479631 | d0Mseg585 | 6457 |
| 0 | 69019700 | 69021550 | 150506080 | 150506410 | d0Mseg586 | 6458 |
| 0 | 69036350 | 69037700 | 150528414 | 150529663 | d0Mseg587 | 6459 |
| 0 | 69518500 | 69520300 | 151141496 | 151143350 | d0Mseg588 | 6460 |
| 0 | 69593150 | 69594850 | 151253649 | 151254915 | d0Mseg589 | 6461 |
| 0 | 70170200 | 70171300 | 152013627 | 152014200 | d0Mseg592 | 6462 |
| 0 | 70655800 | 70657950 | 152676293 | 152678338 | d0Mseg598 | 6463 |
| 0 | 70664550 | 70669500 | 152684240 | 152688407 | d0Mseg599 | 6464 |
| 0 | 70692950 | 70694650 | 152721396 | 152723065 | d0Mseg600 | 6465 |
| 0 | 70711750 | 70713450 | 152741138 | 152742758 | d0Mseg601 | 6466 |
| 0 | 70749800 | 70751750 | 152784456 | 152786356 | d0Mseg602 | 6467 |
| 0 | 70762700 | 70764300 | 152796863 | 152798278 | d0Mseg603 | 6468 |
| 0 | 70855400 | 70859850 | 152887498 | 152889256 | d0Mseg604 | 6469 |
| 0 | 70880300 | 70883850 | 152907310 | 152911630 | d0Mseg605 | 6470 |
| 0 | 71522150 | 71523800 | 153633517 | 153633972 | d0Mseg608 | 6471 |
| 0 | 71559800 | 71561550 | 153673805 | 153675928 | d0Mseg609 | 6472 |
| 0 | 72683300 | 72684900 | 154319084 | 154320539 | d0Mseg616 | 6473 |
| 0 | 73271250 | 73273150 | 114681544 | 114682421 | d0Mseg625 | 6474 |
| 0 | 73403300 | 73405000 | 114539896 | 114541084 | d0Mseg627 | 6475 |
| 0 | 73945100 | 73946750 | 8809113 | 8810780 | d0Mseg629 | 6476 |
| 0 | 74204800 | 74205950 | 8918925 | 8919933 | d0Mseg633 | 6477 |
| 0 | 74354100 | 74355950 | 9097939 | 9098658 | d0Mseg635 | 6478 |
| 0 | 74479650 | 74481500 | 9165561 | 9166569 | d0Mseg639 | 6479 |
| 0 | 74835300 | 74837050 | 9541007 | 9542010 | d0Mseg640 | 6480 |
| 0 | 74887150 | 74888850 | 9622451 | 9652183 | d0Mseg641 | 6481 |
| 0 | 75814350 | 75816000 | 37220133 | 37221031 | d0Mseg648 | 6482 |
| 0 | 76153600 | 76155300 | 36879028 | 36880035 | d0Mseg652 | 6483 |
| 0 | 76204350 | 76205550 | 36846998 | 36847199 | d0Mseg653 | 6484 |
| 0 | 76509050 | 76510700 | 36404171 | 36404660 | d0Mseg654 | 6485 |
| 0 | 76733150 | 76734800 | 35993028 | 35994758 | d0Mseg655 | 6486 |
| 0 | 76753500 | 76755200 | 35970094 | 35971592 | d0Mseg656 | 6487 |
| 0 | 76810650 | 76812150 | 35905727 | 35906658 | d0Mseg658 | 6488 |
| 0 | 77574200 | 77576000 | 35150260 | 35160500 | d0Mseg665 | 6489 |
| 0 | 77684450 | 77686200 | 36740892 | 36744682 | d0Mseg668 | 6490 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 78741350 | 78745900 | 34356727 | 34359854 | d0Mseg678 | 6491 |
| 0 | 78872550 | 78873800 | 34285580 | 34286028 | d0Mseg682 | 6492 |
| 0 | 79215650 | 79217350 | 33997931 | 33998333 | d0Mseg684 | 6493 |
| 0 | 79557900 | 79559550 | 33741409 | 33743186 | d0Mseg693 | 6494 |
| 0 | 79857600 | 79859300 | 33452012 | 33453109 | d0Mseg696 | 6495 |
| 0 | 80254150 | 80255950 | 33185083 | 33186115 | d0Mseg698 | 6496 |
| 0 | 80318500 | 80320200 | 33105869 | 33108524 | d0Mseg699 | 6497 |
| 0 | 81251850 | 81253650 | 32239306 | 32242454 | d0Mseg704 | 6498 |
| 0 | 81255150 | 81257300 | 32237572 | 32237818 | d0Mseg705 | 6499 |
| 0 | 81479450 | 81480900 | 32015529 | 32016547 | d0Mseg706 | 6500 |
| 0 | 81487750 | 81489450 | 32009808 | 32010769 | d0Mseg707 | 6501 |
| 0 | 81590050 | 81591800 | 31917168 | 31919036 | d0Mseg708 | 6502 |
| 0 | 81990300 | 81992050 | 31553874 | 31554846 | d0Mseg709 | 6503 |
| 0 | 82018750 | 82020400 | 31524098 | 31525749 | d0Mseg710 | 6504 |
| 0 | 82195400 | 82196700 | 31357619 | 31359042 | d0Mseg711 | 6505 |
| 0 | 82403700 | 82405400 | 31181011 | 31182728 | d0Mseg712 | 6506 |
| 0 | 82654100 | 82658600 | 31006282 | 31009137 | d0Mseg713 | 6507 |
| 0 | 82689550 | 82691450 | 30979166 | 30980310 | d0Mseg714 | 6508 |
| 0 | 82720400 | 82722100 | 30966768 | 30968131 | d0Mseg715 | 6509 |
| 0 | 82879550 | 82881300 | 30845268 | 30845816 | d0Mseg717 | 6510 |
| 0 | 82953250 | 82954900 | 30743635 | 30745063 | d0Mseg718 | 6511 |
| 0 | 83389350 | 83391000 | 30391141 | 30393316 | d0Mseg720 | 6512 |
| 0 | 83459650 | 83462050 | 30305447 | 30310141 | d0Mseg721 | 6513 |
| 0 | 83498100 | 83499800 | 30266572 | 30268308 | d0Mseg722 | 6514 |
| 0 | 83676450 | 83678100 | 30216814 | 30217402 | d0Mseg726 | 6515 |
| 0 | 83996250 | 83998050 | 29966349 | 29967290 | d0Mseg731 | 6516 |
| 0 | 84145500 | 84147050 | 29818530 | 29819770 | d0Mseg732 | 6517 |
| 0 | 84170700 | 84172800 | 29799731 | 29801818 | d0Mseg733 | 6518 |
| 0 | 84247650 | 84249250 | 29742448 | 29743818 | d0Mseg734 | 6519 |
| 0 | 84276950 | 84278650 | 29701349 | 29703758 | d0Mseg735 | 6520 |
| 0 | 84351200 | 84352850 | 29632179 | 29632621 | d0Mseg736 | 6521 |
| 0 | 84517450 | 84519150 | 29452057 | 29453170 | d0Mseg738 | 6522 |
| 0 | 84557200 | 84558650 | 29408052 | 29409423 | d0Mseg739 | 6523 |
| 0 | 84653350 | 84655100 | 29305622 | 29306211 | d0Mseg740 | 6524 |
| 0 | 84720450 | 84722200 | 29247582 | 29248603 | d0Mseg741 | 6525 |
| 0 | 84815150 | 84816800 | 29145261 | 29147611 | d0Mseg742 | 6526 |
| 0 | 84860400 | 84862250 | 29093880 | 29095196 | d0Mseg743 | 6527 |
| 0 | 85012200 | 85013650 | 28928792 | 28931035 | d0Mseg744 | 6528 |
| 0 | 85032750 | 85034050 | 28908715 | 28909224 | d0Mseg745 | 6529 |
| 0 | 85124800 | 85126400 | 28820332 | 28821634 | d0Mseg747 | 6530 |
| 0 | 85176650 | 85178350 | 28786018 | 28786623 | d0Mseg748 | 6531 |
| 0 | 85206500 | 85207750 | 28754563 | 28756386 | d0Mseg749 | 6532 |
| 0 | 85288700 | 85290550 | 28675711 | 28679552 | d0Mseg750 | 6533 |
| 0 | 85314350 | 85316000 | 28646138 | 28647295 | d0Mseg751 | 6534 |
| 0 | 85358400 | 85361750 | 28604766 | 28608155 | d0Mseg752 | 6535 |
| 0 | 85364600 | 85366300 | 28600255 | 28601965 | d0Mseg753 | 6536 |
| 0 | 85792550 | 85794200 | 28299807 | 28300150 | d0Mseg757 | 6537 |
| 0 | 86389550 | 86391150 | 27957716 | 27958166 | d0Mseg762 | 6538 |
| 0 | 86412650 | 86414350 | 27939569 | 27940357 | d0Mseg763 | 6539 |
| 0 | 86989450 | 86991200 | 27489658 | 27490404 | d0Mseg766 | 6540 |
| 0 | 86999250 | 87000950 | 27478311 | 27480059 | d0Mseg767 | 6541 |
| 0 | 87263750 | 87265550 | 27234699 | 27235412 | d0Mseg771 | 6542 |
| 0 | 87459700 | 87461400 | 27105417 | 27107248 | d0Mseg774 | 6543 |
| 0 | 87753950 | 87756000 | 26869569 | 26869857 | d0Mseg778 | 6544 |
| 0 | 87925000 | 87926600 | 26652168 | 26652786 | d0Mseg782 | 6545 |
| 0 | 88192750 | 88194400 | 26465880 | 26466400 | d0Mseg786 | 6546 |
| 0 | 89312450 | 89314100 | 26180439 | 26180674 | d0Mseg800 | 6547 |
| 0 | 89465500 | 89467150 | 26031327 | 26031720 | d0Mseg802 | 6548 |
| 0 | 89650200 | 89652200 | 25802345 | 25805653 | d0Mseg805 | 6549 |
| 0 | 89717750 | 89718750 | 25731163 | 25732194 | d0Mseg806 | 6550 |
| 0 | 89738800 | 89740450 | 25695054 | 25699634 | d0Mseg807 | 6551 |
| 0 | 89880500 | 89882250 | 25523309 | 25523987 | d0Mseg809 | 6552 |
| 0 | 90278350 | 90280050 | 25197574 | 25199546 | d0Mseg811 | 6553 |
| 0 | 90294900 | 90296650 | 25182507 | 25184534 | d0Mseg812 | 6554 |
| 0 | 90519400 | 90521250 | 25044877 | 25046103 | d0Mseg814 | 6555 |
| 0 | 90525450 | 90546350 | 25018910 | 25040467 | d0Mseg815 | 6556 |
| 0 | 90930950 | 90932600 | 24656096 | 24657532 | d0Mseg816 | 6557 |
| 0 | 91413950 | 91415650 | 24100595 | 24101004 | d0Mseg818 | 6558 |
| 0 | 91477600 | 91479550 | 24044199 | 24045531 | d0Mseg819 | 6559 |
| 0 | 91484400 | 91488600 | 24033530 | 24039170 | d0Mseg820 | 6560 |
| 0 | 91608900 | 91612700 | 23925605 | 23928770 | d0Mseg821 | 6561 |
| 0 | 91799000 | 91800800 | 51601228 | 51601466 | d0Mseg824 | 6562 |
| 0 | 92639800 | 92641550 | 63425250 | 63426814 | d0Mseg830 | 6563 |
| 0 | 92723300 | 92725200 | 63564001 | 63566849 | d0Mseg832 | 6564 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 92839200 | 92841000 | 64140517 | 64141987 | d0Mseg834 | 6565 |
| 0 | 93136000 | 93137650 | 64738085 | 64739731 | d0Mseg836 | 6566 |
| 0 | 93660200 | 93662150 | 65391584 | 65392550 | d0Mseg841 | 6567 |
| 0 | 93906200 | 93908200 | 65654925 | 65656563 | d0Mseg845 | 6568 |
| 0 | 94538700 | 94540250 | 65824332 | 65825740 | d0Mseg853 | 6569 |
| 0 | 94580000 | 94582300 | 65870522 | 65870853 | d0Mseg854 | 6570 |
| 0 | 94817600 | 94819350 | 66116387 | 66116875 | d0Mseg856 | 6571 |
| 0 | 94846650 | 94848350 | 66133132 | 66134850 | d0Mseg857 | 6572 |
| 0 | 95342400 | 95349050 | 66762307 | 66769132 | d0Mseg865 | 6573 |
| 0 | 95823750 | 95825500 | 67318031 | 67319044 | d0Mseg869 | 6574 |
| 0 | 96084100 | 96086200 | 67651012 | 67653565 | d0Mseg870 | 6575 |
| 0 | 96211300 | 96213200 | 67884482 | 67886322 | d0Mseg872 | 6576 |
| 0 | 96237950 | 96240650 | 67913458 | 67916124 | d0Mseg873 | 6577 |
| 0 | 96329750 | 96333550 | 68047196 | 68050996 | d0Mseg875 | 6578 |
| 0 | 96342550 | 96343850 | 68060181 | 68061523 | d0Mseg876 | 6579 |
| 0 | 96393800 | 96395100 | 68113958 | 68115329 | d0Mseg877 | 6580 |
| 0 | 96411000 | 96412800 | 68130958 | 68133362 | d0Mseg878 | 6581 |
| 0 | 96421600 | 96423300 | 68143108 | 68146669 | d0Mseg879 | 6582 |
| 0 | 96428000 | 96429850 | 68150769 | 68152786 | d0Mseg880 | 6583 |
| 0 | 96512700 | 96514600 | 68235986 | 68238549 | d0Mseg881 | 6584 |
| 0 | 96579250 | 96581150 | 68298297 | 68298617 | d0Mseg883 | 6585 |
| 0 | 96593500 | 96595100 | 68310297 | 68311868 | d0Mseg884 | 6586 |
| 0 | 96599750 | 96601450 | 68315355 | 68317029 | d0Mseg885 | 6587 |
| 0 | 96608150 | 96609450 | 68324375 | 68325513 | d0Mseg886 | 6588 |
| 0 | 96625050 | 96626650 | 68342396 | 68344299 | d0Mseg887 | 6589 |
| 0 | 96627800 | 96630250 | 68346564 | 68349617 | d0Mseg888 | 6590 |
| 0 | 96725450 | 96727150 | 68448086 | 68449933 | d0Mseg889 | 6591 |
| 0 | 96763250 | 96765100 | 68497972 | 68500183 | d0Mseg890 | 6592 |
| 0 | 96848650 | 96850350 | 68602279 | 68603945 | d0Mseg891 | 6593 |
| 0 | 97159500 | 97161350 | 68826620 | 68826999 | d0Mseg893 | 6594 |
| 0 | 97379000 | 97380100 | 69020662 | 69022721 | d0Mseg894 | 6595 |
| 0 | 97503950 | 97505850 | 69175650 | 69177751 | d0Mseg895 | 6596 |
| 0 | 97676850 | 97678550 | 69318580 | 69319059 | d0Mseg896 | 6597 |
| 0 | 97803250 | 97804250 | 69490538 | 69491298 | d0Mseg897 | 6598 |
| 0 | 97932300 | 97934150 | 69650015 | 69653471 | d0Mseg898 | 6599 |
| 0 | 97963050 | 97964500 | 69664670 | 69666136 | d0Mseg900 | 6600 |
| 0 | 97965650 | 97967350 | 69667355 | 69669161 | d0Mseg901 | 6601 |
| 0 | 98046500 | 98048050 | 69774027 | 69775248 | d0Mseg902 | 6602 |
| 0 | 98415650 | 98417450 | 70285879 | 70287822 | d0Mseg907 | 6603 |
| 0 | 98450050 | 98452150 | 70316252 | 70318356 | d0Mseg908 | 6604 |
| 0 | 98514100 | 98516200 | 70387695 | 70390584 | d0Mseg909 | 6605 |
| 0 | 98570350 | 98571800 | 70432843 | 70434018 | d0Mseg910 | 6606 |
| 0 | 98581000 | 98583000 | 70445087 | 70447666 | d0Mseg911 | 6607 |
| 0 | 98610750 | 98612550 | 70469534 | 70471333 | d0Mseg912 | 6608 |
| 0 | 98753750 | 98755400 | 70613505 | 70614236 | d0Mseg913 | 6609 |
| 0 | 98886600 | 98887850 | 150565726 | 150573806 | d0Mseg914 | 6610 |
| 0 | 98889950 | 98894050 | 70798488 | 70799686 | d0Mseg915 | 6611 |
| 0 | 98964500 | 98966350 | 70869746 | 70871110 | d0Mseg916 | 6612 |
| 0 | 99034950 | 99038350 | 71115819 | 71116564 | d0Mseg918 | 6613 |
| 0 | 99041700 | 99049300 | 71127413 | 71135129 | d0Mseg919 | 6614 |
| 0 | 99060700 | 99062300 | 71145126 | 71146461 | d0Mseg920 | 6615 |
| 0 | 99071200 | 99073100 | 71155218 | 71156780 | d0Mseg921 | 6616 |
| 0 | 99095300 | 99096550 | 71175644 | 71176356 | d0Mseg922 | 6617 |
| 0 | 99134200 | 99136050 | 71221238 | 71222506 | d0Mseg924 | 6618 |
| 0 | 99149850 | 99151550 | 71238722 | 71240542 | d0Mseg925 | 6619 |
| 0 | 99285100 | 99286750 | 71370737 | 71372518 | d0Mseg926 | 6620 |
| 0 | 99383000 | 99384700 | 71495186 | 71497106 | d0Mseg929 | 6621 |
| 0 | 99444050 | 99451350 | 71522808 | 71530160 | d0Mseg930 | 6622 |
| 0 | 99486400 | 99488250 | 71558772 | 71560626 | d0Mseg931 | 6623 |
| 0 | 99566000 | 99567800 | 71633358 | 71635362 | d0Mseg932 | 6624 |
| 0 | 99603150 | 99604800 | 71686760 | 71688246 | d0Mseg933 | 6625 |
| 0 | 99640350 | 99642100 | 71731741 | 71733679 | d0Mseg934 | 6626 |
| 0 | 99812450 | 99814300 | 71887027 | 71887547 | d0Mseg935 | 6627 |
| 0 | 100125900 | 100127750 | 72159986 | 72161955 | d0Mseg936 | 6628 |
| 0 | 100381100 | 100382950 | 72433780 | 72435567 | d0Mseg939 | 6629 |
| 0 | 100516550 | 100518450 | 72666744 | 72668591 | d0Mseg941 | 6630 |
| 0 | 100818300 | 100820300 | 73512719 | 73513769 | d0Mseg946 | 6631 |
| 0 | 100884300 | 100885450 | 73592095 | 73593215 | d0Mseg947 | 6632 |
| 0 | 100888500 | 100892400 | 73754118 | 73757872 | d0Mseg948 | 6633 |
| 0 | 100894150 | 100896200 | 73749869 | 73752364 | d0Mseg949 | 6634 |
| 0 | 100918650 | 100920300 | 73733005 | 73733622 | d0Mseg950 | 6635 |
| 0 | 100938350 | 100940150 | 73712704 | 73714413 | d0Mseg951 | 6636 |
| 0 | 101006150 | 101007750 | 73652321 | 73654311 | d0Mseg953 | 6637 |
| 0 | 101015150 | 101018500 | 73640388 | 73643571 | d0Mseg954 | 6638 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 0 | 101073800 | 101075500 | 73755542 | 73759009 | d0Mseg956 | 6639 |
| 0 | 101287250 | 101288950 | 73972760 | 73973792 | d0Mseg961 | 6640 |
| 0 | 101443250 | 101445100 | 74189480 | 74222078 | d0Mseg962 | 6641 |
| 0 | 101673000 | 101674850 | 74448601 | 74462106 | d0Mseg964 | 6642 |
| 0 | 102008000 | 102009850 | 74956843 | 74957815 | d0Mseg967 | 6643 |
| 0 | 102012300 | 102013950 | 74968256 | 74969482 | d0Mseg968 | 6644 |
| 0 | 102049500 | 102051050 | 75002015 | 75003554 | d0Mseg969 | 6645 |
| 0 | 102280200 | 102281900 | 75404165 | 75404915 | d0Mseg972 | 6646 |
| 0 | 102315950 | 102317000 | 75648324 | 75649410 | d0Mseg973 | 6647 |
| 0 | 102608250 | 102610100 | 76280646 | 76282009 | d0Mseg976 | 6648 |
| 0 | 102956950 | 102963400 | 76703692 | 76706545 | d0Mseg979 | 6649 |
| 0 | 103303400 | 103305100 | 77287226 | 77289103 | d0Mseg980 | 6650 |
| 0 | 103413750 | 103416550 | 77393560 | 77396497 | d0Mseg983 | 6651 |
| 0 | 103799950 | 103801400 | 77585135 | 77585894 | d0Mseg991 | 6652 |
| 0 | 103896700 | 103898600 | 77770237 | 77771313 | d0Mseg993 | 6653 |
| 0 | 104115650 | 104117700 | 78002891 | 78004882 | d0Mseg995 | 6654 |
| 0 | 104597350 | 104598850 | 78621398 | 78623011 | d0Mseg1000 | 6655 |
| 0 | 104703700 | 104705400 | 78813367 | 78814999 | d0Mseg1001 | 6656 |
| 0 | 104872050 | 104873900 | 79277582 | 79279571 | d0Mseg1003 | 6657 |
| 0 | 105014200 | 105015850 | 79595049 | 79596388 | d0Mseg1004 | 6658 |
| 0 | 105933200 | 105935100 | 79926813 | 79928864 | d0Mseg1013 | 6659 |
| 0 | 105952000 | 105953600 | 79943931 | 79945929 | d0Mseg1014 | 6660 |
| 0 | 106178250 | 106179900 | 80316735 | 80317343 | d0Mseg1015 | 6661 |
| 0 | 106206050 | 106207850 | 80374090 | 80376305 | d0Mseg1016 | 6662 |
| 0 | 106227350 | 106229250 | 80389747 | 80415164 | d0Mseg1017 | 6663 |
| 0 | 106655900 | 106657650 | 80850892 | 80851694 | d0Mseg1022 | 6664 |
| 0 | 106998250 | 107000200 | 81377385 | 81379460 | d0Mseg1026 | 6665 |
| 0 | 107491600 | 107492950 | 81956311 | 81957710 | d0Mseg1028 | 6666 |
| 0 | 107515000 | 107516800 | 81980538 | 81982179 | d0Mseg1029 | 6667 |
| 0 | 107890800 | 107892700 | 82586210 | 82588204 | d0Mseg1032 | 6668 |
| 0 | 107917250 | 107918900 | 82606575 | 82608531 | d0Mseg1033 | 6669 |
| 0 | 108008800 | 108013900 | 82762302 | 82767614 | d0Mseg1035 | 6670 |
| 0 | 108623600 | 108625500 | 83484874 | 83487065 | d0Mseg1038 | 6671 |
| 0 | 108633600 | 108635250 | 83494837 | 83496129 | d0Mseg1039 | 6672 |
| 0 | 108648550 | 108650250 | 83505320 | 83508862 | d0Mseg1041 | 6673 |
| 0 | 108699950 | 108701200 | 83585647 | 83587388 | d0Mseg1042 | 6674 |
| 0 | 108782850 | 108784250 | 83727825 | 83729519 | d0Mseg1044 | 6675 |
| 0 | 109353850 | 109355800 | 84227965 | 84231580 | d0Mseg1050 | 6676 |
| 0 | 109423150 | 109424950 | 84256948 | 84258838 | d0Mseg1052 | 6677 |
| 0 | 109713750 | 109717050 | 84498457 | 84501673 | d0Mseg1054 | 6678 |
| 0 | 109871500 | 109872550 | 84689438 | 84690082 | d0Mseg1055 | 6679 |
| 0 | 110118950 | 110120750 | 85033538 | 85033826 | d0Mseg1056 | 6680 |
| 0 | 110140750 | 110142450 | 85084462 | 85086230 | d0Mseg1057 | 6681 |
| 0 | 110421100 | 110422800 | 85412681 | 85416710 | d0Mseg1059 | 6682 |
| 0 | 110801700 | 110803500 | 85933710 | 85934289 | d0Mseg1061 | 6683 |
| 0 | 110851000 | 110852750 | 85990473 | 85990766 | d0Mseg1062 | 6684 |
| 0 | 111700150 | 111701800 | 86956298 | 86959701 | d0Mseg1066 | 6685 |
| 0 | 112401200 | 112403200 | 87315126 | 87315926 | d0Mseg1071 | 6686 |
| 0 | 113059400 | 113060700 | 87695980 | 87696230 | d0Mseg1076 | 6687 |
| 0 | 113845100 | 113846850 | 88310419 | 88310868 | d0Mseg1080 | 6688 |
| 0 | 113917550 | 113919350 | 88263023 | 88263833 | d0Mseg1081 | 6689 |
| 0 | 114314750 | 114316350 | 88442229 | 88443387 | d0Mseg1083 | 6690 |
| 0 | 115703400 | 115705000 | 89319230 | 89320498 | d0Mseg1089 | 6691 |
| 0 | 115959150 | 115960350 | 89590007 | 89590892 | d0Mseg1091 | 6692 |
| 0 | 116295150 | 116296800 | 89865088 | 89865907 | d0Mseg1096 | 6693 |
| 0 | 116315700 | 116317450 | 89900830 | 89911110 | d0Mseg1097 | 6694 |
| 0 | 116511800 | 116513400 | 90067520 | 90067991 | d0Mseg1100 | 6695 |
| 0 | 117048900 | 117050550 | 90697489 | 90698453 | d0Mseg1107 | 6696 |
| 0 | 117089400 | 117091200 | 90730944 | 90736294 | d0Mseg1108 | 6697 |
| 0 | 117278850 | 117280300 | 90916891 | 90919777 | d0Mseg1111 | 6698 |
| 0 | 117377550 | 117379450 | 91016340 | 91017764 | d0Mseg1112 | 6699 |
| 0 | 117401400 | 117407150 | 91031842 | 91037540 | d0Mseg1113 | 6700 |
| 0 | 117644600 | 117647700 | 91346072 | 91354230 | d0Mseg1115 | 6701 |
| 0 | 117768800 | 117770600 | 91547393 | 91548215 | d0Mseg1116 | 6702 |
| 0 | 119120350 | 119122050 | 92660966 | 92661229 | d0Mseg1125 | 6703 |
| 0 | 119151350 | 119153150 | 92701270 | 92702362 | d0Mseg1126 | 6704 |
| 0 | 119252400 | 119253650 | 92772141 | 92772699 | d0Mseg1129 | 6705 |
| 0 | 119277800 | 119279600 | 92792140 | 92793911 | d0Mseg1130 | 6706 |
| 0 | 119499300 | 119501050 | 92909526 | 92910271 | d0Mseg1132 | 6707 |
| 0 | 119623200 | 119624900 | 93021134 | 93022275 | d0Mseg1134 | 6708 |
| 0 | 119774200 | 119775900 | 93085263 | 93086408 | d0Mseg1136 | 6709 |
| 0 | 119924950 | 119926650 | 93288572 | 93290474 | d0Mseg1137 | 6710 |
| 0 | 123235550 | 123237150 | 93668059 | 93668633 | d0Mseg1156 | 6711 |
| 0 | 124986350 | 124990400 | 94938081 | 94942255 | d0Mseg1170 | 6712 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 125348250 | 125349850 | 95209971 | 95210989 | d0Mseg1173 | 6713 |
| 0 | 126591250 | 126592900 | 96338747 | 96342353 | d0Mseg1181 | 6714 |
| 0 | 126738250 | 126739450 | 96515899 | 96521050 | d0Mseg1182 | 6715 |
| 0 | 127136000 | 127137750 | 96958145 | 96959898 | d0Mseg1183 | 6716 |
| 0 | 127309150 | 127311100 | 97067208 | 97067837 | d0Mseg1184 | 6717 |
| 0 | 127573000 | 127574700 | 97252973 | 97256101 | d0Mseg1185 | 6718 |
| 0 | 127650050 | 127651700 | 97335209 | 97336831 | d0Mseg1186 | 6719 |
| 0 | 127728000 | 127729800 | 97416576 | 97417848 | d0Mseg1187 | 6720 |
| 0 | 128054100 | 128055850 | 97702907 | 97704933 | d0Mseg1189 | 6721 |
| 0 | 128386750 | 128388450 | 98011360 | 98012327 | d0Mseg1191 | 6722 |
| 0 | 128421550 | 128423350 | 98026625 | 98027329 | d0Mseg1192 | 6723 |
| 0 | 128541000 | 128543000 | 98153780 | 98154681 | d0Mseg1193 | 6724 |
| 0 | 128554500 | 128556200 | 98176607 | 98177200 | d0Mseg1194 | 6725 |
| 0 | 128895350 | 128897000 | 98420777 | 98425614 | d0Mseg1197 | 6726 |
| 0 | 129333950 | 129336300 | 98868946 | 98869357 | d0Mseg1198 | 6727 |
| 0 | 129419100 | 129420750 | 98939503 | 98939769 | d0Mseg1199 | 6728 |
| 0 | 129959400 | 129960500 | 99375776 | 99376091 | d0Mseg1203 | 6729 |
| 0 | 130195200 | 130196750 | 99637105 | 99638248 | d0Mseg1204 | 6730 |
| 0 | 130204800 | 130206600 | 99646054 | 99647626 | d0Mseg1205 | 6731 |
| 0 | 130218450 | 130226750 | 99660339 | 99668308 | d0Mseg1206 | 6732 |
| 0 | 130289950 | 130291600 | 99734427 | 99736686 | d0Mseg1207 | 6733 |
| 0 | 130430550 | 130432400 | 99889879 | 99891230 | d0Mseg1210 | 6734 |
| 0 | 130447400 | 130449200 | 99903304 | 99905140 | d0Mseg1211 | 6735 |
| 0 | 130462700 | 130464300 | 99921423 | 99923033 | d0Mseg1212 | 6736 |
| 0 | 130696700 | 130698350 | 100183556 | 100185633 | d0Mseg1213 | 6737 |
| 0 | 130938150 | 130940950 | 100473406 | 100476707 | d0Mseg1214 | 6738 |
| 0 | 131008150 | 131010000 | 100545375 | 100546418 | d0Mseg1215 | 6739 |
| 0 | 131290750 | 131291800 | 100877742 | 100878801 | d0Mseg1218 | 6740 |
| 0 | 131426400 | 131427850 | 101005754 | 101006338 | d0Mseg1221 | 6741 |
| 0 | 131468850 | 131470800 | 101060331 | 101079314 | d0Mseg1222 | 6742 |
| 0 | 131486050 | 131490050 | 101092954 | 101095762 | d0Mseg1223 | 6743 |
| 0 | 131558550 | 131560250 | 101215897 | 101216526 | d0Mseg1226 | 6744 |
| 0 | 131744200 | 131746500 | 101396423 | 101398365 | d0Mseg1228 | 6745 |
| 0 | 132128400 | 132130250 | 101634963 | 101635181 | d0Mseg1234 | 6746 |
| 0 | 132443300 | 132444950 | 102026471 | 102026806 | d0Mseg1237 | 6747 |
| 0 | 132699650 | 132700900 | 102504962 | 102505385 | d0Mseg1240 | 6748 |
| 0 | 132702150 | 132706250 | 102506557 | 102509611 | d0Mseg1241 | 6749 |
| 0 | 133173150 | 133174550 | 102809378 | 102809962 | d0Mseg1244 | 6750 |
| 0 | 133201850 | 133203600 | 102863759 | 102865597 | d0Mseg1246 | 6751 |
| 0 | 133225300 | 133227050 | 102893114 | 102894204 | d0Mseg1247 | 6752 |
| 0 | 133259450 | 133261350 | 102923252 | 102926503 | d0Mseg1248 | 6753 |
| 0 | 133320000 | 133321650 | 102989190 | 102991061 | d0Mseg1249 | 6754 |
| 0 | 133461350 | 133464150 | 103159141 | 103159839 | d0Mseg1250 | 6755 |
| 0 | 133527350 | 133528800 | 103356849 | 103358437 | d0Mseg1251 | 6756 |
| 0 | 133651350 | 133659100 | 103497403 | 103501568 | d0Mseg1254 | 6757 |
| 0 | 133867150 | 133868900 | 103672189 | 103672769 | d0Mseg1259 | 6758 |
| 0 | 134099100 | 134107350 | 103799771 | 103812994 | d0Mseg1262 | 6759 |
| 0 | 134277700 | 134279100 | 103983757 | 103984495 | d0Mseg1264 | 6760 |
| 0 | 134704850 | 134706650 | 104435078 | 104437310 | d0Mseg1267 | 6761 |
| 0 | 134947050 | 134948700 | 104646829 | 104647833 | d0Mseg1269 | 6762 |
| 0 | 134964050 | 134965750 | 104660717 | 104661858 | d0Mseg1271 | 6763 |
| 0 | 134975950 | 134977150 | 104671819 | 104672746 | d0Mseg1272 | 6764 |
| 0 | 134988850 | 134990650 | 104683910 | 104686108 | d0Mseg1273 | 6765 |
| 0 | 135301150 | 135302700 | 104941956 | 104943185 | d0Mseg1277 | 6766 |
| 0 | 135327950 | 135329550 | 104963624 | 104964823 | d0Mseg1278 | 6767 |
| 0 | 135445450 | 135450300 | 105063274 | 105067884 | d0Mseg1279 | 6768 |
| 0 | 135464700 | 135466450 | 105086269 | 105087503 | d0Mseg1280 | 6769 |
| 0 | 135504950 | 135506500 | 105144680 | 105149446 | d0Mseg1281 | 6770 |
| 0 | 135613150 | 135615050 | 105276126 | 105277717 | d0Mseg1284 | 6771 |
| 0 | 135751150 | 135752450 | 105420847 | 105422046 | d0Mseg1288 | 6772 |
| 0 | 136014900 | 136015950 | 105855188 | 105856078 | d0Mseg1291 | 6773 |
| 0 | 136108300 | 136109900 | 105945940 | 105946917 | d0Mseg1293 | 6774 |
| 0 | 136144900 | 136146850 | 105969711 | 105971612 | d0Mseg1294 | 6775 |
| 0 | 136219200 | 136221300 | 106045583 | 106047409 | d0Mseg1295 | 6776 |
| 0 | 136404100 | 136407250 | 106241425 | 106243936 | d0Mseg1296 | 6777 |
| 0 | 136681900 | 136683600 | 106545632 | 106546670 | d0Mseg1298 | 6778 |
| 0 | 136711950 | 136713450 | 106581560 | 106582257 | d0Mseg1299 | 6779 |
| 0 | 136798700 | 136800050 | 106681941 | 106682647 | d0Mseg1300 | 6780 |
| 0 | 136809900 | 136814900 | 106690547 | 106695325 | d0Mseg1301 | 6781 |
| 0 | 136825150 | 136826950 | 106705878 | 106707101 | d0Mseg1302 | 6782 |
| 0 | 136846800 | 136848700 | 106728011 | 106728776 | d0Mseg1303 | 6783 |
| 0 | 136873950 | 136877750 | 106747501 | 106750911 | d0Mseg1304 | 6784 |
| 0 | 136950200 | 136953900 | 106817595 | 106819913 | d0Mseg1305 | 6785 |
| 0 | 136960100 | 136961800 | 106839200 | 106840176 | d0Mseg1306 | 6786 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 0 | 136965450 | 136971200 | 106843893 | 106850147 | d0Mseg1307 | 6787 |
| 0 | 136987850 | 136989650 | 106861515 | 106861895 | d0Mseg1308 | 6788 |
| 0 | 137044750 | 137046600 | 106919655 | 106921361 | d0Mseg1309 | 6789 |
| 0 | 137109800 | 137111500 | 106993783 | 106995539 | d0Mseg1310 | 6790 |
| 0 | 137131250 | 137136400 | 107016901 | 107021572 | d0Mseg1311 | 6791 |
| 0 | 137198250 | 137201550 | 107068108 | 107072468 | d0Mseg1314 | 6792 |
| 0 | 137234450 | 137236450 | 107103259 | 107106148 | d0Mseg1315 | 6793 |
| 0 | 137269050 | 137270800 | 107145234 | 107147012 | d0Mseg1316 | 6794 |
| 0 | 137272400 | 137274200 | 107148183 | 107150272 | d0Mseg1317 | 6795 |
| 0 | 137344250 | 137345450 | 107222583 | 107223451 | d0Mseg1318 | 6796 |
| 0 | 137418950 | 137420250 | 107272383 | 107273135 | d0Mseg1320 | 6797 |
| 0 | 137475450 | 137477100 | 107324457 | 107324673 | d0Mseg1321 | 6798 |
| 0 | 137509750 | 137511450 | 107360053 | 107361701 | d0Mseg1322 | 6799 |
| 0 | 137674500 | 137676400 | 107472475 | 107473950 | d0Mseg1323 | 6800 |
| 0 | 137699150 | 137700900 | 107491922 | 107494242 | d0Mseg1325 | 6801 |
| 0 | 137765550 | 137767100 | 107555769 | 107556399 | d0Mseg1327 | 6802 |
| 0 | 137884100 | 137885750 | 107652591 | 107654374 | d0Mseg1329 | 6803 |
| 0 | 137901400 | 137903050 | 107670265 | 107672930 | d0Mseg1330 | 6804 |
| 0 | 137907400 | 137909100 | 107680345 | 107682178 | d0Mseg1331 | 6805 |
| 0 | 137913050 | 137914700 | 107686110 | 107687970 | d0Mseg1332 | 6806 |
| 0 | 138094300 | 138098200 | 107914252 | 107916568 | d0Mseg1333 | 6807 |
| 0 | 138128300 | 138129950 | 107943938 | 107945667 | d0Mseg1334 | 6808 |
| 0 | 138148950 | 138150550 | 107967515 | 107970175 | d0Mseg1335 | 6809 |
| 0 | 138155150 | 138162600 | 107974881 | 107982840 | d0Mseg1336 | 6810 |
| 0 | 138186550 | 138188350 | 108049972 | 108050213 | d0Mseg1338 | 6811 |
| 0 | 138365600 | 138367300 | 108432612 | 108434501 | d0Mseg1342 | 6812 |
| 0 | 138523550 | 138525200 | 108619278 | 108621100 | d0Mseg1343 | 6813 |
| 0 | 138545600 | 138547700 | 108641869 | 108643544 | d0Mseg1344 | 6814 |
| 0 | 138662450 | 138664250 | 108779852 | 108781402 | d0Mseg1345 | 6815 |
| 0 | 138738550 | 138740750 | 108866096 | 108868429 | d0Mseg1347 | 6816 |
| 0 | 138882800 | 138884650 | 109036295 | 109036891 | d0Mseg1348 | 6817 |
| 0 | 138972450 | 138974350 | 109132872 | 109133904 | d0Mseg1349 | 6818 |
| 0 | 139112450 | 139116200 | 109240267 | 109246096 | d0Mseg1354 | 6819 |
| 0 | 139247600 | 139249350 | 109393888 | 109394126 | d0Mseg1355 | 6820 |
| 0 | 139305450 | 139307200 | 109451407 | 109453314 | d0Mseg1356 | 6821 |
| 0 | 139340500 | 139341700 | 109499852 | 109502000 | d0Mseg1357 | 6822 |
| 0 | 139392650 | 139393800 | 109552718 | 109553654 | d0Mseg1358 | 6823 |
| 0 | 139401350 | 139403400 | 109561393 | 109563282 | d0Mseg1359 | 6824 |
| 0 | 139494050 | 139496650 | 109657053 | 109659686 | d0Mseg1360 | 6825 |
| 0 | 139514050 | 139515750 | 109674380 | 109676104 | d0Mseg1361 | 6826 |
| 0 | 139555750 | 139557700 | 109714935 | 109716033 | d0Mseg1362 | 6827 |
| 0 | 139720350 | 139721850 | 109917218 | 109918796 | d0Mseg1363 | 6828 |
| 0 | 139827450 | 139829450 | 110038100 | 110040094 | d0Mseg1365 | 6829 |
| 0 | 139962000 | 139964450 | 110195335 | 110197319 | d0Mseg1366 | 6830 |
| 0 | 140171650 | 140173500 | 110409080 | 110411343 | d0Mseg1367 | 6831 |
| 0 | 140236000 | 140237700 | 110487602 | 110489252 | d0Mseg1368 | 6832 |
| 0 | 140323050 | 140324700 | 110597361 | 110599205 | d0Mseg1369 | 6833 |
| 0 | 140336000 | 140337650 | 110614330 | 110616194 | d0Mseg1370 | 6834 |
| 0 | 140956750 | 140958450 | 111191291 | 111195694 | d0Mseg1374 | 6835 |
| 0 | 141121700 | 141124950 | 111324455 | 111327763 | d0Mseg1375 | 6836 |
| 0 | 141143000 | 141144700 | 111339366 | 111340349 | d0Mseg1376 | 6837 |
| 0 | 141781200 | 141783100 | 111921282 | 111922819 | d0Mseg1382 | 6838 |
| 0 | 141847200 | 141848450 | 111986158 | 111987296 | d0Mseg1383 | 6839 |
| 0 | 142126650 | 142128400 | 112290439 | 112291383 | d0Mseg1384 | 6840 |
| 0 | 142137000 | 142138800 | 112318621 | 112319362 | d0Mseg1385 | 6841 |
| 0 | 142421600 | 142423450 | 112599067 | 112600494 | d0Mseg1387 | 6842 |
| 0 | 142755450 | 142757200 | 113011194 | 113012415 | d0Mseg1390 | 6843 |
| 0 | 142997200 | 142998850 | 113319750 | 113320204 | d0Mseg1393 | 6844 |
| 0 | 143059550 | 143061300 | 113385304 | 113387105 | d0Mseg1395 | 6845 |
| 0 | 143231600 | 143233300 | 113661602 | 113662646 | d0Mseg1398 | 6846 |
| 0 | 143393450 | 143395700 | 113815080 | 113817326 | d0Mseg1399 | 6847 |
| 0 | 143396950 | 143401150 | 113818463 | 113821894 | d0Mseg1400 | 6848 |
| 0 | 143449950 | 143451400 | 113901516 | 113902923 | d0Mseg1401 | 6849 |
| 0 | 143577250 | 143578400 | 114039214 | 114045591 | d0Mseg1402 | 6850 |
| 0 | 143931450 | 143933250 | 114391306 | 114393176 | d0Mseg1408 | 6851 |
| 0 | 143977650 | 143979250 | 114461446 | 114462674 | d0Mseg1409 | 6852 |
| 0 | 146168000 | 146169550 | 114737725 | 114738742 | d0Mseg1417 | 6853 |
| 0 | 146280800 | 146282350 | 114538969 | 114540129 | d0Mseg1419 | 6854 |
| 0 | 147116650 | 147118250 | 54929258 | 54933331 | d0Mseg1429 | 6855 |
| 0 | 147797700 | 147798950 | 54195261 | 54195972 | d0Mseg1433 | 6856 |
| 0 | 148422700 | 148424000 | 53467423 | 53467726 | d0Mseg1435 | 6857 |
| 0 | 148428050 | 148429750 | 53462780 | 53464180 | d0Mseg1436 | 6858 |
| 0 | 148577250 | 148580800 | 53348416 | 53352759 | d0Mseg1438 | 6859 |
| 0 | 148788900 | 148790500 | 53097066 | 53098921 | d0Mseg1439 | 6860 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 0 | 149042400 | 149046100 | 9916073 | 9917528 | d0Mseg1440 | 6861 |
| 0 | 149137450 | 149139100 | 9834324 | 9835006 | d0Mseg1441 | 6862 |
| 0 | 149797550 | 149799350 | 56261656 | 56262877 | d0Mseg1446 | 6863 |
| 0 | 149828100 | 149830000 | 56311581 | 56313823 | d0Mseg1447 | 6864 |
| 0 | 149925500 | 149926950 | 56582908 | 56584454 | d0Mseg1449 | 6865 |
| 0 | 150160400 | 150162250 | 56758648 | 56759758 | d0Mseg1451 | 6866 |
| 0 | 150329350 | 150331100 | 57002874 | 57005781 | d0Mseg1453 | 6867 |
| 0 | 151558100 | 151560950 | 9935198 | 9936384 | d0Mseg1464 | 6868 |
| 0 | 151699000 | 151700650 | 23759018 | 23759699 | d0Mseg1465 | 6869 |
| 0 | 151994050 | 151995850 | 23421953 | 23422453 | d0Mseg1467 | 6870 |
| 0 | 152056150 | 152064650 | 23347044 | 23354675 | d0Mseg1468 | 6871 |
| 0 | 152676600 | 152677700 | 22949204 | 22949507 | d0Mseg1473 | 6872 |
| 0 | 152771850 | 152773500 | 22877650 | 22879623 | d0Mseg1474 | 6873 |
| 0 | 152909100 | 152910850 | 22754525 | 22755136 | d0Mseg1475 | 6874 |
| 0 | 153350750 | 153352600 | 22423386 | 22424736 | d0Mseg1477 | 6875 |
| 0 | 154348700 | 154350350 | 21542638 | 21544400 | d0Mseg1482 | 6876 |
| 0 | 154357100 | 154358800 | 21533589 | 21535664 | d0Mseg1483 | 6877 |
| 0 | 154478700 | 154481800 | 21391966 | 21395196 | d0Mseg1484 | 6878 |
| 0 | 154562500 | 154564150 | 21311881 | 21312415 | d0Mseg1487 | 6879 |
| 0 | 155066450 | 155067650 | 20806235 | 20808355 | d0Mseg1491 | 6880 |
| 0 | 155296500 | 155298300 | 20582759 | 20584743 | d0Mseg1494 | 6881 |
| 0 | 155359050 | 155360800 | 20548201 | 20549780 | d0Mseg1496 | 6882 |
| 0 | 155604950 | 155606650 | 20368678 | 20370276 | d0Mseg1498 | 6883 |
| 0 | 155683800 | 155685400 | 20298827 | 20300257 | d0Mseg1499 | 6884 |
| 0 | 155748150 | 155750000 | 20227385 | 20228616 | d0Mseg1500 | 6885 |
| 0 | 155814300 | 155816300 | 20153593 | 20156750 | d0Mseg1501 | 6886 |
| 0 | 155947100 | 155948550 | 20014121 | 20014507 | d0Mseg1503 | 6887 |
| 0 | 156064800 | 156066350 | 19904673 | 19906249 | d0Mseg1505 | 6888 |
| 0 | 156071600 | 156073250 | 19895889 | 19898567 | d0Mseg1506 | 6889 |
| 0 | 156115150 | 156117050 | 19857775 | 19858433 | d0Mseg1507 | 6890 |
| 0 | 156151400 | 156153250 | 19810140 | 19812996 | d0Mseg1508 | 6891 |
| 0 | 156156250 | 156158000 | 19805306 | 19807598 | d0Mseg1509 | 6892 |
| 0 | 156258050 | 156259200 | 19708990 | 19710443 | d0Mseg1510 | 6893 |
| 0 | 156276550 | 156280250 | 19687382 | 19690843 | d0Mseg1511 | 6894 |
| 0 | 156408900 | 156410700 | 19554897 | 19556072 | d0Mseg1512 | 6895 |
| 0 | 156637800 | 156639450 | 19318361 | 19318925 | d0Mseg1513 | 6896 |
| 0 | 156827750 | 156829650 | 19139573 | 19141668 | d0Mseg1514 | 6897 |
| 0 | 156944150 | 156945850 | 18983886 | 18996976 | d0Mseg1515 | 6898 |
| 0 | 156955350 | 156957000 | 18978106 | 18979198 | d0Mseg1516 | 6899 |
| 0 | 156960750 | 156962400 | 18971441 | 18973047 | d0Mseg1517 | 6900 |
| 0 | 157126700 | 157128150 | 18764319 | 18764930 | d0Mseg1518 | 6901 |
| 0 | 157172500 | 157174300 | 18717813 | 18719134 | d0Mseg1519 | 6902 |
| 0 | 157602750 | 157604400 | 18368053 | 18370767 | d0Mseg1523 | 6903 |
| 0 | 157935200 | 157936850 | 18061056 | 18064895 | d0Mseg1526 | 6904 |
| 0 | 157975300 | 157976950 | 18021341 | 18022610 | d0Mseg1527 | 6905 |
| 0 | 157990200 | 157991450 | 18018059 | 18018555 | d0Mseg1528 | 6906 |
| 0 | 158047700 | 158049250 | 17965345 | 17966494 | d0Mseg1529 | 6907 |
| 0 | 158154500 | 158157650 | 17876885 | 17879805 | d0Mseg1530 | 6908 |
| 0 | 158164200 | 158165200 | 17869342 | 17870336 | d0Mseg1531 | 6909 |
| 0 | 158226150 | 158227850 | 17807246 | 17808941 | d0Mseg1532 | 6910 |
| 0 | 158344800 | 158348150 | 17672476 | 17675850 | d0Mseg1533 | 6911 |
| 0 | 158357400 | 158359050 | 17659247 | 17661046 | d0Mseg1534 | 6912 |
| 0 | 158493300 | 158494950 | 17503094 | 17504675 | d0Mseg1535 | 6913 |
| 0 | 158513400 | 158514600 | 17486213 | 17487444 | d0Mseg1536 | 6914 |
| 0 | 158595800 | 158598300 | 17392951 | 17395448 | d0Mseg1537 | 6915 |
| 0 | 158643700 | 158645550 | 17357905 | 17359795 | d0Mseg1538 | 6916 |
| 0 | 159025000 | 159026750 | 17005964 | 17008778 | d0Mseg1540 | 6917 |
| 0 | 159080450 | 159082100 | 16964311 | 16965994 | d0Mseg1542 | 6918 |
| 0 | 159444450 | 159446550 | 16629904 | 16630822 | d0Mseg1543 | 6919 |
| 0 | 159604800 | 159606500 | 16472299 | 16473220 | d0Mseg1544 | 6920 |
| 0 | 159877900 | 159879650 | 16214151 | 16215502 | d0Mseg1545 | 6921 |
| 0 | 160072000 | 160073850 | 16082385 | 16083637 | d0Mseg1546 | 6922 |
| 0 | 160416050 | 160417900 | 15800274 | 15800905 | d0Mseg1549 | 6923 |
| 0 | 160428250 | 160430050 | 15790292 | 15792526 | d0Mseg1550 | 6924 |
| 0 | 160787650 | 160789400 | 15415928 | 15417243 | d0Mseg1552 | 6925 |
| 0 | 160938850 | 160940250 | 15292565 | 15293587 | d0Mseg1553 | 6926 |
| 0 | 160957300 | 160959250 | 15276411 | 15276976 | d0Mseg1554 | 6927 |
| 0 | 161023850 | 161025300 | 15221827 | 15222933 | d0Mseg1555 | 6928 |
| 0 | 161239100 | 161240850 | 15083146 | 15084874 | d0Mseg1556 | 6929 |
| 0 | 161607600 | 161609800 | 14712401 | 14715636 | d0Mseg1558 | 6930 |
| 0 | 161656300 | 161658050 | 14667879 | 14669135 | d0Mseg1559 | 6931 |
| 0 | 161781000 | 161782750 | 14526619 | 14533219 | d0Mseg1560 | 6932 |
| 0 | 161999650 | 162000750 | 14397763 | 14399069 | d0Mseg1563 | 6933 |
| 0 | 162065050 | 162067000 | 14372294 | 14373947 | d0Mseg1564 | 6934 |

TABLE IVB-continued

Mouse Binding Sites with Human Liftovers

| Cell/ Day | Mouse Start | Mouse end | Human start | Human end | Segment name | SEQ ID NO: |
|---|---|---|---|---|---|---|
| 0 | 162119800 | 162120900 | 14339340 | 14340408 | d0Mseg1565 | 6935 |
| 0 | 162591150 | 162592800 | 14059808 | 14063365 | d0Mseg1566 | 6936 |
| 0 | 162675900 | 162679050 | 13954693 | 13957841 | d0Mseg1568 | 6937 |
| 0 | 162784900 | 162786600 | 13831452 | 13833007 | d0Mseg1569 | 6938 |
| 0 | 162806950 | 162808800 | 13805983 | 13807381 | d0Mseg1570 | 6939 |
| 0 | 162861400 | 162863100 | 13767456 | 13768255 | d0Mseg1571 | 6940 |
| 0 | 162958300 | 162959950 | 13662381 | 13664259 | d0Mseg1572 | 6941 |
| 0 | 163218700 | 163220500 | 13393389 | 13394599 | d0Mseg1575 | 6942 |
| 0 | 163289200 | 163290800 | 13351902 | 13352895 | d0Mseg1576 | 6943 |
| 0 | 163769750 | 163770850 | 12883751 | 12884144 | d0Mseg1578 | 6944 |
| 0 | 163963000 | 163964650 | 12690276 | 12691336 | d0Mseg1580 | 6945 |
| 0 | 164002400 | 164006150 | 12655929 | 12658937 | d0Mseg1581 | 6946 |
| 0 | 164355400 | 164357300 | 12338108 | 12340755 | d0Mseg1582 | 6947 |
| 0 | 164554800 | 164556500 | 12161288 | 12161947 | d0Mseg1584 | 6948 |
| 0 | 164560050 | 164562900 | 12154917 | 12157768 | d0Mseg1585 | 6949 |
| 0 | 164576350 | 164578150 | 12148441 | 12149581 | d0Mseg1586 | 6950 |
| 0 | 164858150 | 164859750 | 11917226 | 11921091 | d0Mseg1589 | 6951 |
| 0 | 164865650 | 164866850 | 11910227 | 11910735 | d0Mseg1590 | 6952 |
| 0 | 164917300 | 164919050 | 11886934 | 11887134 | d0Mseg1591 | 6953 |
| 0 | 165193100 | 165194650 | 11713997 | 11715593 | d0Mseg1593 | 6954 |
| 0 | 165230800 | 165236400 | 11680395 | 11685724 | d0Mseg1594 | 6955 |
| 0 | 165241550 | 165243500 | 11672938 | 11674373 | d0Mseg1595 | 6956 |
| 0 | 165263750 | 165265800 | 11652442 | 11652722 | d0Mseg1596 | 6957 |
| 0 | 165328850 | 165330550 | 11588243 | 11590167 | d0Mseg1598 | 6958 |
| 0 | 165333350 | 165335100 | 11583458 | 11584689 | d0Mseg1599 | 6959 |
| 0 | 165379500 | 165381300 | 11535393 | 11544684 | d0Mseg1601 | 6960 |
| 0 | 165499850 | 165501750 | 11421936 | 11423685 | d0Mseg1602 | 6961 |
| 0 | 165557250 | 165559100 | 11361230 | 11363506 | d0Mseg1604 | 6962 |
| 0 | 165655850 | 165658650 | 11272295 | 11276341 | d0Mseg1605 | 6963 |
| 0 | 165659950 | 165661900 | 11269025 | 11271106 | d0Mseg1606 | 6964 |
| 0 | 165713750 | 165715650 | 11176443 | 11178107 | d0Mseg1607 | 6965 |
| 0 | 165722250 | 165724100 | 11170391 | 11171289 | d0Mseg1608 | 6966 |
| 0 | 166188300 | 166189850 | 10728146 | 10729457 | d0Mseg1612 | 6967 |
| 0 | 166195050 | 166196800 | 10724058 | 10724983 | d0Mseg1613 | 6968 |
| 0 | 166317100 | 166319550 | 10586688 | 10589069 | d0Mseg1615 | 6969 |
| 0 | 166384600 | 166386250 | 10509459 | 10511131 | d0Mseg1616 | 6970 |
| 0 | 166416250 | 166418300 | 10452095 | 10461012 | d0Mseg1617 | 6971 |
| 7 | 4919200 | 4920300 | 57160216 | 57160722 | d7Mseg4 | 6972 |
| 7 | 5626950 | 5628900 | 51236461 | 51237600 | d7Mseg11 | 6973 |
| 7 | 5657900 | 5660200 | 51150174 | 51152241 | d7Mseg12 | 6974 |
| 7 | 5748450 | 5749700 | 51076070 | 51076838 | d7Mseg17 | 6975 |
| 7 | 5826100 | 5827650 | 50744939 | 50745432 | d7Mseg19 | 6976 |
| 7 | 5919250 | 5921000 | 50617610 | 50618797 | d7Mseg23 | 6977 |
| 7 | 5968250 | 5969600 | 50569762 | 50571083 | d7Mseg24 | 6978 |
| 7 | 5976300 | 5978850 | 50555318 | 50558012 | d7Mseg25 | 6979 |
| 7 | 6098950 | 6100700 | 50434563 | 50436098 | d7Mseg27 | 6980 |
| 7 | 6308000 | 6309750 | 50262948 | 50264696 | d7Mseg30 | 6981 |
| 7 | 6345300 | 6347250 | 50219848 | 50221873 | d7Mseg31 | 6982 |
| 7 | 6350900 | 6352100 | 50217495 | 50218757 | d7Mseg32 | 6983 |
| 7 | 6353350 | 6359000 | 50210631 | 50215940 | d7Mseg33 | 6984 |
| 7 | 6446650 | 6448650 | 50171668 | 50173248 | d7Mseg34 | 6985 |
| 7 | 6471200 | 6472550 | 50146277 | 50147919 | d7Mseg35 | 6986 |
| 7 | 6486000 | 6487450 | 50131182 | 50131462 | d7Mseg36 | 6987 |
| 7 | 6525650 | 6526650 | 50107802 | 50108249 | d7Mseg39 | 6988 |
| 7 | 6536400 | 6538150 | 50096153 | 50096484 | d7Mseg40 | 6989 |
| 7 | 6585600 | 6586850 | 50051876 | 50052868 | d7Mseg42 | 6990 |
| 7 | 6660300 | 6662050 | 49948999 | 49951180 | d7Mseg44 | 6991 |
| 7 | 6670300 | 6672050 | 49929734 | 49930439 | d7Mseg45 | 6992 |
| 7 | 6680150 | 6681850 | 49923698 | 49924970 | d7Mseg46 | 6993 |
| 7 | 6683750 | 6685450 | 49921526 | 49923467 | d7Mseg47 | 6994 |
| 7 | 6728500 | 6730300 | 49864177 | 49864647 | d7Mseg52 | 6995 |
| 7 | 6747350 | 6748450 | 49845184 | 49846559 | d7Mseg53 | 6996 |
| 7 | 6810850 | 6812050 | 49780895 | 49781541 | d7Mseg56 | 6997 |
| 7 | 6816950 | 6818100 | 49774742 | 49776244 | d7Mseg57 | 6998 |
| 7 | 6828500 | 6830200 | 49763406 | 49764017 | d7Mseg58 | 6999 |
| 7 | 6875550 | 6876800 | 49715264 | 49716838 | d7Mseg59 | 7000 |
| 7 | 6891050 | 6892950 | 49690808 | 49693591 | d7Mseg61 | 7001 |
| 7 | 6895500 | 6897000 | 49686587 | 49688141 | d7Mseg62 | 7002 |
| 7 | 6928500 | 6932850 | 49658144 | 49664262 | d7Mseg65 | 7003 |
| 7 | 6937850 | 6939600 | 49657320 | 49657656 | d7Mseg66 | 7004 |
| 7 | 6952250 | 6954400 | 49642648 | 49644647 | d7Mseg67 | 7005 |
| 7 | 6955550 | 6957350 | 49638826 | 49641464 | d7Mseg68 | 7006 |
| 7 | 6963750 | 6965650 | 49628587 | 49629146 | d7Mseg69 | 7007 |
| 7 | 6991300 | 6995150 | 49608034 | 49612678 | d7Mseg71 | 7008 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 7046200 | 7047250 | 49525191 | 49525883 | d7Mseg73 | 7009 |
| 7 | 7048850 | 7050400 | 49519739 | 49522241 | d7Mseg74 | 7010 |
| 7 | 7066600 | 7068400 | 49489990 | 49490861 | d7Mseg75 | 7011 |
| 7 | 7132850 | 7137250 | 49143045 | 49147196 | d7Mseg82 | 7012 |
| 7 | 7184950 | 7189050 | 49084517 | 49089284 | d7Mseg83 | 7013 |
| 7 | 7191200 | 7192550 | 49081908 | 49083307 | d7Mseg84 | 7014 |
| 7 | 7202000 | 7203350 | 49071000 | 49072200 | d7Mseg85 | 7015 |
| 7 | 7224100 | 7226000 | 49047902 | 49048316 | d7Mseg86 | 7016 |
| 7 | 7235300 | 7236750 | 49040281 | 49041666 | d7Mseg87 | 7017 |
| 7 | 7243800 | 7245550 | 49031105 | 49033077 | d7Mseg88 | 7018 |
| 7 | 7247400 | 7252650 | 49022108 | 49029321 | d7Mseg89 | 7019 |
| 7 | 7312600 | 7314300 | 48921702 | 48922985 | d7Mseg91 | 7020 |
| 7 | 7339050 | 7341000 | 48899815 | 48901760 | d7Mseg93 | 7021 |
| 7 | 7365650 | 7367450 | 48858339 | 48860456 | d7Mseg95 | 7022 |
| 7 | 7387900 | 7390200 | 48837395 | 48839300 | d7Mseg96 | 7023 |
| 7 | 7391350 | 7392600 | 48834448 | 48835534 | d7Mseg97 | 7024 |
| 7 | 7400300 | 7401900 | 48825746 | 48827390 | d7Mseg98 | 7025 |
| 7 | 7412700 | 7414150 | 48819326 | 48821035 | d7Mseg99 | 7026 |
| 7 | 7418000 | 7419950 | 48814126 | 48816442 | d7Mseg100 | 7027 |
| 7 | 7440000 | 7441800 | 48795210 | 48796608 | d7Mseg101 | 7028 |
| 7 | 7451100 | 7452750 | 48779299 | 48780881 | d7Mseg102 | 7029 |
| 7 | 7454750 | 7456800 | 48775061 | 48776976 | d7Mseg103 | 7030 |
| 7 | 7463050 | 7464950 | 48766679 | 48767097 | d7Mseg104 | 7031 |
| 7 | 7475700 | 7477250 | 48754429 | 48755835 | d7Mseg105 | 7032 |
| 7 | 7497150 | 7506950 | 48683656 | 48693840 | d7Mseg106 | 7033 |
| 7 | 7522550 | 7524350 | 48661089 | 48663231 | d7Mseg107 | 7034 |
| 7 | 7585350 | 7587000 | 48627487 | 48629164 | d7Mseg110 | 7035 |
| 7 | 7593400 | 7596300 | 48620066 | 48623525 | d7Mseg111 | 7036 |
| 7 | 7708050 | 7709850 | 48455983 | 48457509 | d7Mseg120 | 7037 |
| 7 | 7734300 | 7736350 | 48415234 | 48416872 | d7Mseg122 | 7038 |
| 7 | 7752200 | 7753550 | 48397691 | 48398967 | d7Mseg123 | 7039 |
| 7 | 7769500 | 7771450 | 48378718 | 48380778 | d7Mseg124 | 7040 |
| 7 | 7782550 | 7784550 | 48365855 | 48368480 | d7Mseg125 | 7041 |
| 7 | 7786050 | 7787900 | 48363329 | 48364503 | d7Mseg126 | 7042 |
| 7 | 7848100 | 7849900 | 48325341 | 48327201 | d7Mseg128 | 7043 |
| 7 | 8157250 | 8158850 | 47935546 | 47936172 | d7Mseg135 | 7044 |
| 7 | 8380200 | 8381750 | 48213767 | 48214988 | d7Mseg137 | 7045 |
| 7 | 8775150 | 8778300 | 37429655 | 37431928 | d7Mseg139 | 7046 |
| 7 | 8849400 | 8851350 | 37544530 | 37546944 | d7Mseg140 | 7047 |
| 7 | 8856650 | 8858250 | 37551344 | 37552816 | d7Mseg141 | 7048 |
| 7 | 9109150 | 9110850 | 37594744 | 37596273 | d7Mseg143 | 7049 |
| 7 | 9239450 | 9240700 | 37706179 | 37707339 | d7Mseg145 | 7050 |
| 7 | 9324450 | 9326300 | 37764706 | 37766660 | d7Mseg147 | 7051 |
| 7 | 9353300 | 9354950 | 37791612 | 37791830 | d7Mseg148 | 7052 |
| 7 | 9447500 | 9449300 | 37875007 | 37875775 | d7Mseg151 | 7053 |
| 7 | 9459500 | 9461200 | 37885299 | 37890916 | d7Mseg152 | 7054 |
| 7 | 9491700 | 9493550 | 37931961 | 37933104 | d7Mseg153 | 7055 |
| 7 | 9644450 | 9645850 | 38031037 | 38032469 | d7Mseg154 | 7056 |
| 7 | 9657250 | 9659000 | 38042981 | 38044301 | d7Mseg155 | 7057 |
| 7 | 9670650 | 9672300 | 38055423 | 38056959 | d7Mseg156 | 7058 |
| 7 | 9720800 | 9722100 | 38099711 | 38100267 | d7Mseg158 | 7059 |
| 7 | 9730750 | 9732050 | 38116930 | 38117426 | d7Mseg159 | 7060 |
| 7 | 9777950 | 9779250 | 38163267 | 38164002 | d7Mseg160 | 7061 |
| 7 | 9824350 | 9827850 | 38207031 | 38209915 | d7Mseg161 | 7062 |
| 7 | 9890700 | 9892450 | 38271696 | 38274039 | d7Mseg162 | 7063 |
| 7 | 9912400 | 9914300 | 38285245 | 38288555 | d7Mseg164 | 7064 |
| 7 | 9944800 | 9946350 | 38315820 | 38316547 | d7Mseg165 | 7065 |
| 7 | 9997500 | 9998500 | 38352389 | 38352638 | d7Mseg168 | 7066 |
| 7 | 10002350 | 10004250 | 38355720 | 38358180 | d7Mseg169 | 7067 |
| 7 | 10060250 | 10063600 | 38418377 | 38422130 | d7Mseg170 | 7068 |
| 7 | 10084950 | 10086050 | 38446820 | 38447963 | d7Mseg171 | 7069 |
| 7 | 10168100 | 10170150 | 38541308 | 38544218 | d7Mseg172 | 7070 |
| 7 | 10203850 | 10205850 | 38591107 | 38591584 | d7Mseg173 | 7071 |
| 7 | 10226400 | 10227450 | 38611454 | 38613048 | d7Mseg174 | 7072 |
| 7 | 10281150 | 10284050 | 38650920 | 38652786 | d7Mseg175 | 7073 |
| 7 | 10294100 | 10296950 | 38662899 | 38665833 | d7Mseg176 | 7074 |
| 7 | 10389250 | 10390700 | 38768023 | 38771332 | d7Mseg177 | 7075 |
| 7 | 10397150 | 10399350 | 38775666 | 38778304 | d7Mseg178 | 7076 |
| 7 | 10418750 | 10419900 | 38799248 | 38800576 | d7Mseg179 | 7077 |
| 7 | 10430700 | 10432300 | 38818074 | 38820660 | d7Mseg180 | 7078 |
| 7 | 10435150 | 10437000 | 38825619 | 38826855 | d7Mseg181 | 7079 |
| 7 | 10479200 | 10480700 | 38868554 | 38870645 | d7Mseg182 | 7080 |
| 7 | 10519400 | 10521250 | 38893561 | 38895789 | d7Mseg183 | 7081 |
| 7 | 10539100 | 10540750 | 38899527 | 38901207 | d7Mseg184 | 7082 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 10569100 | 10571100 | 38923681 | 38925811 | d7Mseg185 | 7083 |
| 7 | 10572450 | 10573450 | 38926904 | 38927597 | d7Mseg186 | 7084 |
| 7 | 10625250 | 10626450 | 38979108 | 38981312 | d7Mseg188 | 7085 |
| 7 | 10637200 | 10639050 | 38983928 | 38985478 | d7Mseg189 | 7086 |
| 7 | 10652650 | 10654550 | 38994641 | 38996417 | d7Mseg190 | 7087 |
| 7 | 10664350 | 10666100 | 39008576 | 39010042 | d7Mseg191 | 7088 |
| 7 | 10676000 | 10677500 | 39019149 | 39020705 | d7Mseg192 | 7089 |
| 7 | 10679900 | 10684450 | 39023735 | 39028517 | d7Mseg193 | 7090 |
| 7 | 10710850 | 10713950 | 39058972 | 39061038 | d7Mseg194 | 7091 |
| 7 | 10773550 | 10775350 | 39102800 | 39104320 | d7Mseg196 | 7092 |
| 7 | 10786800 | 10788450 | 39117537 | 39118597 | d7Mseg197 | 7093 |
| 7 | 10832450 | 10837400 | 39169692 | 39173123 | d7Mseg199 | 7094 |
| 7 | 10838450 | 10839750 | 39173732 | 39174552 | d7Mseg200 | 7095 |
| 7 | 10929250 | 10931150 | 39245592 | 39246809 | d7Mseg201 | 7096 |
| 7 | 10938550 | 10941850 | 39253468 | 39256612 | d7Mseg202 | 7097 |
| 7 | 10960350 | 10961750 | 39275115 | 39275792 | d7Mseg203 | 7098 |
| 7 | 10988400 | 10989700 | 39306374 | 39307684 | d7Mseg204 | 7099 |
| 7 | 11021950 | 11023600 | 39337369 | 39338594 | d7Mseg206 | 7100 |
| 7 | 11028900 | 11030600 | 39342102 | 39342959 | d7Mseg207 | 7101 |
| 7 | 11051300 | 11052550 | 39361046 | 39362068 | d7Mseg208 | 7102 |
| 7 | 11058200 | 11059250 | 39366332 | 39367121 | d7Mseg209 | 7103 |
| 7 | 11064800 | 11066500 | 39372179 | 39373276 | d7Mseg210 | 7104 |
| 7 | 11068300 | 11072800 | 39375066 | 39379407 | d7Mseg211 | 7105 |
| 7 | 11090550 | 11091550 | 39396438 | 39397330 | d7Mseg212 | 7106 |
| 7 | 11115550 | 11116750 | 39424110 | 39425012 | d7Mseg213 | 7107 |
| 7 | 11162050 | 11163850 | 39467640 | 39469169 | d7Mseg214 | 7108 |
| 7 | 11176250 | 11177400 | 39490538 | 39491203 | d7Mseg215 | 7109 |
| 7 | 11187100 | 11188550 | 39499396 | 39499576 | d7Mseg216 | 7110 |
| 7 | 11191950 | 11193200 | 39501963 | 39502500 | d7Mseg217 | 7111 |
| 7 | 11197900 | 11199750 | 39504268 | 39505878 | d7Mseg218 | 7112 |
| 7 | 11208250 | 11210100 | 39512928 | 39514596 | d7Mseg219 | 7113 |
| 7 | 11212150 | 11213550 | 39516204 | 39517585 | d7Mseg220 | 7114 |
| 7 | 11232050 | 11233750 | 39537141 | 39538884 | d7Mseg221 | 7115 |
| 7 | 11237650 | 11247250 | 39544480 | 39551310 | d7Mseg222 | 7116 |
| 7 | 11252400 | 11253650 | 39560450 | 39561655 | d7Mseg223 | 7117 |
| 7 | 11358400 | 11359950 | 39654968 | 39656319 | d7Mseg225 | 7118 |
| 7 | 11371200 | 11373400 | 39667213 | 39668810 | d7Mseg226 | 7119 |
| 7 | 11374650 | 11376900 | 39670260 | 39672213 | d7Mseg227 | 7120 |
| 7 | 11378700 | 11386050 | 39674037 | 39682459 | d7Mseg228 | 7121 |
| 7 | 11416400 | 11417400 | 39714651 | 39715661 | d7Mseg229 | 7122 |
| 7 | 11421800 | 11423650 | 39719104 | 39720500 | d7Mseg230 | 7123 |
| 7 | 11446100 | 11450800 | 39742764 | 39746068 | d7Mseg231 | 7124 |
| 7 | 11459800 | 11461250 | 39754970 | 39756487 | d7Mseg232 | 7125 |
| 7 | 11490400 | 11492200 | 39784048 | 39785370 | d7Mseg233 | 7126 |
| 7 | 11495000 | 11496600 | 39788283 | 39789511 | d7Mseg234 | 7127 |
| 7 | 11567500 | 11571150 | 39854650 | 39859973 | d7Mseg235 | 7128 |
| 7 | 11574050 | 11589650 | 39863015 | 39879253 | d7Mseg236 | 7129 |
| 7 | 11617850 | 11620050 | 39915391 | 39917570 | d7Mseg238 | 7130 |
| 7 | 11642000 | 11673350 | 39941129 | 39972450 | d7Mseg239 | 7131 |
| 7 | 11675550 | 11677300 | 39976333 | 39977956 | d7Mseg240 | 7132 |
| 7 | 11695450 | 11696850 | 39995907 | 39997208 | d7Mseg242 | 7133 |
| 7 | 11698650 | 11720400 | 39999141 | 40019359 | d7Mseg243 | 7134 |
| 7 | 11721450 | 11722850 | 40021692 | 40022803 | d7Mseg244 | 7135 |
| 7 | 11726100 | 11739000 | 40024406 | 40037420 | d7Mseg245 | 7136 |
| 7 | 11760250 | 11761950 | 40054618 | 40055714 | d7Mseg247 | 7137 |
| 7 | 11801050 | 11802800 | 40107276 | 40107980 | d7Mseg248 | 7138 |
| 7 | 11833300 | 11834300 | 40128653 | 40128938 | d7Mseg249 | 7139 |
| 7 | 11838450 | 11839900 | 40135692 | 40136444 | d7Mseg250 | 7140 |
| 7 | 11843050 | 11844200 | 40138318 | 40138753 | d7Mseg251 | 7141 |
| 7 | 11863000 | 11868200 | 40157276 | 40160609 | d7Mseg252 | 7142 |
| 7 | 11883950 | 11885700 | 40181571 | 40182123 | d7Mseg253 | 7143 |
| 7 | 11932600 | 11934150 | 40239920 | 40240785 | d7Mseg255 | 7144 |
| 7 | 11946300 | 11950100 | 40248967 | 40253015 | d7Mseg256 | 7145 |
| 7 | 11977700 | 11980200 | 40280783 | 40281602 | d7Mseg258 | 7146 |
| 7 | 12002700 | 12004650 | 40303252 | 40305380 | d7Mseg259 | 7147 |
| 7 | 12019850 | 12022050 | 40319011 | 40319811 | d7Mseg260 | 7148 |
| 7 | 12041400 | 12043050 | 40331180 | 40332263 | d7Mseg262 | 7149 |
| 7 | 12049600 | 12051000 | 40339085 | 40341064 | d7Mseg263 | 7150 |
| 7 | 12052750 | 12054400 | 40343345 | 40344750 | d7Mseg264 | 7151 |
| 7 | 12061950 | 12063350 | 40349057 | 40350009 | d7Mseg265 | 7152 |
| 7 | 12090500 | 12092350 | 40377973 | 40380095 | d7Mseg266 | 7153 |
| 7 | 12232600 | 12234150 | 40486843 | 40487915 | d7Mseg267 | 7154 |
| 7 | 12310600 | 12312200 | 40566770 | 40567505 | d7Mseg269 | 7155 |
| 7 | 12338300 | 12340450 | 40594156 | 40596414 | d7Mseg270 | 7156 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 12347950 | 12349600 | 40604159 | 40604615 | d7Mseg271 | 7157 |
| 7 | 12369900 | 12371500 | 40606233 | 40606815 | d7Mseg272 | 7158 |
| 7 | 12423300 | 12425350 | 40712570 | 40713485 | d7Mseg273 | 7159 |
| 7 | 12435350 | 12437200 | 40731055 | 40732055 | d7Mseg274 | 7160 |
| 7 | 12522600 | 12524250 | 40789135 | 40791339 | d7Mseg280 | 7161 |
| 7 | 12569750 | 12571500 | 40859418 | 40861263 | d7Mseg281 | 7162 |
| 7 | 12581500 | 12584750 | 40873621 | 40874134 | d7Mseg282 | 7163 |
| 7 | 12603250 | 12604900 | 40888184 | 40889457 | d7Mseg284 | 7164 |
| 7 | 12648150 | 12650200 | 40944126 | 40946037 | d7Mseg286 | 7165 |
| 7 | 12656000 | 12657100 | 40950910 | 40951267 | d7Mseg287 | 7166 |
| 7 | 12811500 | 12815100 | 41147804 | 41148733 | d7Mseg290 | 7167 |
| 7 | 12948050 | 12949450 | 41260825 | 41264696 | d7Mseg295 | 7168 |
| 7 | 13055650 | 13056800 | 41316705 | 41318489 | d7Mseg298 | 7169 |
| 7 | 13062200 | 13066850 | 41329525 | 41335673 | d7Mseg299 | 7170 |
| 7 | 13069500 | 13071400 | 41338104 | 41340490 | d7Mseg300 | 7171 |
| 7 | 13073650 | 13074650 | 41342772 | 41343281 | d7Mseg301 | 7172 |
| 7 | 13182350 | 13184100 | 41493335 | 41493765 | d7Mseg302 | 7173 |
| 7 | 13193700 | 13194750 | 41520244 | 41521169 | d7Mseg303 | 7174 |
| 7 | 13212100 | 13215400 | 41550721 | 41553690 | d7Mseg304 | 7175 |
| 7 | 13235900 | 13237400 | 41579472 | 41580366 | d7Mseg305 | 7176 |
| 7 | 13239550 | 13241650 | 41583548 | 41585092 | d7Mseg306 | 7177 |
| 7 | 13289250 | 13291300 | 41643312 | 41645899 | d7Mseg307 | 7178 |
| 7 | 13294150 | 13295850 | 41648292 | 41651109 | d7Mseg308 | 7179 |
| 7 | 13317450 | 13319100 | 41666420 | 41674580 | d7Mseg309 | 7180 |
| 7 | 13414900 | 13415950 | 41770688 | 41772438 | d7Mseg310 | 7181 |
| 7 | 13417000 | 13418800 | 41773924 | 41778067 | d7Mseg311 | 7182 |
| 7 | 13422100 | 13425750 | 41781169 | 41784742 | d7Mseg312 | 7183 |
| 7 | 13433750 | 13435550 | 41901773 | 41902195 | d7Mseg313 | 7184 |
| 7 | 13466700 | 13468450 | 41811104 | 41813067 | d7Mseg315 | 7185 |
| 7 | 13501800 | 13503300 | 41856146 | 41856869 | d7Mseg316 | 7186 |
| 7 | 13642200 | 13644000 | 41930439 | 41931106 | d7Mseg317 | 7187 |
| 7 | 13715550 | 13716700 | 41969408 | 41970649 | d7Mseg318 | 7188 |
| 7 | 13844250 | 13846050 | 42068049 | 42069560 | d7Mseg320 | 7189 |
| 7 | 13853450 | 13854850 | 42076961 | 42077776 | d7Mseg321 | 7190 |
| 7 | 13926150 | 13927150 | 42131618 | 42132033 | d7Mseg322 | 7191 |
| 7 | 13945150 | 13946700 | 42148562 | 42149286 | d7Mseg323 | 7192 |
| 7 | 14852250 | 14853750 | 42730771 | 42734853 | d7Mseg327 | 7193 |
| 7 | 15822650 | 15824200 | 43325725 | 43326563 | d7Mseg332 | 7194 |
| 7 | 16161900 | 16163300 | 43488079 | 43488763 | d7Mseg336 | 7195 |
| 7 | 16195350 | 16197100 | 43513805 | 43515723 | d7Mseg337 | 7196 |
| 7 | 16381150 | 16382150 | 43731901 | 43732198 | d7Mseg338 | 7197 |
| 7 | 16462950 | 16464350 | 43808335 | 43809503 | d7Mseg339 | 7198 |
| 7 | 16482850 | 16484150 | 43826920 | 43828218 | d7Mseg340 | 7199 |
| 7 | 16527800 | 16529350 | 43864258 | 43865486 | d7Mseg341 | 7200 |
| 7 | 16552300 | 16553450 | 43881947 | 43882897 | d7Mseg342 | 7201 |
| 7 | 16575400 | 16577150 | 43901708 | 43903520 | d7Mseg344 | 7202 |
| 7 | 16582150 | 16583800 | 43906988 | 43908657 | d7Mseg345 | 7203 |
| 7 | 16681850 | 16683350 | 43977637 | 43978568 | d7Mseg346 | 7204 |
| 7 | 16746500 | 16748600 | 44046438 | 44048611 | d7Mseg347 | 7205 |
| 7 | 16819050 | 16820700 | 44131566 | 44132079 | d7Mseg348 | 7206 |
| 7 | 16988650 | 16989750 | 44253170 | 44253353 | d7Mseg351 | 7207 |
| 7 | 17064900 | 17066300 | 44338445 | 44338815 | d7Mseg352 | 7208 |
| 7 | 17142450 | 17143700 | 44394022 | 44396420 | d7Mseg354 | 7209 |
| 7 | 17147650 | 17149850 | 44400354 | 44402597 | d7Mseg355 | 7210 |
| 7 | 17261500 | 17263250 | 44481793 | 44482972 | d7Mseg357 | 7211 |
| 7 | 17278350 | 17279950 | 44503095 | 44503525 | d7Mseg358 | 7212 |
| 7 | 17283050 | 17284700 | 44507655 | 44508039 | d7Mseg359 | 7213 |
| 7 | 18036550 | 18038200 | 45058417 | 45059889 | d7Mseg362 | 7214 |
| 7 | 18452800 | 18454350 | 45368150 | 45369336 | d7Mseg365 | 7215 |
| 7 | 18731250 | 18732950 | 45613816 | 45615723 | d7Mseg366 | 7216 |
| 7 | 18849650 | 18851250 | 45738248 | 45744907 | d7Mseg367 | 7217 |
| 7 | 18891650 | 18893150 | 45767561 | 45769610 | d7Mseg368 | 7218 |
| 7 | 19598100 | 19599850 | 46414440 | 46415684 | d7Mseg371 | 7219 |
| 7 | 19635850 | 19639100 | 46432902 | 46435740 | d7Mseg374 | 7220 |
| 7 | 19693100 | 19694200 | 46476607 | 46477107 | d7Mseg377 | 7221 |
| 7 | 19867400 | 19869550 | 46617058 | 46619162 | d7Mseg379 | 7222 |
| 7 | 19987450 | 19988450 | 46759672 | 46760964 | d7Mseg381 | 7223 |
| 7 | 20001050 | 20006900 | 46770003 | 46775398 | d7Mseg382 | 7224 |
| 7 | 20133150 | 20134700 | 46949051 | 46949237 | d7Mseg387 | 7225 |
| 7 | 20138900 | 20140300 | 46952547 | 46958116 | d7Mseg388 | 7226 |
| 7 | 20193650 | 20196400 | 47003141 | 47006163 | d7Mseg391 | 7227 |
| 7 | 20233200 | 20236300 | 47049742 | 47051013 | d7Mseg392 | 7228 |
| 7 | 20245850 | 20247250 | 47058479 | 47060229 | d7Mseg393 | 7229 |
| 7 | 20294250 | 20296200 | 47103171 | 47106480 | d7Mseg394 | 7230 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 20354150 | 20355950 | 47229058 | 47230076 | d7Mseg397 | 7231 |
| 7 | 20445800 | 20447000 | 47439532 | 47441360 | d7Mseg398 | 7232 |
| 7 | 20450950 | 20454550 | 47445473 | 47447504 | d7Mseg399 | 7233 |
| 7 | 20517100 | 20518950 | 47499377 | 47500949 | d7Mseg400 | 7234 |
| 7 | 20538000 | 20539700 | 47517836 | 47518881 | d7Mseg401 | 7235 |
| 7 | 20691650 | 20693300 | 47966246 | 47967479 | d7Mseg405 | 7236 |
| 7 | 20696050 | 20697700 | 47969860 | 47972005 | d7Mseg406 | 7237 |
| 7 | 20891950 | 20893000 | 115009363 | 115009510 | d7Mseg412 | 7238 |
| 7 | 21127250 | 21128250 | 115396570 | 115397412 | d7Mseg417 | 7239 |
| 7 | 21131650 | 21133000 | 115398546 | 115399304 | d7Mseg418 | 7240 |
| 7 | 21202600 | 21204400 | 115494915 | 115495182 | d7Mseg420 | 7241 |
| 7 | 21233100 | 21234900 | 115516513 | 115516900 | d7Mseg421 | 7242 |
| 7 | 21292700 | 21294650 | 115568307 | 115570380 | d7Mseg425 | 7243 |
| 7 | 21436250 | 21437800 | 115681925 | 115682289 | d7Mseg428 | 7244 |
| 7 | 22387850 | 22388950 | 116649096 | 116649382 | d7Mseg437 | 7245 |
| 7 | 22571250 | 22572850 | 116821470 | 116822793 | d7Mseg439 | 7246 |
| 7 | 22837700 | 22839200 | 117078647 | 117079978 | d7Mseg440 | 7247 |
| 7 | 22935000 | 22937600 | 117244072 | 117246963 | d7Mseg441 | 7248 |
| 7 | 22941050 | 22942750 | 117249549 | 117251350 | d7Mseg442 | 7249 |
| 7 | 23381300 | 23382650 | 117582148 | 117583490 | d7Mseg446 | 7250 |
| 7 | 23395650 | 23396900 | 117630091 | 117630424 | d7Mseg447 | 7251 |
| 7 | 33386350 | 33387650 | 117593398 | 117593729 | d7Mseg459 | 7252 |
| 7 | 33428350 | 33432700 | 117629279 | 117633627 | d7Mseg461 | 7253 |
| 7 | 33484000 | 33485450 | 117676445 | 117677328 | d7Mseg462 | 7254 |
| 7 | 33575050 | 33576650 | 117775756 | 117776815 | d7Mseg463 | 7255 |
| 7 | 33647150 | 33648600 | 117857986 | 117859061 | d7Mseg464 | 7256 |
| 7 | 33668750 | 33669800 | 117878823 | 117879810 | d7Mseg465 | 7257 |
| 7 | 33672750 | 33673950 | 117883334 | 117883830 | d7Mseg466 | 7258 |
| 7 | 33704450 | 33705450 | 117919442 | 117920997 | d7Mseg468 | 7259 |
| 7 | 33730600 | 33732100 | 117954118 | 117954666 | d7Mseg469 | 7260 |
| 7 | 33737800 | 33739550 | 117959581 | 117961051 | d7Mseg470 | 7261 |
| 7 | 33773400 | 33774550 | 117995961 | 117997013 | d7Mseg472 | 7262 |
| 7 | 33780800 | 33782750 | 118004575 | 118006522 | d7Mseg473 | 7263 |
| 7 | 33827600 | 33829800 | 118080596 | 118084083 | d7Mseg474 | 7264 |
| 7 | 33855600 | 33857800 | 118095782 | 118096900 | d7Mseg477 | 7265 |
| 7 | 33862700 | 33871850 | 118101866 | 118111814 | d7Mseg478 | 7266 |
| 7 | 33873450 | 33875200 | 118113897 | 118116777 | d7Mseg479 | 7267 |
| 7 | 33898700 | 33900300 | 118148269 | 118150073 | d7Mseg480 | 7268 |
| 7 | 33920300 | 33921600 | 118172291 | 118172812 | d7Mseg482 | 7269 |
| 7 | 33975600 | 33977150 | 118227046 | 118229060 | d7Mseg484 | 7270 |
| 7 | 34031750 | 34033500 | 118257496 | 118264547 | d7Mseg485 | 7271 |
| 7 | 34052700 | 34054400 | 118283650 | 118286784 | d7Mseg486 | 7272 |
| 7 | 34067300 | 34068850 | 118305035 | 118305865 | d7Mseg487 | 7273 |
| 7 | 34090800 | 34093000 | 118323795 | 118325483 | d7Mseg488 | 7274 |
| 7 | 34108000 | 34109600 | 118338209 | 118340743 | d7Mseg489 | 7275 |
| 7 | 34136250 | 34139900 | 118368672 | 118372101 | d7Mseg490 | 7276 |
| 7 | 34158350 | 34160000 | 118388420 | 118390110 | d7Mseg491 | 7277 |
| 7 | 34184100 | 34185750 | 118406356 | 118407906 | d7Mseg492 | 7278 |
| 7 | 34228000 | 34229600 | 118458424 | 118458708 | d7Mseg494 | 7279 |
| 7 | 34353300 | 34354950 | 118625326 | 118626697 | d7Mseg495 | 7280 |
| 7 | 34403300 | 34405050 | 118693657 | 118699484 | d7Mseg496 | 7281 |
| 7 | 34414150 | 34417000 | 118708339 | 118710452 | d7Mseg497 | 7282 |
| 7 | 34419600 | 34421400 | 118713662 | 118715210 | d7Mseg498 | 7283 |
| 7 | 34433800 | 34435500 | 118728431 | 118731317 | d7Mseg499 | 7284 |
| 7 | 34441550 | 34443350 | 118738473 | 118740315 | d7Mseg500 | 7285 |
| 7 | 34501550 | 34504600 | 118795625 | 118796773 | d7Mseg502 | 7286 |
| 7 | 34522900 | 34524600 | 118819332 | 118821047 | d7Mseg503 | 7287 |
| 7 | 34527100 | 34529100 | 118824399 | 118826793 | d7Mseg504 | 7288 |
| 7 | 34531600 | 34533800 | 118829603 | 118834092 | d7Mseg505 | 7289 |
| 7 | 34550400 | 34551750 | 118859419 | 118861475 | d7Mseg507 | 7290 |
| 7 | 34564100 | 34566100 | 118869106 | 118869399 | d7Mseg508 | 7291 |
| 7 | 34587000 | 34591300 | 118890936 | 118896264 | d7Mseg511 | 7292 |
| 7 | 34624750 | 34626550 | 118925117 | 118925935 | d7Mseg514 | 7293 |
| 7 | 34648750 | 34650650 | 118985452 | 118987309 | d7Mseg515 | 7294 |
| 7 | 34673650 | 34675350 | 119071240 | 119071966 | d7Mseg517 | 7295 |
| 7 | 34702450 | 34704050 | 119037211 | 119037689 | d7Mseg518 | 7296 |
| 7 | 34731800 | 34733550 | 119003071 | 119005156 | d7Mseg519 | 7297 |
| 7 | 34827500 | 34829300 | 119126327 | 119126654 | d7Mseg520 | 7298 |
| 7 | 35209150 | 35212350 | 119255084 | 119257269 | d7Mseg534 | 7299 |
| 7 | 35228400 | 35230250 | 103497232 | 103497572 | d7Mseg536 | 7300 |
| 7 | 35455350 | 35457350 | 119370616 | 119371100 | d7Mseg546 | 7301 |
| 7 | 35463200 | 35464950 | 119252585 | 119254350 | d7Mseg547 | 7302 |
| 7 | 35511900 | 35513750 | 119071822 | 119072627 | d7Mseg549 | 7303 |
| 7 | 35542250 | 35544050 | 119383881 | 119385797 | d7Mseg552 | 7304 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 35564450 | 35566250 | 119404045 | 119405506 | d7Mseg553 | 7305 |
| 7 | 35584500 | 35586200 | 119424706 | 119425002 | d7Mseg554 | 7306 |
| 7 | 35591750 | 35593000 | 119430294 | 119431616 | d7Mseg555 | 7307 |
| 7 | 35602250 | 35609250 | 119441828 | 119448975 | d7Mseg556 | 7308 |
| 7 | 35735200 | 35737100 | 119553661 | 119554103 | d7Mseg560 | 7309 |
| 7 | 35825700 | 35827700 | 119619292 | 119620676 | d7Mseg562 | 7310 |
| 7 | 35869400 | 35871050 | 119641379 | 119642065 | d7Mseg565 | 7311 |
| 7 | 35896800 | 35898250 | 119672193 | 119672859 | d7Mseg566 | 7312 |
| 7 | 35945450 | 35947350 | 119725232 | 119726155 | d7Mseg568 | 7313 |
| 7 | 35960900 | 35962650 | 119742375 | 119742750 | d7Mseg569 | 7314 |
| 7 | 35973250 | 35974650 | 119751898 | 119752609 | d7Mseg570 | 7315 |
| 7 | 35982450 | 35984200 | 119758334 | 119759895 | d7Mseg571 | 7316 |
| 7 | 36039550 | 36042550 | 119842373 | 119842993 | d7Mseg573 | 7317 |
| 7 | 36084100 | 36085850 | 119877050 | 119880086 | d7Mseg574 | 7318 |
| 7 | 36658950 | 36660600 | 120349685 | 120349979 | d7Mseg580 | 7319 |
| 7 | 36821100 | 36822400 | 120466341 | 120467733 | d7Mseg583 | 7320 |
| 7 | 36835550 | 36837350 | 120473721 | 120474695 | d7Mseg584 | 7321 |
| 7 | 36993850 | 36995400 | 120609826 | 120610565 | d7Mseg586 | 7322 |
| 7 | 37274050 | 37275600 | 120711913 | 120713294 | d7Mseg590 | 7323 |
| 7 | 37277550 | 37279100 | 120714476 | 120714928 | d7Mseg591 | 7324 |
| 7 | 37307350 | 37308800 | 120742981 | 120743299 | d7Mseg592 | 7325 |
| 7 | 37373650 | 37375200 | 120795834 | 120796051 | d7Mseg594 | 7326 |
| 7 | 37843950 | 37845700 | 121330777 | 121331054 | d7Mseg602 | 7327 |
| 7 | 37874600 | 37875950 | 121383448 | 121383639 | d7Mseg603 | 7328 |
| 7 | 37942000 | 37943700 | 121449882 | 121450471 | d7Mseg605 | 7329 |
| 7 | 38168150 | 38169300 | 121757691 | 121758017 | d7Mseg609 | 7330 |
| 7 | 38352450 | 38354000 | 121964465 | 121964998 | d7Mseg611 | 7331 |
| 7 | 38571600 | 38573450 | 122131571 | 122132305 | d7Mseg616 | 7332 |
| 7 | 38712650 | 38714550 | 122273746 | 122275607 | d7Mseg617 | 7333 |
| 7 | 38753250 | 38755800 | 122316995 | 122319507 | d7Mseg619 | 7334 |
| 7 | 38761350 | 38763200 | 122325082 | 122327163 | d7Mseg620 | 7335 |
| 7 | 38775950 | 38777250 | 122337917 | 122338900 | d7Mseg621 | 7336 |
| 7 | 38785900 | 38787550 | 122347462 | 122349577 | d7Mseg622 | 7337 |
| 7 | 38788900 | 38790750 | 122350981 | 122352780 | d7Mseg623 | 7338 |
| 7 | 38808100 | 38809850 | 122368598 | 122370508 | d7Mseg624 | 7339 |
| 7 | 38817000 | 38818050 | 122377739 | 122378848 | d7Mseg625 | 7340 |
| 7 | 38868750 | 38870050 | 122423489 | 122424235 | d7Mseg626 | 7341 |
| 7 | 38901000 | 38902250 | 122465474 | 122466479 | d7Mseg627 | 7342 |
| 7 | 38940400 | 38942100 | 122527672 | 122529277 | d7Mseg628 | 7343 |
| 7 | 38953700 | 38955450 | 122541332 | 122543459 | d7Mseg629 | 7344 |
| 7 | 38957650 | 38958750 | 122545664 | 122546196 | d7Mseg630 | 7345 |
| 7 | 39069250 | 39070850 | 122661389 | 122661962 | d7Mseg631 | 7346 |
| 7 | 39095350 | 39096500 | 46299690 | 46300174 | d7Mseg632 | 7347 |
| 7 | 39147150 | 39148600 | 122733877 | 122734840 | d7Mseg634 | 7348 |
| 7 | 39191000 | 39192100 | 122771658 | 122773001 | d7Mseg635 | 7349 |
| 7 | 39224500 | 39226200 | 122828869 | 122830963 | d7Mseg637 | 7350 |
| 7 | 39262300 | 39268050 | 122863887 | 122867232 | d7Mseg638 | 7351 |
| 7 | 39306500 | 39310050 | 122886899 | 122889059 | d7Mseg640 | 7352 |
| 7 | 39458200 | 39459550 | 123041080 | 123042455 | d7Mseg645 | 7353 |
| 7 | 39473150 | 39474350 | 123057506 | 123058040 | d7Mseg646 | 7354 |
| 7 | 39561750 | 39562950 | 123163515 | 123163722 | d7Mseg647 | 7355 |
| 7 | 39603900 | 39605650 | 123200413 | 123200673 | d7Mseg648 | 7356 |
| 7 | 39645100 | 39646850 | 123264005 | 123265635 | d7Mseg649 | 7357 |
| 7 | 39703750 | 39705500 | 123356474 | 123357325 | d7Mseg652 | 7358 |
| 7 | 39748100 | 39750750 | 123386144 | 123389400 | d7Mseg654 | 7359 |
| 7 | 39795050 | 39796800 | 123420095 | 123420917 | d7Mseg655 | 7360 |
| 7 | 39822450 | 39824800 | 123439590 | 123441675 | d7Mseg657 | 7361 |
| 7 | 39827750 | 39829750 | 123443185 | 123445037 | d7Mseg658 | 7362 |
| 7 | 39854100 | 39855100 | 123478354 | 123479725 | d7Mseg659 | 7363 |
| 7 | 39861700 | 39863550 | 123488709 | 123491917 | d7Mseg660 | 7364 |
| 7 | 39878250 | 39880750 | 123507531 | 123509464 | d7Mseg661 | 7365 |
| 7 | 39910500 | 39911500 | 123540576 | 123541595 | d7Mseg662 | 7366 |
| 7 | 39961400 | 39962950 | 123587036 | 123588661 | d7Mseg663 | 7367 |
| 7 | 39999550 | 40000600 | 123619042 | 123620125 | d7Mseg664 | 7368 |
| 7 | 40021500 | 40023500 | 123640842 | 123642232 | d7Mseg665 | 7369 |
| 7 | 40138700 | 40140100 | 123745775 | 123748264 | d7Mseg667 | 7370 |
| 7 | 40194800 | 40196600 | 123800549 | 123801153 | d7Mseg668 | 7371 |
| 7 | 40251250 | 40252250 | 123837406 | 123838243 | d7Mseg669 | 7372 |
| 7 | 40270800 | 40271800 | 123855470 | 123856915 | d7Mseg670 | 7373 |
| 7 | 40339850 | 40341450 | 123924457 | 123926086 | d7Mseg671 | 7374 |
| 7 | 40391050 | 40392400 | 123980204 | 123981603 | d7Mseg674 | 7375 |
| 7 | 40491100 | 40492900 | 124076824 | 124078653 | d7Mseg675 | 7376 |
| 7 | 40512300 | 40515500 | 124093055 | 124093930 | d7Mseg676 | 7377 |
| 7 | 40643550 | 40644950 | 124218781 | 124220388 | d7Mseg677 | 7378 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 40779300 | 40784650 | 124335476 | 124340593 | d7Mseg678 | 7379 |
| 7 | 40786450 | 40789800 | 124341501 | 124343669 | d7Mseg679 | 7380 |
| 7 | 40895000 | 40897000 | 124392274 | 124393404 | d7Mseg680 | 7381 |
| 7 | 41626100 | 41627650 | 125183879 | 125184824 | d7Mseg686 | 7382 |
| 7 | 41720000 | 41722700 | 125298738 | 125301534 | d7Mseg688 | 7383 |
| 7 | 41725600 | 41727250 | 125305425 | 125306666 | d7Mseg689 | 7384 |
| 7 | 41739700 | 41741100 | 125315494 | 125316590 | d7Mseg691 | 7385 |
| 7 | 41778450 | 41780000 | 125345143 | 125345434 | d7Mseg692 | 7386 |
| 7 | 41975350 | 41976400 | 125536880 | 125537343 | d7Mseg695 | 7387 |
| 7 | 42141450 | 42143550 | 125685070 | 125686968 | d7Mseg698 | 7388 |
| 7 | 42551450 | 42552950 | 126072188 | 126072400 | d7Mseg702 | 7389 |
| 7 | 42742700 | 42744450 | 126256720 | 126259105 | d7Mseg704 | 7390 |
| 7 | 43681750 | 43682900 | 127185574 | 127186509 | d7Mseg719 | 7391 |
| 7 | 43718650 | 43720150 | 127369845 | 127370845 | d7Mseg720 | 7392 |
| 7 | 43826700 | 43827950 | 127457557 | 127458870 | d7Mseg722 | 7393 |
| 7 | 43924000 | 43925700 | 127537074 | 127538042 | d7Mseg726 | 7394 |
| 7 | 43944700 | 43946500 | 127558022 | 127562464 | d7Mseg727 | 7395 |
| 7 | 43969150 | 43975550 | 127574007 | 127574767 | d7Mseg728 | 7396 |
| 7 | 44013750 | 44014950 | 127615704 | 127616060 | d7Mseg730 | 7397 |
| 7 | 44162300 | 44163900 | 127751803 | 127753111 | d7Mseg731 | 7398 |
| 7 | 44168000 | 44169200 | 127760101 | 127761053 | d7Mseg732 | 7399 |
| 7 | 44179150 | 44180900 | 127762335 | 127764008 | d7Mseg733 | 7400 |
| 7 | 44236850 | 44238650 | 127816537 | 127818349 | d7Mseg735 | 7401 |
| 7 | 44244700 | 44245700 | 127826431 | 127827406 | d7Mseg736 | 7402 |
| 7 | 44266850 | 44267850 | 127843131 | 127844280 | d7Mseg737 | 7403 |
| 7 | 44315300 | 44316300 | 127881040 | 127882035 | d7Mseg738 | 7404 |
| 7 | 44356550 | 44358500 | 127933880 | 127934275 | d7Mseg740 | 7405 |
| 7 | 44365000 | 44366600 | 127937955 | 127940329 | d7Mseg741 | 7406 |
| 7 | 44443800 | 44445600 | 127991458 | 127992746 | d7Mseg743 | 7407 |
| 7 | 44451750 | 44453500 | 127997200 | 127997763 | d7Mseg744 | 7408 |
| 7 | 44527000 | 44528850 | 128029686 | 128030431 | d7Mseg745 | 7409 |
| 7 | 44611100 | 44613100 | 128080017 | 128082507 | d7Mseg746 | 7410 |
| 7 | 44614550 | 44615900 | 128083922 | 128085314 | d7Mseg747 | 7411 |
| 7 | 44636950 | 44638700 | 128102810 | 128104628 | d7Mseg749 | 7412 |
| 7 | 44645400 | 44646550 | 128109278 | 128110437 | d7Mseg750 | 7413 |
| 7 | 44675000 | 44676400 | 128158625 | 128159046 | d7Mseg751 | 7414 |
| 7 | 44742200 | 44743750 | 128210114 | 128211421 | d7Mseg752 | 7415 |
| 7 | 44752900 | 44754950 | 128225301 | 128225941 | d7Mseg753 | 7416 |
| 7 | 44762600 | 44763650 | 128228412 | 128229418 | d7Mseg754 | 7417 |
| 7 | 44818750 | 44819750 | 128249704 | 128250478 | d7Mseg757 | 7418 |
| 7 | 44885000 | 44886400 | 128287402 | 128288714 | d7Mseg759 | 7419 |
| 7 | 44918400 | 44919450 | 128327828 | 128328289 | d7Mseg760 | 7420 |
| 7 | 45115150 | 45116750 | 128527794 | 128534377 | d7Mseg763 | 7421 |
| 7 | 45139750 | 45140850 | 128562667 | 128563010 | d7Mseg764 | 7422 |
| 7 | 45149600 | 45151450 | 128564761 | 128566767 | d7Mseg765 | 7423 |
| 7 | 45206100 | 45207900 | 128624361 | 128626077 | d7Mseg766 | 7424 |
| 7 | 45238850 | 45239850 | 128651514 | 128652188 | d7Mseg767 | 7425 |
| 7 | 45243800 | 45248200 | 128655532 | 128659505 | d7Mseg768 | 7426 |
| 7 | 45343350 | 45345400 | 128740271 | 128740722 | d7Mseg772 | 7427 |
| 7 | 45347700 | 45349600 | 128743374 | 128745042 | d7Mseg773 | 7428 |
| 7 | 45370000 | 45373100 | 128768526 | 128771016 | d7Mseg775 | 7429 |
| 7 | 45378400 | 45380150 | 128779312 | 128781102 | d7Mseg776 | 7430 |
| 7 | 45382100 | 45392250 | 128783256 | 128794419 | d7Mseg777 | 7431 |
| 7 | 45421950 | 45423050 | 128826449 | 128828388 | d7Mseg779 | 7432 |
| 7 | 45470150 | 45471350 | 128880233 | 128881408 | d7Mseg780 | 7433 |
| 7 | 45486550 | 45488200 | 128898092 | 128901517 | d7Mseg781 | 7434 |
| 7 | 45505450 | 45507250 | 128919171 | 128921423 | d7Mseg782 | 7435 |
| 7 | 45523500 | 45524800 | 128937383 | 128938592 | d7Mseg783 | 7436 |
| 7 | 45549600 | 45550900 | 128964584 | 128965390 | d7Mseg784 | 7437 |
| 7 | 45553900 | 45555650 | 128968663 | 128970954 | d7Mseg785 | 7438 |
| 7 | 45638100 | 45641300 | 129065731 | 129069327 | d7Mseg788 | 7439 |
| 7 | 45663150 | 45665200 | 129086083 | 129088051 | d7Mseg790 | 7440 |
| 7 | 45667150 | 45672900 | 129090445 | 129096500 | d7Mseg791 | 7441 |
| 7 | 45686100 | 45687700 | 129107765 | 129108269 | d7Mseg792 | 7442 |
| 7 | 45690600 | 45700600 | 129110140 | 129120295 | d7Mseg793 | 7443 |
| 7 | 45702350 | 45703850 | 129122297 | 129124820 | d7Mseg794 | 7444 |
| 7 | 45718350 | 45720100 | 129144003 | 129146043 | d7Mseg795 | 7445 |
| 7 | 45765800 | 45767350 | 129198856 | 129200204 | d7Mseg796 | 7446 |
| 7 | 45799100 | 45810800 | 129237506 | 129249292 | d7Mseg797 | 7447 |
| 7 | 45812150 | 45814800 | 129251212 | 129253769 | d7Mseg798 | 7448 |
| 7 | 45816000 | 45817700 | 129254822 | 129256413 | d7Mseg799 | 7449 |
| 7 | 45866650 | 45868500 | 129299763 | 129301830 | d7Mseg800 | 7450 |
| 7 | 45871600 | 45873900 | 129304821 | 129307190 | d7Mseg801 | 7451 |
| 7 | 45882850 | 45884650 | 129318283 | 129319851 | d7Mseg802 | 7452 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 45886350 | 45888400 | 129328069 | 129329868 | d7Mseg803 | 7453 |
| 7 | 45948000 | 45953650 | 129403820 | 129431849 | d7Mseg805 | 7454 |
| 7 | 45973350 | 45975050 | 129468409 | 129469605 | d7Mseg806 | 7455 |
| 7 | 45976250 | 45977750 | 129473417 | 129474708 | d7Mseg807 | 7456 |
| 7 | 46023700 | 46025550 | 129515667 | 129517638 | d7Mseg808 | 7457 |
| 7 | 46034900 | 46036450 | 129526974 | 129527389 | d7Mseg809 | 7458 |
| 7 | 46132550 | 46133550 | 129558859 | 129559167 | d7Mseg812 | 7459 |
| 7 | 46223150 | 46225050 | 129641466 | 129643348 | d7Mseg817 | 7460 |
| 7 | 46262450 | 46265700 | 129685489 | 129688485 | d7Mseg818 | 7461 |
| 7 | 46270350 | 46272450 | 129689470 | 129690075 | d7Mseg819 | 7462 |
| 7 | 46349200 | 46350350 | 129740640 | 129741686 | d7Mseg820 | 7463 |
| 7 | 46382450 | 46384200 | 129775346 | 129778554 | d7Mseg821 | 7464 |
| 7 | 46532500 | 46534100 | 129926807 | 129927787 | d7Mseg822 | 7465 |
| 7 | 46567450 | 46571000 | 129963488 | 129966125 | d7Mseg823 | 7466 |
| 7 | 46572050 | 46573150 | 129966813 | 129967901 | d7Mseg824 | 7467 |
| 7 | 46582650 | 46583850 | 129980034 | 129984481 | d7Mseg825 | 7468 |
| 7 | 46594300 | 46595950 | 129998253 | 129999658 | d7Mseg826 | 7469 |
| 7 | 46626700 | 46628000 | 130021285 | 130022621 | d7Mseg827 | 7470 |
| 7 | 46634500 | 46636050 | 130029235 | 130030553 | d7Mseg828 | 7471 |
| 7 | 46671500 | 46673050 | 130073295 | 130073496 | d7Mseg829 | 7472 |
| 7 | 46674600 | 46676050 | 130078270 | 130079177 | d7Mseg830 | 7473 |
| 7 | 46726050 | 46727550 | 130125961 | 130126274 | d7Mseg831 | 7474 |
| 7 | 46737200 | 46739400 | 130135006 | 130140805 | d7Mseg832 | 7475 |
| 7 | 46816350 | 46817750 | 130184629 | 130186078 | d7Mseg833 | 7476 |
| 7 | 46823100 | 46825000 | 130191661 | 130193575 | d7Mseg834 | 7477 |
| 7 | 46826600 | 46830900 | 130195347 | 130199871 | d7Mseg835 | 7478 |
| 7 | 46835350 | 46841700 | 130204271 | 130210819 | d7Mseg836 | 7479 |
| 7 | 46844950 | 46849750 | 130214253 | 130219020 | d7Mseg837 | 7480 |
| 7 | 47150550 | 47152600 | 130422906 | 130424949 | d7Mseg844 | 7481 |
| 7 | 47186750 | 47187950 | 130439140 | 130439609 | d7Mseg845 | 7482 |
| 7 | 47278100 | 47279800 | 130480780 | 130481986 | d7Mseg851 | 7483 |
| 7 | 47292850 | 47294550 | 130491902 | 130492452 | d7Mseg853 | 7484 |
| 7 | 47364850 | 47366600 | 130534553 | 130536454 | d7Mseg855 | 7485 |
| 7 | 47424250 | 47428350 | 130726734 | 130729236 | d7Mseg857 | 7486 |
| 7 | 47430650 | 47432200 | 130723771 | 130724975 | d7Mseg858 | 7487 |
| 7 | 47472750 | 47474200 | 130698377 | 130698983 | d7Mseg859 | 7488 |
| 7 | 47560000 | 47561650 | 130653757 | 130658153 | d7Mseg862 | 7489 |
| 7 | 47782200 | 47783800 | 130554282 | 130555150 | d7Mseg872 | 7490 |
| 7 | 47858850 | 47860050 | 130773271 | 130774095 | d7Mseg874 | 7491 |
| 7 | 47929100 | 47930850 | 130875045 | 130875479 | d7Mseg875 | 7492 |
| 7 | 48040400 | 48041550 | 130994804 | 130995795 | d7Mseg883 | 7493 |
| 7 | 48109200 | 48110900 | 131069398 | 131069895 | d7Mseg885 | 7494 |
| 7 | 48119250 | 48121250 | 131078768 | 131079448 | d7Mseg886 | 7495 |
| 7 | 48144000 | 48145800 | 131109912 | 131112139 | d7Mseg887 | 7496 |
| 7 | 48179700 | 48180700 | 131140703 | 131142091 | d7Mseg888 | 7497 |
| 7 | 48185150 | 48186950 | 131147312 | 131149548 | d7Mseg889 | 7498 |
| 7 | 48189850 | 48198300 | 131152397 | 131161050 | d7Mseg890 | 7499 |
| 7 | 48203050 | 48204800 | 131166679 | 131167984 | d7Mseg891 | 7500 |
| 7 | 48226550 | 48227700 | 131192271 | 131193226 | d7Mseg892 | 7501 |
| 7 | 48234100 | 48236000 | 131198499 | 131199901 | d7Mseg893 | 7502 |
| 7 | 48277100 | 48278750 | 131243804 | 131245698 | d7Mseg894 | 7503 |
| 7 | 48320550 | 48321850 | 131305442 | 131306511 | d7Mseg896 | 7504 |
| 7 | 48334450 | 48335700 | 131315268 | 131316204 | d7Mseg897 | 7505 |
| 7 | 48344800 | 48346450 | 131322527 | 131324095 | d7Mseg898 | 7506 |
| 7 | 48367900 | 48369550 | 131347929 | 131349656 | d7Mseg899 | 7507 |
| 7 | 48371400 | 48373300 | 131351609 | 131353535 | d7Mseg900 | 7508 |
| 7 | 48378450 | 48380300 | 131359006 | 131360241 | d7Mseg901 | 7509 |
| 7 | 48392950 | 48394800 | 131376959 | 131377597 | d7Mseg903 | 7510 |
| 7 | 48427250 | 48428700 | 131448759 | 131449344 | d7Mseg904 | 7511 |
| 7 | 48519050 | 48520750 | 131574679 | 131576849 | d7Mseg905 | 7512 |
| 7 | 48526400 | 48527750 | 131590554 | 131591574 | d7Mseg906 | 7513 |
| 7 | 48556700 | 48560700 | 131621640 | 131625568 | d7Mseg907 | 7514 |
| 7 | 48567300 | 48569250 | 131633733 | 131636080 | d7Mseg908 | 7515 |
| 7 | 48601650 | 48603300 | 131672522 | 131673737 | d7Mseg910 | 7516 |
| 7 | 48714350 | 48716050 | 131736184 | 131738217 | d7Mseg915 | 7517 |
| 7 | 48720150 | 48721750 | 131742492 | 131744045 | d7Mseg916 | 7518 |
| 7 | 48723650 | 48725300 | 131745751 | 131746705 | d7Mseg917 | 7519 |
| 7 | 48730150 | 48731200 | 131751997 | 131752578 | d7Mseg918 | 7520 |
| 7 | 48751350 | 48753150 | 131771008 | 131772879 | d7Mseg919 | 7521 |
| 7 | 48767250 | 48769150 | 131791107 | 131792497 | d7Mseg921 | 7522 |
| 7 | 48775650 | 48777650 | 131797691 | 131799242 | d7Mseg922 | 7523 |
| 7 | 48822850 | 48824550 | 131840659 | 131842489 | d7Mseg923 | 7524 |
| 7 | 48826100 | 48827150 | 131843770 | 131844771 | d7Mseg924 | 7525 |
| 7 | 48842250 | 48844350 | 131865225 | 131867486 | d7Mseg925 | 7526 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 48856950 | 48858850 | 131881678 | 131883985 | d7Mseg926 | 7527 |
| 7 | 48864750 | 48866400 | 131890217 | 131891614 | d7Mseg927 | 7528 |
| 7 | 48897650 | 48899400 | 131935120 | 131936820 | d7Mseg928 | 7529 |
| 7 | 48909100 | 48910850 | 131950298 | 131951553 | d7Mseg929 | 7530 |
| 7 | 48931250 | 48933000 | 131967192 | 131968841 | d7Mseg930 | 7531 |
| 7 | 48964850 | 48966550 | 132010214 | 132011982 | d7Mseg931 | 7532 |
| 7 | 48968750 | 48970550 | 132014619 | 132018738 | d7Mseg932 | 7533 |
| 7 | 49021000 | 49022250 | 132077029 | 132080830 | d7Mseg934 | 7534 |
| 7 | 49029050 | 49041550 | 132086353 | 132099266 | d7Mseg935 | 7535 |
| 7 | 49059000 | 49060800 | 132116444 | 132117784 | d7Mseg937 | 7536 |
| 7 | 49074200 | 49078150 | 132132815 | 132135689 | d7Mseg938 | 7537 |
| 7 | 49112650 | 49115450 | 132164748 | 132165878 | d7Mseg939 | 7538 |
| 7 | 49129950 | 49131100 | 132202644 | 132203348 | d7Mseg940 | 7539 |
| 7 | 49132950 | 49134700 | 132205610 | 132206138 | d7Mseg941 | 7540 |
| 7 | 49147550 | 49149200 | 132221481 | 132222936 | d7Mseg942 | 7541 |
| 7 | 49154200 | 49156050 | 132231108 | 132231426 | d7Mseg943 | 7542 |
| 7 | 49225950 | 49227800 | 132308890 | 132310144 | d7Mseg947 | 7543 |
| 7 | 49245000 | 49248550 | 132328592 | 132331618 | d7Mseg948 | 7544 |
| 7 | 49266800 | 49268400 | 132350187 | 132353685 | d7Mseg949 | 7545 |
| 7 | 49309800 | 49311100 | 148628962 | 148631469 | d7Mseg951 | 7546 |
| 7 | 49332650 | 49334500 | 132371196 | 132373666 | d7Mseg954 | 7547 |
| 7 | 49368650 | 49370350 | 132395499 | 132398844 | d7Mseg955 | 7548 |
| 7 | 49404000 | 49405600 | 132434517 | 132436079 | d7Mseg956 | 7549 |
| 7 | 49450750 | 49452200 | 132478916 | 132480717 | d7Mseg957 | 7550 |
| 7 | 49459650 | 49461300 | 132491788 | 132492348 | d7Mseg958 | 7551 |
| 7 | 49463800 | 49465500 | 132494617 | 132495838 | d7Mseg959 | 7552 |
| 7 | 49476500 | 49478250 | 132506352 | 132507136 | d7Mseg960 | 7553 |
| 7 | 49498900 | 49500600 | 132528398 | 132529030 | d7Mseg961 | 7554 |
| 7 | 49510100 | 49511850 | 132540421 | 132542440 | d7Mseg962 | 7555 |
| 7 | 49515500 | 49518450 | 132546425 | 132549459 | d7Mseg963 | 7556 |
| 7 | 49576600 | 49578100 | 132627205 | 132628175 | d7Mseg964 | 7557 |
| 7 | 49590900 | 49592850 | 132637092 | 132637290 | d7Mseg965 | 7558 |
| 7 | 49617900 | 49619800 | 132660401 | 132662237 | d7Mseg966 | 7559 |
| 7 | 49632850 | 49634350 | 132677567 | 132681410 | d7Mseg967 | 7560 |
| 7 | 49699050 | 49700750 | 132781018 | 132782176 | d7Mseg969 | 7561 |
| 7 | 49702600 | 49703900 | 132784341 | 132785336 | d7Mseg970 | 7562 |
| 7 | 49717400 | 49719150 | 132793527 | 132796169 | d7Mseg971 | 7563 |
| 7 | 49727200 | 49729600 | 132810230 | 132812693 | d7Mseg972 | 7564 |
| 7 | 49748000 | 49749700 | 132831845 | 132833357 | d7Mseg973 | 7565 |
| 7 | 49753650 | 49755450 | 132839915 | 132843768 | d7Mseg974 | 7566 |
| 7 | 49760650 | 49762350 | 132858473 | 132860076 | d7Mseg975 | 7567 |
| 7 | 49775500 | 49776800 | 132880685 | 132881912 | d7Mseg976 | 7568 |
| 7 | 49791000 | 49792600 | 132903731 | 132905101 | d7Mseg977 | 7569 |
| 7 | 49810050 | 49811400 | 132930423 | 132931256 | d7Mseg978 | 7570 |
| 7 | 49839400 | 49841300 | 132968858 | 132970519 | d7Mseg980 | 7571 |
| 7 | 49849000 | 49850650 | 132979775 | 132981699 | d7Mseg981 | 7572 |
| 7 | 49886850 | 49888500 | 133026214 | 133027755 | d7Mseg982 | 7573 |
| 7 | 49915100 | 49916650 | 133063791 | 133066065 | d7Mseg983 | 7574 |
| 7 | 49964750 | 49970250 | 133117306 | 133123010 | d7Mseg984 | 7575 |
| 7 | 49984450 | 49986150 | 133138165 | 133139953 | d7Mseg985 | 7576 |
| 7 | 49988900 | 49990250 | 133142277 | 133143895 | d7Mseg986 | 7577 |
| 7 | 50001500 | 50003050 | 133157026 | 133158739 | d7Mseg987 | 7578 |
| 7 | 50013800 | 50014850 | 133172408 | 133172881 | d7Mseg988 | 7579 |
| 7 | 50096650 | 50098550 | 133305238 | 133307374 | d7Mseg990 | 7580 |
| 7 | 50141400 | 50143600 | 133367377 | 133370553 | d7Mseg991 | 7581 |
| 7 | 50146600 | 50148250 | 133374229 | 133375409 | d7Mseg992 | 7582 |
| 7 | 50153450 | 50155050 | 133380833 | 133381987 | d7Mseg993 | 7583 |
| 7 | 50157250 | 50159100 | 133383651 | 133385748 | d7Mseg994 | 7584 |
| 7 | 50165250 | 50170650 | 133396268 | 133398976 | d7Mseg995 | 7585 |
| 7 | 50226750 | 50228450 | 133476263 | 133476568 | d7Mseg997 | 7586 |
| 7 | 50238900 | 50240650 | 85340660 | 85340880 | d7Mseg999 | 7587 |
| 7 | 50264950 | 50267500 | 133506826 | 133509357 | d7Mseg1001 | 7588 |
| 7 | 50340900 | 50342400 | 133593795 | 133595251 | d7Mseg1003 | 7589 |
| 7 | 50407500 | 50413850 | 133680727 | 133686885 | d7Mseg1004 | 7590 |
| 7 | 50426500 | 50427800 | 133702985 | 133704563 | d7Mseg1005 | 7591 |
| 7 | 50464700 | 50467750 | 133751955 | 133755782 | d7Mseg1006 | 7592 |
| 7 | 50469100 | 50470800 | 133757148 | 133758461 | d7Mseg1007 | 7593 |
| 7 | 50479950 | 50482900 | 133766270 | 133771004 | d7Mseg1008 | 7594 |
| 7 | 50489150 | 50493350 | 133779974 | 133784547 | d7Mseg1009 | 7595 |
| 7 | 50495400 | 50497150 | 133786974 | 133788968 | d7Mseg1010 | 7596 |
| 7 | 50504750 | 50506250 | 133796368 | 133797936 | d7Mseg1011 | 7597 |
| 7 | 50516350 | 50517550 | 133806333 | 133807526 | d7Mseg1012 | 7598 |
| 7 | 50519200 | 50521300 | 133808900 | 133811153 | d7Mseg1013 | 7599 |
| 7 | 50545650 | 50547350 | 133846911 | 133848813 | d7Mseg1014 | 7600 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 50561150 | 50562700 | 133863567 | 133865861 | d7Mseg1015 | 7601 |
| 7 | 50603850 | 50605350 | 133911878 | 133913761 | d7Mseg1016 | 7602 |
| 7 | 50639650 | 50641450 | 133953300 | 133956274 | d7Mseg1017 | 7603 |
| 7 | 50643600 | 50645150 | 133960537 | 133962077 | d7Mseg1018 | 7604 |
| 7 | 50673600 | 50675450 | 134003552 | 134005656 | d7Mseg1019 | 7605 |
| 7 | 50712000 | 50713100 | 134034393 | 134035131 | d7Mseg1020 | 7606 |
| 7 | 50954900 | 50956200 | 134173012 | 134173437 | d7Mseg1029 | 7607 |
| 7 | 51038850 | 51040850 | 134580347 | 134581420 | d7Mseg1032 | 7608 |
| 7 | 53477850 | 53479750 | 134314823 | 134317752 | d7Mseg1046 | 7609 |
| 7 | 53535550 | 53536750 | 134480236 | 134481187 | d7Mseg1048 | 7610 |
| 7 | 53618100 | 53619850 | 134496269 | 134497771 | d7Mseg1050 | 7611 |
| 7 | 53715350 | 53716700 | 134661219 | 134662437 | d7Mseg1056 | 7612 |
| 7 | 53719800 | 53720900 | 134665148 | 134665788 | d7Mseg1057 | 7613 |
| 7 | 53850250 | 53852000 | 135055068 | 135057268 | d7Mseg1060 | 7614 |
| 7 | 53862950 | 53864950 | 135067584 | 135069491 | d7Mseg1062 | 7615 |
| 7 | 53867000 | 53868100 | 135071580 | 135071738 | d7Mseg1063 | 7616 |
| 7 | 53872150 | 53873200 | 135075480 | 135076643 | d7Mseg1064 | 7617 |
| 7 | 53903650 | 53905750 | 135111009 | 135113266 | d7Mseg1065 | 7618 |
| 7 | 53916600 | 53919150 | 135128877 | 135130681 | d7Mseg1066 | 7619 |
| 7 | 53924250 | 53925900 | 135138366 | 135141056 | d7Mseg1067 | 7620 |
| 7 | 53927400 | 53929150 | 135142875 | 135143824 | d7Mseg1068 | 7621 |
| 7 | 53934300 | 53935300 | 135149326 | 135150157 | d7Mseg1069 | 7622 |
| 7 | 53937550 | 53939550 | 135158855 | 135159827 | d7Mseg1070 | 7623 |
| 7 | 53960850 | 53962400 | 135194420 | 135195116 | d7Mseg1071 | 7624 |
| 7 | 53964550 | 53966300 | 135197019 | 135199821 | d7Mseg1072 | 7625 |
| 7 | 53983050 | 53986450 | 135226914 | 135231187 | d7Mseg1073 | 7626 |
| 7 | 53994800 | 53996200 | 135237335 | 135239141 | d7Mseg1074 | 7627 |
| 7 | 53999200 | 54001250 | 135243641 | 135245538 | d7Mseg1075 | 7628 |
| 7 | 54025000 | 54026150 | 135273261 | 135274425 | d7Mseg1076 | 7629 |
| 7 | 54064600 | 54066250 | 135314577 | 135318282 | d7Mseg1077 | 7630 |
| 7 | 54076350 | 54077600 | 135335304 | 135335746 | d7Mseg1078 | 7631 |
| 7 | 54097050 | 54098900 | 135356262 | 135358301 | d7Mseg1079 | 7632 |
| 7 | 54158750 | 54160600 | 135421910 | 135422840 | d7Mseg1081 | 7633 |
| 7 | 54166700 | 54168050 | 135426964 | 135428335 | d7Mseg1082 | 7634 |
| 7 | 54183300 | 54184850 | 135443734 | 135445050 | d7Mseg1083 | 7635 |
| 7 | 54200850 | 54202450 | 135467765 | 135469685 | d7Mseg1084 | 7636 |
| 7 | 54280650 | 54281650 | 135547604 | 135548845 | d7Mseg1085 | 7637 |
| 7 | 54289050 | 54290150 | 135557237 | 135558334 | d7Mseg1086 | 7638 |
| 7 | 54296300 | 54297750 | 135570154 | 135571569 | d7Mseg1087 | 7639 |
| 7 | 54301850 | 54303250 | 135575859 | 135576441 | d7Mseg1088 | 7640 |
| 7 | 54393400 | 54395000 | 135669405 | 135670466 | d7Mseg1089 | 7641 |
| 7 | 54397950 | 54399000 | 135674353 | 135675699 | d7Mseg1090 | 7642 |
| 7 | 54459050 | 54462150 | 135725439 | 135727688 | d7Mseg1091 | 7643 |
| 7 | 54492950 | 54494750 | 135758145 | 135759853 | d7Mseg1092 | 7644 |
| 7 | 54589300 | 54590950 | 135861227 | 135862302 | d7Mseg1094 | 7645 |
| 7 | 54644100 | 54645900 | 135961061 | 135962620 | d7Mseg1095 | 7646 |
| 7 | 54662150 | 54663950 | 135991728 | 135992427 | d7Mseg1096 | 7647 |
| 7 | 54691650 | 54692750 | 136044641 | 136045232 | d7Mseg1097 | 7648 |
| 7 | 54715200 | 54716550 | 136073919 | 136075950 | d7Mseg1098 | 7649 |
| 7 | 54726000 | 54727900 | 136084944 | 136085335 | d7Mseg1099 | 7650 |
| 7 | 54754050 | 54761400 | 136112939 | 136120284 | d7Mseg1101 | 7651 |
| 7 | 54791700 | 54793500 | 136152572 | 136153345 | d7Mseg1102 | 7652 |
| 7 | 54796000 | 54797400 | 136156162 | 136156860 | d7Mseg1103 | 7653 |
| 7 | 54804350 | 54805950 | 136163511 | 136164395 | d7Mseg1104 | 7654 |
| 7 | 54834600 | 54835700 | 136181856 | 136182411 | d7Mseg1105 | 7655 |
| 7 | 54906100 | 54907850 | 136259090 | 136260020 | d7Mseg1107 | 7656 |
| 7 | 54924500 | 54928600 | 136275697 | 136276727 | d7Mseg1108 | 7657 |
| 7 | 54942450 | 54944400 | 136291604 | 136292916 | d7Mseg1110 | 7658 |
| 7 | 54960150 | 54961950 | 136314648 | 136316454 | d7Mseg1111 | 7659 |
| 7 | 54964100 | 54965200 | 136318623 | 136319826 | d7Mseg1112 | 7660 |
| 7 | 55015750 | 55017950 | 136351182 | 136351991 | d7Mseg1114 | 7661 |
| 7 | 55019600 | 55021450 | 136353477 | 136355332 | d7Mseg1115 | 7662 |
| 7 | 55022500 | 55024050 | 136356403 | 136358052 | d7Mseg1116 | 7663 |
| 7 | 55025350 | 55027300 | 136359061 | 136359620 | d7Mseg1117 | 7664 |
| 7 | 55030850 | 55033150 | 136362617 | 136364448 | d7Mseg1118 | 7665 |
| 7 | 55089150 | 55090950 | 136417645 | 136419891 | d7Mseg1119 | 7666 |
| 7 | 55120600 | 55121950 | 136445911 | 136447290 | d7Mseg1120 | 7667 |
| 7 | 55128200 | 55129450 | 136455576 | 136456734 | d7Mseg1121 | 7668 |
| 7 | 55144900 | 55147800 | 136468567 | 136474795 | d7Mseg1122 | 7669 |
| 7 | 55165850 | 55167000 | 136502892 | 136504178 | d7Mseg1123 | 7670 |
| 7 | 55168950 | 55177100 | 136505919 | 136514806 | d7Mseg1124 | 7671 |
| 7 | 55207400 | 55209450 | 136563921 | 136565929 | d7Mseg1125 | 7672 |
| 7 | 55253850 | 55255450 | 136618653 | 136619145 | d7Mseg1127 | 7673 |
| 7 | 55266700 | 55274450 | 136627220 | 136635572 | d7Mseg1128 | 7674 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 55279400 | 55288000 | 136643868 | 136652525 | d7Mseg1129 | 7675 |
| 7 | 55290400 | 55296750 | 136654976 | 136660703 | d7Mseg1130 | 7676 |
| 7 | 55333950 | 55334950 | 136715789 | 136715952 | d7Mseg1131 | 7677 |
| 7 | 55339150 | 55340950 | 136719131 | 136720945 | d7Mseg1132 | 7678 |
| 7 | 55363350 | 55364400 | 136751326 | 136751520 | d7Mseg1133 | 7679 |
| 7 | 55405850 | 55408900 | 136826935 | 136829749 | d7Mseg1134 | 7680 |
| 7 | 55429950 | 55431350 | 136862340 | 136862778 | d7Mseg1135 | 7681 |
| 7 | 55549800 | 55551400 | 136955123 | 136955885 | d7Mseg1136 | 7682 |
| 7 | 55566800 | 55568000 | 136968911 | 136969767 | d7Mseg1137 | 7683 |
| 7 | 55570750 | 55572600 | 136970720 | 136972460 | d7Mseg1138 | 7684 |
| 7 | 55575400 | 55576800 | 136976994 | 136978460 | d7Mseg1139 | 7685 |
| 7 | 55678100 | 55680050 | 137028011 | 137029479 | d7Mseg1143 | 7686 |
| 7 | 55815000 | 55816600 | 137199358 | 137199980 | d7Mseg1145 | 7687 |
| 7 | 55820100 | 55824600 | 137214226 | 137215956 | d7Mseg1146 | 7688 |
| 7 | 55829300 | 55831000 | 137222067 | 137225943 | d7Mseg1147 | 7689 |
| 7 | 55922900 | 55924550 | 137302554 | 137302869 | d7Mseg1149 | 7690 |
| 7 | 56087450 | 56089600 | 137481607 | 137482124 | d7Mseg1155 | 7691 |
| 7 | 56197550 | 56199050 | 141236541 | 141237108 | d7Mseg1157 | 7692 |
| 7 | 56303600 | 56305250 | 137684872 | 137685102 | d7Mseg1160 | 7693 |
| 7 | 56386000 | 56388000 | 137791961 | 137793923 | d7Mseg1161 | 7694 |
| 7 | 56396550 | 56398250 | 137803543 | 137804171 | d7Mseg1162 | 7695 |
| 7 | 56418350 | 56421350 | 137820604 | 137823585 | d7Mseg1163 | 7696 |
| 7 | 56433550 | 56435150 | 137839612 | 137840973 | d7Mseg1164 | 7697 |
| 7 | 56436750 | 56438550 | 137843249 | 137844889 | d7Mseg1165 | 7698 |
| 7 | 56443200 | 56445900 | 137853682 | 137855941 | d7Mseg1166 | 7699 |
| 7 | 56459200 | 56460950 | 137869395 | 137869679 | d7Mseg1167 | 7700 |
| 7 | 56468400 | 56471100 | 137885931 | 137887422 | d7Mseg1168 | 7701 |
| 7 | 56519000 | 56520150 | 137950130 | 137950678 | d7Mseg1169 | 7702 |
| 7 | 56534600 | 56536550 | 137966945 | 137968677 | d7Mseg1170 | 7703 |
| 7 | 56563100 | 56564950 | 137980791 | 137982487 | d7Mseg1171 | 7704 |
| 7 | 56613300 | 56615000 | 138027080 | 138028952 | d7Mseg1172 | 7705 |
| 7 | 56689000 | 56691500 | 138155772 | 138157271 | d7Mseg1174 | 7706 |
| 7 | 56725550 | 56726900 | 138179819 | 138181542 | d7Mseg1175 | 7707 |
| 7 | 56727950 | 56729100 | 138181772 | 138182052 | d7Mseg1176 | 7708 |
| 7 | 56734200 | 56735350 | 138190457 | 138190837 | d7Mseg1177 | 7709 |
| 7 | 56759550 | 56760950 | 138213396 | 138214940 | d7Mseg1178 | 7710 |
| 7 | 56817950 | 56824200 | 138284113 | 138290320 | d7Mseg1179 | 7711 |
| 7 | 56835900 | 56837950 | 138302267 | 138304129 | d7Mseg1180 | 7712 |
| 7 | 56841550 | 56842900 | 138306749 | 138308006 | d7Mseg1181 | 7713 |
| 7 | 56939950 | 56941400 | 138368358 | 138368667 | d7Mseg1183 | 7714 |
| 7 | 56958200 | 56959950 | 138378925 | 138380442 | d7Mseg1184 | 7715 |
| 7 | 57026800 | 57027950 | 138452521 | 138452728 | d7Mseg1186 | 7716 |
| 7 | 57051400 | 57053650 | 138473286 | 138473849 | d7Mseg1187 | 7717 |
| 7 | 57155850 | 57158250 | 138531976 | 138532890 | d7Mseg1193 | 7718 |
| 7 | 57259500 | 57261250 | 138620974 | 138621523 | d7Mseg1194 | 7719 |
| 7 | 57268650 | 57270650 | 138629849 | 138631276 | d7Mseg1195 | 7720 |
| 7 | 57342400 | 57344350 | 138681973 | 138682655 | d7Mseg1196 | 7721 |
| 7 | 57391850 | 57393700 | 138714941 | 138716185 | d7Mseg1197 | 7722 |
| 7 | 57428450 | 57434700 | 138771735 | 138780855 | d7Mseg1198 | 7723 |
| 7 | 57438600 | 57440300 | 138784285 | 138784635 | d7Mseg1199 | 7724 |
| 7 | 57545250 | 57547100 | 138880576 | 138882549 | d7Mseg1200 | 7725 |
| 7 | 57548650 | 57550300 | 138884694 | 138886798 | d7Mseg1201 | 7726 |
| 7 | 57574850 | 57576750 | 138909129 | 138909629 | d7Mseg1202 | 7727 |
| 7 | 57610200 | 57612800 | 138954829 | 138955383 | d7Mseg1203 | 7728 |
| 7 | 57632800 | 57634100 | 138988196 | 138990271 | d7Mseg1204 | 7729 |
| 7 | 57655000 | 57659550 | 139012164 | 139017130 | d7Mseg1205 | 7730 |
| 7 | 57667000 | 57668600 | 139026626 | 139027927 | d7Mseg1206 | 7731 |
| 7 | 57723000 | 57724000 | 139055531 | 139055991 | d7Mseg1208 | 7732 |
| 7 | 57799400 | 57803350 | 139172227 | 139176447 | d7Mseg1212 | 7733 |
| 7 | 57816150 | 57817150 | 139186360 | 139187124 | d7Mseg1213 | 7734 |
| 7 | 57820600 | 57822300 | 139190009 | 139192320 | d7Mseg1214 | 7735 |
| 7 | 57897000 | 57898600 | 139246106 | 139247243 | d7Mseg1215 | 7736 |
| 7 | 57924600 | 57926050 | 139265900 | 139266606 | d7Mseg1216 | 7737 |
| 7 | 57941900 | 57943700 | 139279344 | 139280405 | d7Mseg1217 | 7738 |
| 7 | 57970300 | 57971950 | 139329689 | 139331596 | d7Mseg1219 | 7739 |
| 7 | 58016500 | 58017800 | 139428337 | 139428642 | d7Mseg1220 | 7740 |
| 7 | 58023150 | 58027350 | 139435386 | 139438602 | d7Mseg1221 | 7741 |
| 7 | 58029900 | 58031700 | 139440158 | 139441944 | d7Mseg1222 | 7742 |
| 7 | 58051850 | 58054150 | 139471603 | 139473881 | d7Mseg1223 | 7743 |
| 7 | 58055850 | 58057250 | 139474933 | 139485755 | d7Mseg1224 | 7744 |
| 7 | 58090000 | 58091400 | 139527124 | 139528588 | d7Mseg1225 | 7745 |
| 7 | 58093400 | 58095200 | 139530686 | 139532366 | d7Mseg1226 | 7746 |
| 7 | 58140550 | 58155350 | 139580490 | 139597036 | d7Mseg1227 | 7747 |
| 7 | 58165000 | 58167100 | 139606013 | 139608635 | d7Mseg1228 | 7748 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 58384850 | 58386550 | 139813773 | 139815971 | d7Mseg1231 | 7749 |
| 7 | 58465000 | 58466750 | 139909059 | 139910219 | d7Mseg1233 | 7750 |
| 7 | 58525200 | 58526900 | 139944578 | 139945782 | d7Mseg1234 | 7751 |
| 7 | 58663700 | 58665150 | 140028027 | 140028808 | d7Mseg1237 | 7752 |
| 7 | 58669750 | 58671600 | 140034198 | 140035090 | d7Mseg1238 | 7753 |
| 7 | 58675550 | 58677350 | 140040110 | 140041802 | d7Mseg1239 | 7754 |
| 7 | 58902100 | 58904000 | 140377605 | 140378501 | d7Mseg1243 | 7755 |
| 7 | 58934950 | 58936400 | 140317220 | 140317391 | d7Mseg1246 | 7756 |
| 7 | 58952850 | 58954350 | 140290024 | 140293902 | d7Mseg1248 | 7757 |
| 7 | 58957950 | 58959600 | 140274917 | 140275522 | d7Mseg1249 | 7758 |
| 7 | 58964100 | 58965700 | 140268009 | 140269956 | d7Mseg1250 | 7759 |
| 7 | 59377900 | 59379350 | 140817693 | 140818068 | d7Mseg1252 | 7760 |
| 7 | 59654450 | 59656000 | 141152255 | 141152448 | d7Mseg1254 | 7761 |
| 7 | 59732000 | 59733550 | 141043698 | 141044410 | d7Mseg1255 | 7762 |
| 7 | 60257750 | 60259350 | 141645503 | 141645843 | d7Mseg1260 | 7763 |
| 7 | 60328950 | 60330400 | 141697400 | 141697914 | d7Mseg1261 | 7764 |
| 7 | 60333600 | 60334700 | 141701687 | 141702583 | d7Mseg1262 | 7765 |
| 7 | 60358800 | 60360600 | 141734606 | 141734949 | d7Mseg1263 | 7766 |
| 7 | 60551350 | 60553250 | 141918750 | 141919340 | d7Mseg1264 | 7767 |
| 7 | 60615600 | 60617300 | 141983211 | 141983387 | d7Mseg1265 | 7768 |
| 7 | 60907800 | 60909550 | 142176537 | 142176875 | d7Mseg1266 | 7769 |
| 7 | 61149350 | 61150750 | 142399415 | 142400245 | d7Mseg1269 | 7770 |
| 7 | 61524000 | 61530100 | 142716690 | 142722819 | d7Mseg1271 | 7771 |
| 7 | 63358150 | 63359900 | 144466717 | 144467918 | d7Mseg1279 | 7772 |
| 7 | 63846600 | 63848250 | 144844453 | 144847661 | d7Mseg1282 | 7773 |
| 7 | 63854000 | 63856750 | 144856740 | 144857718 | d7Mseg1283 | 7774 |
| 7 | 63900800 | 63905250 | 144897705 | 144902105 | d7Mseg1284 | 7775 |
| 7 | 63906250 | 63908900 | 144903114 | 144905761 | d7Mseg1285 | 7776 |
| 7 | 63928000 | 63929650 | 144926400 | 144926929 | d7Mseg1286 | 7777 |
| 7 | 64138700 | 64140250 | 145223055 | 145224629 | d7Mseg1289 | 7778 |
| 7 | 64451200 | 64453150 | 145458604 | 145459922 | d7Mseg1291 | 7779 |
| 7 | 64472650 | 64473800 | 145487301 | 145488595 | d7Mseg1292 | 7780 |
| 7 | 65497350 | 65499300 | 146607457 | 146608792 | d7Mseg1298 | 7781 |
| 7 | 65896600 | 65898050 | 146924168 | 146928985 | d7Mseg1306 | 7782 |
| 7 | 65902700 | 65905800 | 146933222 | 146940547 | d7Mseg1307 | 7783 |
| 7 | 65915350 | 65916650 | 146947717 | 146956114 | d7Mseg1308 | 7784 |
| 7 | 65930300 | 65933100 | 146992254 | 146994838 | d7Mseg1309 | 7785 |
| 7 | 66305550 | 66307300 | 147288427 | 147289227 | d7Mseg1320 | 7786 |
| 7 | 66361850 | 66362900 | 147330986 | 147331400 | d7Mseg1321 | 7787 |
| 7 | 66364600 | 66365700 | 147332932 | 147333643 | d7Mseg1322 | 7788 |
| 7 | 66390250 | 66391650 | 147351653 | 147353040 | d7Mseg1323 | 7789 |
| 7 | 66406550 | 66408250 | 147372678 | 147372973 | d7Mseg1324 | 7790 |
| 7 | 66611300 | 66617600 | 147579836 | 147586312 | d7Mseg1329 | 7791 |
| 7 | 66622250 | 66624200 | 147590811 | 147592758 | d7Mseg1330 | 7792 |
| 7 | 66646150 | 66647800 | 147615213 | 147616214 | d7Mseg1331 | 7793 |
| 7 | 66759400 | 66761050 | 147719435 | 147721104 | d7Mseg1332 | 7794 |
| 7 | 66880800 | 66882300 | 147833273 | 147834183 | d7Mseg1335 | 7795 |
| 7 | 66908150 | 66909650 | 147851588 | 147853287 | d7Mseg1336 | 7796 |
| 7 | 66913250 | 66914700 | 147856589 | 147864319 | d7Mseg1337 | 7797 |
| 7 | 66978700 | 66980300 | 147925058 | 147926809 | d7Mseg1340 | 7798 |
| 7 | 66997750 | 66999000 | 147946438 | 147947572 | d7Mseg1341 | 7799 |
| 7 | 67067550 | 67069150 | 148015670 | 148017370 | d7Mseg1342 | 7800 |
| 7 | 67113250 | 67114850 | 148062880 | 148063791 | d7Mseg1343 | 7801 |
| 7 | 67132650 | 67134100 | 148083832 | 148085381 | d7Mseg1344 | 7802 |
| 7 | 67204900 | 67206350 | 148141610 | 148142956 | d7Mseg1347 | 7803 |
| 7 | 67211750 | 67213450 | 148148674 | 148150153 | d7Mseg1348 | 7804 |
| 7 | 67216400 | 67217650 | 148151702 | 148152010 | d7Mseg1349 | 7805 |
| 7 | 67231000 | 67232850 | 148184311 | 148185873 | d7Mseg1351 | 7806 |
| 7 | 67398850 | 67400400 | 148355268 | 148356853 | d7Mseg1354 | 7807 |
| 7 | 67539950 | 67541950 | 148479700 | 148480642 | d7Mseg1356 | 7808 |
| 7 | 67582850 | 67584700 | 148551742 | 148553461 | d7Mseg1357 | 7809 |
| 7 | 67608200 | 67609500 | 148574205 | 148575872 | d7Mseg1358 | 7810 |
| 7 | 67615850 | 67617800 | 148584521 | 148586400 | d7Mseg1359 | 7811 |
| 7 | 67623250 | 67624750 | 148592205 | 148607263 | d7Mseg1360 | 7812 |
| 7 | 67729150 | 67730900 | 148712174 | 148714034 | d7Mseg1361 | 7813 |
| 7 | 67795200 | 67796600 | 148662163 | 148662484 | d7Mseg1362 | 7814 |
| 7 | 67858400 | 67860050 | 149143513 | 149144925 | d7Mseg1363 | 7815 |
| 7 | 67861650 | 67863400 | 149146670 | 149148115 | d7Mseg1364 | 7816 |
| 7 | 67922900 | 67924650 | 149187024 | 149187514 | d7Mseg1365 | 7817 |
| 7 | 68072950 | 68074700 | 149313658 | 149315427 | d7Mseg1368 | 7818 |
| 7 | 68099650 | 68100700 | 149350667 | 149351773 | d7Mseg1369 | 7819 |
| 7 | 68144700 | 68146150 | 149374855 | 149375923 | d7Mseg1370 | 7820 |
| 7 | 68170850 | 68172300 | 149413480 | 149414297 | d7Mseg1371 | 7821 |
| 7 | 68176350 | 68177600 | 149421989 | 149423304 | d7Mseg1372 | 7822 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 68189050 | 68190950 | 149431047 | 149431717 | d7Mseg1373 | 7823 |
| 7 | 68195750 | 68197250 | 149435111 | 149436178 | d7Mseg1374 | 7824 |
| 7 | 68198500 | 68200200 | 149437096 | 149438842 | d7Mseg1375 | 7825 |
| 7 | 68208500 | 68210500 | 149449297 | 149449967 | d7Mseg1376 | 7826 |
| 7 | 68265250 | 68266700 | 149493557 | 149494011 | d7Mseg1378 | 7827 |
| 7 | 68270550 | 68272400 | 149496841 | 149498434 | d7Mseg1379 | 7828 |
| 7 | 68276750 | 68280150 | 149503063 | 149506784 | d7Mseg1380 | 7829 |
| 7 | 68301500 | 68306350 | 149529896 | 149534532 | d7Mseg1381 | 7830 |
| 7 | 68308900 | 68310600 | 149538744 | 149540733 | d7Mseg1382 | 7831 |
| 7 | 68311900 | 68313400 | 149544584 | 149545741 | d7Mseg1383 | 7832 |
| 7 | 68333900 | 68336250 | 149578145 | 149580412 | d7Mseg1386 | 7833 |
| 7 | 68421150 | 68422750 | 149693513 | 149694494 | d7Mseg1387 | 7834 |
| 7 | 68439400 | 68440850 | 149711461 | 149712599 | d7Mseg1388 | 7835 |
| 7 | 68454750 | 68456200 | 149720466 | 149721028 | d7Mseg1390 | 7836 |
| 7 | 68471600 | 68473100 | 149741492 | 149743052 | d7Mseg1391 | 7837 |
| 7 | 68633300 | 68635200 | 149883887 | 149886078 | d7Mseg1395 | 7838 |
| 7 | 68665450 | 68670600 | 149924231 | 149931862 | d7Mseg1396 | 7839 |
| 7 | 68678000 | 68679400 | 149939545 | 149941100 | d7Mseg1397 | 7840 |
| 7 | 68684750 | 68691750 | 149947424 | 149962499 | d7Mseg1398 | 7841 |
| 7 | 68734600 | 68736000 | 150046939 | 150047592 | d7Mseg1400 | 7842 |
| 7 | 68783600 | 68787550 | 150109177 | 150110952 | d7Mseg1402 | 7843 |
| 7 | 68792300 | 68794350 | 150119455 | 150121165 | d7Mseg1403 | 7844 |
| 7 | 68805250 | 68809850 | 150146454 | 150152649 | d7Mseg1404 | 7845 |
| 7 | 68840200 | 68841600 | 150238332 | 150238685 | d7Mseg1405 | 7846 |
| 7 | 68865650 | 68867400 | 150256220 | 150257046 | d7Mseg1407 | 7847 |
| 7 | 68902450 | 68903750 | 150322055 | 150323006 | d7Mseg1410 | 7848 |
| 7 | 68914050 | 68921750 | 150341933 | 150350499 | d7Mseg1411 | 7849 |
| 7 | 68954400 | 68956100 | 150408671 | 150410009 | d7Mseg1413 | 7850 |
| 7 | 69022500 | 69023900 | 150506946 | 150508443 | d7Mseg1415 | 7851 |
| 7 | 69061200 | 69063200 | 150564437 | 150567623 | d7Mseg1416 | 7852 |
| 7 | 69084450 | 69085600 | 150588488 | 150589043 | d7Mseg1417 | 7853 |
| 7 | 69151500 | 69152900 | 150750968 | 150751575 | d7Mseg1420 | 7854 |
| 7 | 69184700 | 69186150 | 150842348 | 150845127 | d7Mseg1421 | 7855 |
| 7 | 69209400 | 69210650 | 150865018 | 150866747 | d7Mseg1424 | 7856 |
| 7 | 69227100 | 69228350 | 150880672 | 150881495 | d7Mseg1425 | 7857 |
| 7 | 69236750 | 69237750 | 150894771 | 150895880 | d7Mseg1426 | 7858 |
| 7 | 69290650 | 69292550 | 150935839 | 150936869 | d7Mseg1428 | 7859 |
| 7 | 69331700 | 69333400 | 150956748 | 150957438 | d7Mseg1431 | 7860 |
| 7 | 69385050 | 69386650 | 150986516 | 150988072 | d7Mseg1433 | 7861 |
| 7 | 69496400 | 69500700 | 151120596 | 151121345 | d7Mseg1435 | 7862 |
| 7 | 69517250 | 69520800 | 151139787 | 151143870 | d7Mseg1436 | 7863 |
| 7 | 69671600 | 69673050 | 151329766 | 151331282 | d7Mseg1443 | 7864 |
| 7 | 69679100 | 69680750 | 151335852 | 151337243 | d7Mseg1445 | 7865 |
| 7 | 69686250 | 69688050 | 151355395 | 151356349 | d7Mseg1446 | 7866 |
| 7 | 69732550 | 69733600 | 151411738 | 151412413 | d7Mseg1448 | 7867 |
| 7 | 69747800 | 69749500 | 151434940 | 151435571 | d7Mseg1449 | 7868 |
| 7 | 69811900 | 69813100 | 151538287 | 151538923 | d7Mseg1451 | 7869 |
| 7 | 69900350 | 69901900 | 151618590 | 151620055 | d7Mseg1453 | 7870 |
| 7 | 70046950 | 70050650 | 151785671 | 151787478 | d7Mseg1457 | 7871 |
| 7 | 70069750 | 70071700 | 151805524 | 151807629 | d7Mseg1458 | 7872 |
| 7 | 70142150 | 70144350 | 151979703 | 151983157 | d7Mseg1461 | 7873 |
| 7 | 70153300 | 70154550 | 151989218 | 151990282 | d7Mseg1462 | 7874 |
| 7 | 70193800 | 70195550 | 152027256 | 152028431 | d7Mseg1463 | 7875 |
| 7 | 70220350 | 70221800 | 152056041 | 152056981 | d7Mseg1464 | 7876 |
| 7 | 70232550 | 70233700 | 152066464 | 152067633 | d7Mseg1465 | 7877 |
| 7 | 70257400 | 70259250 | 152113641 | 152129138 | d7Mseg1466 | 7878 |
| 7 | 70276250 | 70277250 | 152141408 | 152142118 | d7Mseg1469 | 7879 |
| 7 | 70307450 | 70311500 | 152223647 | 152226743 | d7Mseg1471 | 7880 |
| 7 | 70472950 | 70474700 | 154611555 | 154612779 | d7Mseg1475 | 7881 |
| 7 | 70487400 | 70488950 | 152517384 | 152517665 | d7Mseg1476 | 7882 |
| 7 | 70576900 | 70578150 | 152574778 | 152575327 | d7Mseg1478 | 7883 |
| 7 | 70580600 | 70583700 | 152585591 | 152587627 | d7Mseg1479 | 7884 |
| 7 | 70601650 | 70603300 | 152615594 | 152617358 | d7Mseg1481 | 7885 |
| 7 | 70640300 | 70642000 | 152661058 | 152662637 | d7Mseg1485 | 7886 |
| 7 | 70655550 | 70660200 | 152676030 | 152680458 | d7Mseg1486 | 7887 |
| 7 | 70664850 | 70671150 | 152684240 | 152690372 | d7Mseg1487 | 7888 |
| 7 | 70679100 | 70681100 | 152709968 | 152711880 | d7Mseg1488 | 7889 |
| 7 | 70702900 | 70704800 | 152731556 | 152736608 | d7Mseg1489 | 7890 |
| 7 | 70723900 | 70725000 | 152755709 | 152756746 | d7Mseg1490 | 7891 |
| 7 | 70726950 | 70728100 | 152758939 | 152759515 | d7Mseg1491 | 7892 |
| 7 | 70743300 | 70746000 | 152776894 | 152780147 | d7Mseg1492 | 7893 |
| 7 | 70748300 | 70751550 | 152783051 | 152786127 | d7Mseg1493 | 7894 |
| 7 | 70757200 | 70759150 | 152791666 | 152793578 | d7Mseg1494 | 7895 |
| 7 | 70767850 | 70769300 | 152801185 | 152802481 | d7Mseg1495 | 7896 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 70781750 | 70783700 | 152814373 | 152815781 | d7Mseg1496 | 7897 |
| 7 | 70794950 | 70796450 | 152824516 | 152825346 | d7Mseg1497 | 7898 |
| 7 | 70812950 | 70814750 | 152842547 | 152844430 | d7Mseg1498 | 7899 |
| 7 | 70860100 | 70861950 | 152889319 | 152890840 | d7Mseg1502 | 7900 |
| 7 | 70875500 | 70877250 | 152902517 | 152904457 | d7Mseg1503 | 7901 |
| 7 | 70880250 | 70886600 | 152907256 | 152914605 | d7Mseg1504 | 7902 |
| 7 | 70905400 | 70911700 | 152939259 | 152940828 | d7Mseg1506 | 7903 |
| 7 | 70919050 | 70921750 | 152953952 | 152956569 | d7Mseg1507 | 7904 |
| 7 | 70933800 | 70935300 | 152968165 | 152969856 | d7Mseg1508 | 7905 |
| 7 | 70948600 | 70949900 | 152978675 | 152979290 | d7Mseg1509 | 7906 |
| 7 | 70980950 | 70982700 | 153007419 | 153008992 | d7Mseg1510 | 7907 |
| 7 | 71012250 | 71013900 | 153039280 | 153040901 | d7Mseg1513 | 7908 |
| 7 | 71069800 | 71072250 | 153095872 | 153098097 | d7Mseg1515 | 7909 |
| 7 | 71109050 | 71113450 | 153136083 | 153139765 | d7Mseg1516 | 7910 |
| 7 | 71120500 | 71121700 | 153146752 | 153147992 | d7Mseg1517 | 7911 |
| 7 | 71124250 | 71126750 | 153149710 | 153152251 | d7Mseg1518 | 7912 |
| 7 | 71149300 | 71150850 | 153184225 | 153185985 | d7Mseg1520 | 7913 |
| 7 | 71154300 | 71156050 | 153189067 | 153191013 | d7Mseg1521 | 7914 |
| 7 | 71159150 | 71160750 | 153193580 | 153193885 | d7Mseg1522 | 7915 |
| 7 | 71161900 | 71162900 | 153195212 | 153196011 | d7Mseg1523 | 7916 |
| 7 | 71165700 | 71168200 | 153198707 | 153201262 | d7Mseg1524 | 7917 |
| 7 | 71194550 | 71196000 | 153219530 | 153220953 | d7Mseg1525 | 7918 |
| 7 | 71210350 | 71212250 | 153235226 | 153237200 | d7Mseg1526 | 7919 |
| 7 | 71223000 | 71225100 | 153250317 | 153251338 | d7Mseg1527 | 7920 |
| 7 | 71283100 | 71284300 | 153298540 | 153300521 | d7Mseg1529 | 7921 |
| 7 | 71292500 | 71294500 | 153316742 | 153324650 | d7Mseg1530 | 7922 |
| 7 | 71335250 | 71336950 | 153370538 | 153371498 | d7Mseg1532 | 7923 |
| 7 | 71382350 | 71384100 | 153418367 | 153418693 | d7Mseg1533 | 7924 |
| 7 | 71386600 | 71389900 | 153420655 | 153422775 | d7Mseg1534 | 7925 |
| 7 | 71459950 | 71461300 | 153562710 | 153563290 | d7Mseg1535 | 7926 |
| 7 | 71489000 | 71492050 | 153596991 | 153599880 | d7Mseg1536 | 7927 |
| 7 | 71499550 | 71501250 | 153606662 | 153608766 | d7Mseg1537 | 7928 |
| 7 | 71525800 | 71528950 | 153636851 | 153640773 | d7Mseg1538 | 7929 |
| 7 | 71544200 | 71546300 | 153658402 | 153660981 | d7Mseg1539 | 7930 |
| 7 | 71549400 | 71551350 | 153664294 | 153666201 | d7Mseg1540 | 7931 |
| 7 | 71566400 | 71568000 | 153679299 | 153679715 | d7Mseg1541 | 7932 |
| 7 | 71572900 | 71574500 | 153686143 | 153686719 | d7Mseg1542 | 7933 |
| 7 | 71597350 | 71599550 | 153706025 | 153707374 | d7Mseg1543 | 7934 |
| 7 | 71673000 | 71675050 | 153773591 | 153775852 | d7Mseg1547 | 7935 |
| 7 | 71693150 | 71694750 | 153792146 | 153794634 | d7Mseg1548 | 7936 |
| 7 | 71991550 | 71992850 | 153706095 | 153706314 | d7Mseg1554 | 7937 |
| 7 | 72211950 | 72213350 | 153705935 | 153706160 | d7Mseg1558 | 7938 |
| 7 | 72290150 | 72291950 | 153956437 | 153958245 | d7Mseg1561 | 7939 |
| 7 | 72333300 | 72334800 | 153982106 | 153982301 | d7Mseg1562 | 7940 |
| 7 | 72369350 | 72371100 | 154019364 | 154020441 | d7Mseg1563 | 7941 |
| 7 | 72409000 | 72410950 | 154060856 | 154061237 | d7Mseg1565 | 7942 |
| 7 | 72456150 | 72457900 | 154089731 | 154092130 | d7Mseg1566 | 7943 |
| 7 | 72557650 | 72561700 | 154180211 | 154181981 | d7Mseg1568 | 7944 |
| 7 | 72639750 | 72640950 | 154282973 | 154284279 | d7Mseg1570 | 7945 |
| 7 | 72732250 | 72734250 | 154372800 | 154373844 | d7Mseg1573 | 7946 |
| 7 | 72758200 | 72760250 | 154444032 | 154445346 | d7Mseg1574 | 7947 |
| 7 | 72786450 | 72787600 | 154471601 | 154471774 | d7Mseg1576 | 7948 |
| 7 | 72821850 | 72824150 | 154492014 | 154494231 | d7Mseg1577 | 7949 |
| 7 | 73053450 | 73054650 | 114861747 | 114862637 | d7Mseg1579 | 7950 |
| 7 | 73110250 | 73112150 | 114806989 | 114808563 | d7Mseg1580 | 7951 |
| 7 | 73115600 | 73117100 | 114798581 | 114799081 | d7Mseg1581 | 7952 |
| 7 | 73118600 | 73123600 | 114793735 | 114797278 | d7Mseg1582 | 7953 |
| 7 | 73147200 | 73148700 | 114768567 | 114769647 | d7Mseg1583 | 7954 |
| 7 | 73314150 | 73315500 | 114656166 | 114657201 | d7Mseg1585 | 7955 |
| 7 | 73332800 | 73334600 | 114641567 | 114641991 | d7Mseg1586 | 7956 |
| 7 | 73954550 | 73956650 | 8811634 | 8812303 | d7Mseg1592 | 7957 |
| 7 | 74652300 | 74654250 | 9269573 | 9270527 | d7Mseg1599 | 7958 |
| 7 | 74664750 | 74666050 | 9297790 | 9299098 | d7Mseg1600 | 7959 |
| 7 | 74676700 | 74678750 | 9309273 | 9310398 | d7Mseg1601 | 7960 |
| 7 | 74691600 | 74693200 | 9320690 | 9322503 | d7Mseg1602 | 7961 |
| 7 | 74920750 | 74922600 | 9933562 | 9935438 | d7Mseg1605 | 7962 |
| 7 | 75725050 | 75728900 | 37285441 | 37294049 | d7Mseg1612 | 7963 |
| 7 | 75828600 | 75830000 | 37207650 | 37209172 | d7Mseg1613 | 7964 |
| 7 | 76511500 | 76513000 | 36401010 | 36403291 | d7Mseg1616 | 7965 |
| 7 | 77182850 | 77184600 | 35485673 | 35486457 | d7Mseg1619 | 7966 |
| 7 | 78310450 | 78311900 | 34680178 | 34682234 | d7Mseg1626 | 7967 |
| 7 | 78315700 | 78317600 | 34673891 | 34675816 | d7Mseg1627 | 7968 |
| 7 | 78342250 | 78344000 | 34644750 | 34646160 | d7Mseg1628 | 7969 |
| 7 | 78362300 | 78364000 | 34627960 | 34628369 | d7Mseg1629 | 7970 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 79623400 | 79624600 | 33687656 | 33687877 | d7Mseg1634 | 7971 |
| 7 | 80205750 | 80207700 | 33216156 | 33217581 | d7Mseg1639 | 7972 |
| 7 | 80405800 | 80407550 | 33013820 | 33016706 | d7Mseg1641 | 7973 |
| 7 | 80469300 | 80471000 | 32948473 | 32949339 | d7Mseg1642 | 7974 |
| 7 | 80502150 | 80503600 | 32924975 | 32926317 | d7Mseg1643 | 7975 |
| 7 | 80510700 | 80511800 | 32914363 | 32915119 | d7Mseg1644 | 7976 |
| 7 | 80600000 | 80602050 | 32853369 | 32853783 | d7Mseg1647 | 7977 |
| 7 | 80779100 | 80780800 | 32792070 | 32795908 | d7Mseg1655 | 7978 |
| 7 | 80803250 | 80804700 | 32784908 | 32785324 | d7Mseg1656 | 7979 |
| 7 | 80975500 | 80977300 | 32561342 | 32562574 | d7Mseg1657 | 7980 |
| 7 | 81017800 | 81018850 | 32518838 | 32520032 | d7Mseg1660 | 7981 |
| 7 | 81145450 | 81146700 | 32388926 | 32389220 | d7Mseg1663 | 7982 |
| 7 | 81204800 | 81206050 | 32314046 | 32315086 | d7Mseg1664 | 7983 |
| 7 | 81322550 | 81323600 | 32171957 | 32173025 | d7Mseg1666 | 7984 |
| 7 | 81439050 | 81440650 | 32052274 | 32052799 | d7Mseg1668 | 7985 |
| 7 | 81500700 | 81501800 | 31995704 | 31996870 | d7Mseg1669 | 7986 |
| 7 | 81524300 | 81525350 | 31980546 | 31981019 | d7Mseg1670 | 7987 |
| 7 | 81574650 | 81575850 | 31931494 | 31931718 | d7Mseg1671 | 7988 |
| 7 | 81640900 | 81642200 | 31874352 | 31875671 | d7Mseg1672 | 7989 |
| 7 | 81706400 | 81708100 | 31798558 | 31801977 | d7Mseg1674 | 7990 |
| 7 | 81801850 | 81803450 | 31723606 | 31725336 | d7Mseg1676 | 7991 |
| 7 | 81845550 | 81847150 | 31674006 | 31675164 | d7Mseg1677 | 7992 |
| 7 | 81904250 | 81905500 | 31632349 | 31633483 | d7Mseg1678 | 7993 |
| 7 | 81913850 | 81915450 | 31623538 | 31625254 | d7Mseg1679 | 7994 |
| 7 | 81945100 | 81946900 | 31589196 | 31590001 | d7Mseg1680 | 7995 |
| 7 | 81951100 | 81952750 | 31581527 | 31583745 | d7Mseg1681 | 7996 |
| 7 | 81966100 | 81970350 | 31567380 | 31572011 | d7Mseg1682 | 7997 |
| 7 | 82019050 | 82020750 | 31523363 | 31525440 | d7Mseg1683 | 7998 |
| 7 | 82023200 | 82024850 | 31518190 | 31520702 | d7Mseg1684 | 7999 |
| 7 | 82033700 | 82034700 | 31508175 | 31509497 | d7Mseg1685 | 8000 |
| 7 | 82101200 | 82104600 | 31455040 | 31457069 | d7Mseg1686 | 8001 |
| 7 | 82113500 | 82116250 | 31446166 | 31447521 | d7Mseg1688 | 8002 |
| 7 | 82120150 | 82121800 | 31443541 | 31444319 | d7Mseg1689 | 8003 |
| 7 | 82137150 | 82138800 | 31426405 | 31428639 | d7Mseg1690 | 8004 |
| 7 | 82153650 | 82155400 | 31407167 | 31407699 | d7Mseg1692 | 8005 |
| 7 | 82156750 | 82158350 | 31403055 | 31405363 | d7Mseg1693 | 8006 |
| 7 | 82160400 | 82161450 | 31394111 | 31395069 | d7Mseg1694 | 8007 |
| 7 | 82187000 | 82189200 | 31367039 | 31368918 | d7Mseg1695 | 8008 |
| 7 | 82193550 | 82195250 | 31359217 | 31360463 | d7Mseg1696 | 8009 |
| 7 | 82208450 | 82209950 | 31346666 | 31347488 | d7Mseg1697 | 8010 |
| 7 | 82266550 | 82267550 | 31299175 | 31299619 | d7Mseg1698 | 8011 |
| 7 | 82288700 | 82290450 | 31288167 | 31289445 | d7Mseg1700 | 8012 |
| 7 | 82293700 | 82295000 | 31283765 | 31285017 | d7Mseg1701 | 8013 |
| 7 | 82311400 | 82313150 | 31262056 | 31262987 | d7Mseg1702 | 8014 |
| 7 | 82347800 | 82349650 | 31228686 | 31230254 | d7Mseg1703 | 8015 |
| 7 | 82367700 | 82368950 | 31208078 | 31210281 | d7Mseg1704 | 8016 |
| 7 | 82381500 | 82382800 | 31203831 | 31204993 | d7Mseg1706 | 8017 |
| 7 | 82458050 | 82459200 | 31129523 | 31130334 | d7Mseg1707 | 8018 |
| 7 | 82499650 | 82501400 | 31103829 | 31105595 | d7Mseg1709 | 8019 |
| 7 | 82514350 | 82516200 | 31089080 | 31090136 | d7Mseg1710 | 8020 |
| 7 | 82611550 | 82613500 | 31028230 | 31028614 | d7Mseg1713 | 8021 |
| 7 | 82670750 | 82672600 | 30994106 | 30994438 | d7Mseg1714 | 8022 |
| 7 | 82722950 | 82724800 | 30964512 | 30966028 | d7Mseg1715 | 8023 |
| 7 | 82777700 | 82779100 | 30934995 | 30935435 | d7Mseg1717 | 8024 |
| 7 | 82814050 | 82815900 | 30909800 | 30911227 | d7Mseg1718 | 8025 |
| 7 | 82818550 | 82821050 | 30905717 | 30908241 | d7Mseg1719 | 8026 |
| 7 | 82822500 | 82823700 | 30903337 | 30904238 | d7Mseg1720 | 8027 |
| 7 | 82840650 | 82842250 | 30887863 | 30889071 | d7Mseg1721 | 8028 |
| 7 | 83000700 | 83002300 | 30691250 | 30692397 | d7Mseg1725 | 8029 |
| 7 | 83124500 | 83126300 | 30587135 | 30588936 | d7Mseg1728 | 8030 |
| 7 | 83154000 | 83155400 | 30545924 | 30546443 | d7Mseg1729 | 8031 |
| 7 | 83175650 | 83177900 | 30523272 | 30524982 | d7Mseg1730 | 8032 |
| 7 | 83216350 | 83219100 | 30494499 | 30495893 | d7Mseg1731 | 8033 |
| 7 | 83223300 | 83224950 | 30490834 | 30491249 | d7Mseg1732 | 8034 |
| 7 | 83322100 | 83323300 | 30431946 | 30432759 | d7Mseg1736 | 8035 |
| 7 | 83418600 | 83420450 | 30346214 | 30349503 | d7Mseg1738 | 8036 |
| 7 | 83435400 | 83438050 | 30326575 | 30329333 | d7Mseg1739 | 8037 |
| 7 | 83455400 | 83457350 | 30310417 | 30311435 | d7Mseg1741 | 8038 |
| 7 | 83538650 | 83540550 | 30271481 | 30272220 | d7Mseg1742 | 8039 |
| 7 | 83591000 | 83592600 | 30260066 | 30260444 | d7Mseg1745 | 8040 |
| 7 | 83657050 | 83660550 | 30223406 | 30223935 | d7Mseg1747 | 8041 |
| 7 | 83662450 | 83663850 | 30221416 | 30221910 | d7Mseg1748 | 8042 |
| 7 | 83705650 | 83706850 | 30191069 | 30192090 | d7Mseg1750 | 8043 |
| 7 | 83722800 | 83724100 | 30182052 | 30182634 | d7Mseg1752 | 8044 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 83933100 | 83934650 | 30046019 | 30048010 | d7Mseg1755 | 8045 |
| 7 | 83964950 | 83966050 | 30020273 | 30021117 | d7Mseg1756 | 8046 |
| 7 | 83993000 | 83994650 | 29972392 | 29973517 | d7Mseg1757 | 8047 |
| 7 | 84016650 | 84018200 | 29947032 | 29949358 | d7Mseg1758 | 8048 |
| 7 | 84030400 | 84032150 | 29936884 | 29938351 | d7Mseg1759 | 8049 |
| 7 | 84063450 | 84064700 | 29905105 | 29907099 | d7Mseg1760 | 8050 |
| 7 | 84110900 | 84112050 | 29859501 | 29869736 | d7Mseg1762 | 8051 |
| 7 | 84144500 | 84146000 | 29819270 | 29820348 | d7Mseg1763 | 8052 |
| 7 | 84203350 | 84207100 | 29777427 | 29780471 | d7Mseg1764 | 8053 |
| 7 | 84270150 | 84271300 | 29712683 | 29714088 | d7Mseg1765 | 8054 |
| 7 | 84314300 | 84316150 | 29657466 | 29658758 | d7Mseg1766 | 8055 |
| 7 | 84354400 | 84357800 | 29627662 | 29628295 | d7Mseg1767 | 8056 |
| 7 | 84469100 | 84470600 | 29479128 | 29480484 | d7Mseg1769 | 8057 |
| 7 | 84574750 | 84576600 | 29378523 | 29379850 | d7Mseg1770 | 8058 |
| 7 | 84591350 | 84592850 | 29370767 | 29371119 | d7Mseg1771 | 8059 |
| 7 | 84634800 | 84637850 | 29329300 | 29332544 | d7Mseg1774 | 8060 |
| 7 | 84684050 | 84685750 | 29280872 | 29285585 | d7Mseg1775 | 8061 |
| 7 | 84713100 | 84714600 | 29252778 | 29253973 | d7Mseg1776 | 8062 |
| 7 | 84898700 | 84900250 | 29064653 | 29066395 | d7Mseg1779 | 8063 |
| 7 | 84908500 | 84910350 | 29052618 | 29054994 | d7Mseg1780 | 8064 |
| 7 | 84947200 | 84948550 | 29016552 | 29017744 | d7Mseg1781 | 8065 |
| 7 | 84977000 | 84978550 | 28982631 | 28983787 | d7Mseg1782 | 8066 |
| 7 | 85066100 | 85067800 | 89176629 | 89177426 | d7Mseg1785 | 8067 |
| 7 | 85132350 | 85134100 | 28809368 | 28811536 | d7Mseg1786 | 8068 |
| 7 | 85148700 | 85150250 | 28797367 | 28798373 | d7Mseg1787 | 8069 |
| 7 | 85160000 | 85161250 | 28793576 | 28793827 | d7Mseg1788 | 8070 |
| 7 | 85253750 | 85255600 | 28712224 | 28713482 | d7Mseg1789 | 8071 |
| 7 | 85352350 | 85353850 | 28612592 | 28613823 | d7Mseg1790 | 8072 |
| 7 | 85366200 | 85367850 | 28598697 | 28600326 | d7Mseg1791 | 8073 |
| 7 | 85386150 | 85387750 | 28582850 | 28583331 | d7Mseg1792 | 8074 |
| 7 | 85412500 | 85413750 | 28564875 | 28566470 | d7Mseg1793 | 8075 |
| 7 | 85697550 | 85699300 | 28374271 | 28374639 | d7Mseg1796 | 8076 |
| 7 | 85854400 | 85855850 | 28277627 | 28278498 | d7Mseg1797 | 8077 |
| 7 | 85997650 | 85999700 | 28218619 | 28220150 | d7Mseg1798 | 8078 |
| 7 | 87456250 | 87457700 | 27109563 | 27109810 | d7Mseg1808 | 8079 |
| 7 | 88214600 | 88216350 | 26462918 | 26463788 | d7Mseg1811 | 8080 |
| 7 | 88611450 | 88613000 | 26190646 | 26191846 | d7Mseg1813 | 8081 |
| 7 | 89357750 | 89359700 | 26167590 | 26168733 | d7Mseg1817 | 8082 |
| 7 | 89617250 | 89619050 | 25843233 | 25844918 | d7Mseg1818 | 8083 |
| 7 | 89661350 | 89662950 | 25784713 | 25785054 | d7Mseg1819 | 8084 |
| 7 | 89677300 | 89679000 | 25765103 | 25765582 | d7Mseg1820 | 8085 |
| 7 | 89711900 | 89713300 | 25733771 | 25734747 | d7Mseg1821 | 8086 |
| 7 | 89725400 | 89726850 | 25721339 | 25721715 | d7Mseg1822 | 8087 |
| 7 | 89753550 | 89754600 | 25673264 | 25680466 | d7Mseg1823 | 8088 |
| 7 | 89777800 | 89778950 | 25634289 | 25635158 | d7Mseg1824 | 8089 |
| 7 | 89827250 | 89828800 | 25564129 | 25565592 | d7Mseg1825 | 8090 |
| 7 | 89939950 | 89941550 | 25471542 | 25471872 | d7Mseg1827 | 8091 |
| 7 | 89954050 | 89955800 | 25463144 | 25463717 | d7Mseg1828 | 8092 |
| 7 | 89966400 | 89967950 | 25460338 | 25461852 | d7Mseg1829 | 8093 |
| 7 | 89983750 | 89985350 | 25450883 | 25451348 | d7Mseg1831 | 8094 |
| 7 | 90037450 | 90039000 | 25399192 | 25400180 | d7Mseg1832 | 8095 |
| 7 | 90054850 | 90056400 | 25373509 | 25374393 | d7Mseg1833 | 8096 |
| 7 | 90198450 | 90199800 | 25257535 | 25259103 | d7Mseg1836 | 8097 |
| 7 | 90266200 | 90268050 | 25206553 | 25206758 | d7Mseg1840 | 8098 |
| 7 | 90305150 | 90306900 | 25172141 | 25172448 | d7Mseg1841 | 8099 |
| 7 | 90353100 | 90354600 | 25122790 | 25123945 | d7Mseg1842 | 8100 |
| 7 | 90402900 | 90404000 | 145892354 | 145892535 | d7Mseg1844 | 8101 |
| 7 | 90506300 | 90507600 | 25062850 | 25063217 | d7Mseg1847 | 8102 |
| 7 | 90518950 | 90520700 | 25045379 | 25046103 | d7Mseg1848 | 8103 |
| 7 | 90523800 | 90549300 | 25016147 | 25042007 | d7Mseg1849 | 8104 |
| 7 | 90562400 | 90563700 | 24999621 | 25000903 | d7Mseg1850 | 8105 |
| 7 | 90663350 | 90664650 | 24908612 | 24909571 | d7Mseg1853 | 8106 |
| 7 | 90668650 | 90670400 | 24899649 | 24902937 | d7Mseg1854 | 8107 |
| 7 | 90705050 | 90706900 | 24861601 | 24863356 | d7Mseg1855 | 8108 |
| 7 | 90791750 | 90793450 | 24780008 | 24781739 | d7Mseg1856 | 8109 |
| 7 | 90836900 | 90838650 | 24745220 | 24745897 | d7Mseg1857 | 8110 |
| 7 | 90921800 | 90923650 | 24661635 | 24664088 | d7Mseg1860 | 8111 |
| 7 | 90930800 | 90932450 | 24656243 | 24657532 | d7Mseg1861 | 8112 |
| 7 | 90934450 | 90935450 | 24652415 | 24653275 | d7Mseg1862 | 8113 |
| 7 | 90947350 | 90949000 | 24635076 | 24637271 | d7Mseg1863 | 8114 |
| 7 | 90976400 | 90978000 | 24595934 | 24598475 | d7Mseg1864 | 8115 |
| 7 | 90994400 | 90995900 | 24575595 | 24577634 | d7Mseg1865 | 8116 |
| 7 | 91038400 | 91039950 | 24530959 | 24531974 | d7Mseg1866 | 8117 |
| 7 | 91076600 | 91079100 | 24481557 | 24484295 | d7Mseg1867 | 8118 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 91089650 | 91090900 | 24466578 | 24468076 | d7Mseg1868 | 8119 |
| 7 | 91098500 | 91102550 | 24457070 | 24462021 | d7Mseg1869 | 8120 |
| 7 | 91105400 | 91107050 | 24445396 | 24446221 | d7Mseg1870 | 8121 |
| 7 | 91120450 | 91122200 | 24423079 | 24424730 | d7Mseg1871 | 8122 |
| 7 | 91135950 | 91137400 | 24411015 | 24412569 | d7Mseg1873 | 8123 |
| 7 | 91145200 | 91146800 | 24399106 | 24405445 | d7Mseg1874 | 8124 |
| 7 | 91155700 | 91157600 | 24388624 | 24390656 | d7Mseg1875 | 8125 |
| 7 | 91200650 | 91202450 | 24350993 | 24351520 | d7Mseg1878 | 8126 |
| 7 | 91224850 | 91226700 | 24331136 | 24331586 | d7Mseg1879 | 8127 |
| 7 | 91243700 | 91245300 | 24310317 | 24312581 | d7Mseg1881 | 8128 |
| 7 | 91247550 | 91250050 | 24306545 | 24309572 | d7Mseg1882 | 8129 |
| 7 | 91324250 | 91326300 | 24226912 | 24229377 | d7Mseg1885 | 8130 |
| 7 | 91371750 | 91372750 | 24164211 | 24164875 | d7Mseg1886 | 8131 |
| 7 | 91384050 | 91385400 | 24153179 | 24154308 | d7Mseg1887 | 8132 |
| 7 | 91387900 | 91389650 | 24144138 | 24146698 | d7Mseg1888 | 8133 |
| 7 | 91458400 | 91459850 | 24069834 | 24072674 | d7Mseg1890 | 8134 |
| 7 | 91480150 | 91482300 | 24041384 | 24043582 | d7Mseg1891 | 8135 |
| 7 | 91493550 | 91494850 | 24028645 | 24029306 | d7Mseg1892 | 8136 |
| 7 | 91504350 | 91506250 | 24019124 | 24020452 | d7Mseg1893 | 8137 |
| 7 | 91507950 | 91509400 | 24016865 | 24018314 | d7Mseg1894 | 8138 |
| 7 | 91519100 | 91520800 | 24004075 | 24005729 | d7Mseg1895 | 8139 |
| 7 | 91570500 | 91572250 | 23970986 | 23972049 | d7Mseg1898 | 8140 |
| 7 | 91573500 | 91575050 | 23968425 | 23969197 | d7Mseg1899 | 8141 |
| 7 | 91587900 | 91591400 | 23950576 | 23955983 | d7Mseg1900 | 8142 |
| 7 | 91594150 | 91595200 | 23943839 | 23944757 | d7Mseg1901 | 8143 |
| 7 | 91609400 | 91614150 | 23922176 | 23928640 | d7Mseg1904 | 8144 |
| 7 | 91627200 | 91628500 | 23896303 | 23897718 | d7Mseg1905 | 8145 |
| 7 | 91631600 | 91633200 | 23892373 | 23892878 | d7Mseg1906 | 8146 |
| 7 | 91704850 | 91706550 | 51810636 | 51813361 | d7Mseg1909 | 8147 |
| 7 | 91782700 | 91784350 | 51639768 | 51641671 | d7Mseg1915 | 8148 |
| 7 | 91786200 | 91788100 | 51635990 | 51637836 | d7Mseg1916 | 8149 |
| 7 | 91797150 | 91798200 | 51599825 | 51600417 | d7Mseg1918 | 8150 |
| 7 | 91880500 | 91882850 | 51485471 | 51487965 | d7Mseg1921 | 8151 |
| 7 | 91890300 | 91892050 | 51491994 | 51492629 | d7Mseg1923 | 8152 |
| 7 | 91973300 | 91975100 | 57621606 | 57623474 | d7Mseg1928 | 8153 |
| 7 | 92219900 | 92223600 | 62568906 | 62571967 | d7Mseg1940 | 8154 |
| 7 | 92248350 | 92249450 | 62858799 | 62862742 | d7Mseg1941 | 8155 |
| 7 | 92264050 | 92265750 | 62883670 | 62884994 | d7Mseg1942 | 8156 |
| 7 | 92268250 | 92269900 | 62887454 | 62888850 | d7Mseg1943 | 8157 |
| 7 | 92276150 | 92277550 | 62898076 | 62898866 | d7Mseg1944 | 8158 |
| 7 | 92302350 | 92304150 | 62921716 | 62922221 | d7Mseg1945 | 8159 |
| 7 | 92327050 | 92330100 | 62945390 | 62949127 | d7Mseg1947 | 8160 |
| 7 | 92335250 | 92337200 | 62956371 | 62956737 | d7Mseg1948 | 8161 |
| 7 | 92350650 | 92352250 | 62963439 | 62964846 | d7Mseg1949 | 8162 |
| 7 | 92365400 | 92367650 | 62976676 | 62978772 | d7Mseg1950 | 8163 |
| 7 | 92501150 | 92502200 | 63072637 | 63073497 | d7Mseg1953 | 8164 |
| 7 | 92535850 | 92538050 | 63138696 | 63138975 | d7Mseg1954 | 8165 |
| 7 | 92620600 | 92623150 | 63409908 | 63412464 | d7Mseg1955 | 8166 |
| 7 | 92638300 | 92640200 | 63423584 | 63425660 | d7Mseg1956 | 8167 |
| 7 | 92653450 | 92654950 | 63430922 | 63431904 | d7Mseg1958 | 8168 |
| 7 | 92672200 | 92673400 | 63449218 | 63450416 | d7Mseg1959 | 8169 |
| 7 | 92718000 | 92719900 | 63492505 | 63556332 | d7Mseg1964 | 8170 |
| 7 | 92880300 | 92881900 | 64233968 | 64235103 | d7Mseg1969 | 8171 |
| 7 | 92906500 | 92907900 | 64253522 | 64255559 | d7Mseg1970 | 8172 |
| 7 | 93131150 | 93133000 | 64732941 | 64734885 | d7Mseg1976 | 8173 |
| 7 | 93203200 | 93204750 | 64802920 | 64803138 | d7Mseg1978 | 8174 |
| 7 | 93207000 | 93208750 | 64807716 | 64808948 | d7Mseg1979 | 8175 |
| 7 | 93215900 | 93217900 | 64816291 | 64818878 | d7Mseg1980 | 8176 |
| 7 | 93246950 | 93248000 | 64855009 | 64855155 | d7Mseg1981 | 8177 |
| 7 | 93281700 | 93283200 | 64872074 | 64873274 | d7Mseg1983 | 8178 |
| 7 | 93285700 | 93287100 | 64875932 | 64876929 | d7Mseg1984 | 8179 |
| 7 | 93291150 | 93293200 | 64887278 | 64888973 | d7Mseg1985 | 8180 |
| 7 | 93315000 | 93316100 | 64907980 | 64908886 | d7Mseg1986 | 8181 |
| 7 | 93346550 | 93347800 | 64948633 | 64949241 | d7Mseg1988 | 8182 |
| 7 | 93440500 | 93442200 | 65241111 | 65241477 | d7Mseg1989 | 8183 |
| 7 | 93508350 | 93510150 | 65291129 | 65297937 | d7Mseg1992 | 8184 |
| 7 | 93512100 | 93513500 | 65301609 | 65302187 | d7Mseg1993 | 8185 |
| 7 | 93690650 | 93693400 | 65416207 | 65417741 | d7Mseg2000 | 8186 |
| 7 | 93720300 | 93721400 | 65421692 | 65422052 | d7Mseg2002 | 8187 |
| 7 | 94144800 | 94146200 | 25077998 | 25078404 | d7Mseg2012 | 8188 |
| 7 | 94539900 | 94541650 | 65825376 | 65830256 | d7Mseg2020 | 8189 |
| 7 | 94543350 | 94545000 | 65831462 | 65832032 | d7Mseg2021 | 8190 |
| 7 | 94569650 | 94571350 | 65856296 | 65857881 | d7Mseg2022 | 8191 |
| 7 | 94595000 | 94596450 | 65896420 | 65897702 | d7Mseg2023 | 8192 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 94898350 | 94899700 | 66268475 | 66269224 | d7Mseg2031 | 8193 |
| 7 | 95048400 | 95049750 | 66429855 | 66431225 | d7Mseg2035 | 8194 |
| 7 | 95343100 | 95348700 | 66762816 | 66768622 | d7Mseg2041 | 8195 |
| 7 | 95356200 | 95357350 | 66777176 | 66778471 | d7Mseg2042 | 8196 |
| 7 | 95359200 | 95363200 | 66780392 | 66784533 | d7Mseg2043 | 8197 |
| 7 | 95365300 | 95366500 | 66786951 | 66788335 | d7Mseg2044 | 8198 |
| 7 | 95392450 | 95394200 | 66801391 | 66801846 | d7Mseg2045 | 8199 |
| 7 | 95410200 | 95412650 | 66815685 | 66818002 | d7Mseg2046 | 8200 |
| 7 | 95444050 | 95445800 | 66856637 | 66862349 | d7Mseg2047 | 8201 |
| 7 | 95462400 | 95464100 | 66878061 | 66885225 | d7Mseg2048 | 8202 |
| 7 | 95727100 | 95728350 | 67222834 | 67226420 | d7Mseg2052 | 8203 |
| 7 | 95823500 | 95825200 | 67317924 | 67319044 | d7Mseg2053 | 8204 |
| 7 | 95830100 | 95831850 | 67321049 | 67326678 | d7Mseg2054 | 8205 |
| 7 | 95835750 | 95837700 | 67331257 | 67333459 | d7Mseg2055 | 8206 |
| 7 | 95891350 | 95892850 | 67412773 | 67413621 | d7Mseg2056 | 8207 |
| 7 | 95895800 | 95897400 | 67415737 | 67417169 | d7Mseg2057 | 8208 |
| 7 | 95952500 | 95953900 | 67490880 | 67491934 | d7Mseg2058 | 8209 |
| 7 | 95970150 | 95972050 | 67499282 | 67500170 | d7Mseg2059 | 8210 |
| 7 | 96025050 | 96028150 | 67573493 | 67575208 | d7Mseg2062 | 8211 |
| 7 | 96064150 | 96065850 | 67634164 | 67635569 | d7Mseg2063 | 8212 |
| 7 | 96075650 | 96077150 | 67644046 | 67644579 | d7Mseg2064 | 8213 |
| 7 | 96085450 | 96087300 | 67652738 | 67654501 | d7Mseg2065 | 8214 |
| 7 | 96130800 | 96134100 | 67717473 | 67719790 | d7Mseg2066 | 8215 |
| 7 | 96194900 | 96196650 | 67861015 | 67865555 | d7Mseg2067 | 8216 |
| 7 | 96219650 | 96221300 | 67893442 | 67896086 | d7Mseg2068 | 8217 |
| 7 | 96236650 | 96240350 | 67911949 | 67915944 | d7Mseg2070 | 8218 |
| 7 | 96253900 | 96255650 | 67929335 | 67932242 | d7Mseg2071 | 8219 |
| 7 | 96262550 | 96264000 | 67938712 | 67940193 | d7Mseg2072 | 8220 |
| 7 | 96280250 | 96281850 | 67987006 | 67988140 | d7Mseg2073 | 8221 |
| 7 | 96283150 | 96284250 | 67979456 | 67979961 | d7Mseg2074 | 8222 |
| 7 | 96311150 | 96312200 | 68007550 | 68008359 | d7Mseg2075 | 8223 |
| 7 | 96329150 | 96335250 | 68046540 | 68052833 | d7Mseg2076 | 8224 |
| 7 | 96339300 | 96340850 | 68056981 | 68058679 | d7Mseg2077 | 8225 |
| 7 | 96354750 | 96356500 | 68073715 | 68075288 | d7Mseg2078 | 8226 |
| 7 | 96359900 | 96362900 | 68080278 | 68081906 | d7Mseg2079 | 8227 |
| 7 | 96372950 | 96376750 | 68091432 | 68094968 | d7Mseg2080 | 8228 |
| 7 | 96385500 | 96387750 | 68104397 | 68108103 | d7Mseg2081 | 8229 |
| 7 | 96401400 | 96406950 | 68123984 | 68126672 | d7Mseg2082 | 8230 |
| 7 | 96410200 | 96414200 | 68130121 | 68135290 | d7Mseg2083 | 8231 |
| 7 | 96419350 | 96421350 | 68140710 | 68142796 | d7Mseg2084 | 8232 |
| 7 | 96433000 | 96434500 | 68156949 | 68157926 | d7Mseg2085 | 8233 |
| 7 | 96466500 | 96468350 | 68197227 | 68199285 | d7Mseg2086 | 8234 |
| 7 | 96471250 | 96473500 | 68202131 | 68203415 | d7Mseg2087 | 8235 |
| 7 | 96474600 | 96475900 | 68203673 | 68204996 | d7Mseg2088 | 8236 |
| 7 | 96482000 | 96484550 | 68211052 | 68213625 | d7Mseg2089 | 8237 |
| 7 | 96488250 | 96490100 | 68217396 | 68219169 | d7Mseg2090 | 8238 |
| 7 | 96501050 | 96504450 | 68229421 | 68230638 | d7Mseg2091 | 8239 |
| 7 | 96508650 | 96510100 | 68232377 | 68234110 | d7Mseg2092 | 8240 |
| 7 | 96514400 | 96519550 | 68238280 | 68242769 | d7Mseg2093 | 8241 |
| 7 | 96528850 | 96530700 | 68250786 | 68252528 | d7Mseg2094 | 8242 |
| 7 | 96532750 | 96534600 | 68254548 | 68256558 | d7Mseg2095 | 8243 |
| 7 | 96536200 | 96537300 | 68258172 | 68258517 | d7Mseg2096 | 8244 |
| 7 | 96556600 | 96559700 | 68284195 | 68287196 | d7Mseg2097 | 8245 |
| 7 | 96563150 | 96564450 | 68289811 | 68290622 | d7Mseg2098 | 8246 |
| 7 | 96583200 | 96585150 | 68300263 | 68301956 | d7Mseg2100 | 8247 |
| 7 | 96605800 | 96607350 | 68322130 | 68323513 | d7Mseg2101 | 8248 |
| 7 | 96617350 | 96618650 | 68334725 | 68336057 | d7Mseg2102 | 8249 |
| 7 | 96624550 | 96625750 | 68341868 | 68343177 | d7Mseg2103 | 8250 |
| 7 | 96627450 | 96630050 | 68345579 | 68349402 | d7Mseg2104 | 8251 |
| 7 | 96638050 | 96640450 | 68356517 | 68359344 | d7Mseg2105 | 8252 |
| 7 | 96653450 | 96657150 | 68372372 | 68375711 | d7Mseg2106 | 8253 |
| 7 | 96661850 | 96664000 | 68381099 | 68383370 | d7Mseg2107 | 8254 |
| 7 | 96671250 | 96674900 | 68391241 | 68397518 | d7Mseg2108 | 8255 |
| 7 | 96712800 | 96715550 | 68435790 | 68438454 | d7Mseg2109 | 8256 |
| 7 | 96718950 | 96720500 | 68442668 | 68444375 | d7Mseg2110 | 8257 |
| 7 | 96721550 | 96723400 | 68445249 | 68445994 | d7Mseg2111 | 8258 |
| 7 | 96725100 | 96726500 | 68447770 | 68449225 | d7Mseg2112 | 8259 |
| 7 | 96727800 | 96729800 | 68450428 | 68452638 | d7Mseg2113 | 8260 |
| 7 | 96759100 | 96765450 | 68494416 | 68500658 | d7Mseg2114 | 8261 |
| 7 | 96768800 | 96769900 | 68504488 | 68505594 | d7Mseg2115 | 8262 |
| 7 | 96802500 | 96806500 | 68537903 | 68541912 | d7Mseg2116 | 8263 |
| 7 | 96807800 | 96810150 | 68543931 | 68546254 | d7Mseg2117 | 8264 |
| 7 | 96819550 | 96820800 | 68576838 | 68578203 | d7Mseg2118 | 8265 |
| 7 | 96852700 | 96854500 | 68606495 | 68608563 | d7Mseg2120 | 8266 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 96863100 | 96864900 | 68615809 | 68616322 | d7Mseg2121 | 8267 |
| 7 | 96879900 | 96881300 | 68620567 | 68621673 | d7Mseg2123 | 8268 |
| 7 | 96885400 | 96887250 | 68624565 | 68624977 | d7Mseg2124 | 8269 |
| 7 | 97005750 | 97007150 | 68715073 | 68716790 | d7Mseg2129 | 8270 |
| 7 | 97013850 | 97018550 | 68722532 | 68727304 | d7Mseg2130 | 8271 |
| 7 | 97041350 | 97042850 | 68749465 | 68751017 | d7Mseg2131 | 8272 |
| 7 | 97069150 | 97070600 | 68775724 | 68776933 | d7Mseg2132 | 8273 |
| 7 | 97125900 | 97127050 | 68808398 | 68808527 | d7Mseg2134 | 8274 |
| 7 | 97159850 | 97161350 | 68826620 | 68826999 | d7Mseg2135 | 8275 |
| 7 | 97168850 | 97172800 | 68833901 | 68837825 | d7Mseg2136 | 8276 |
| 7 | 97177000 | 97179000 | 68842254 | 68842905 | d7Mseg2137 | 8277 |
| 7 | 97202850 | 97204950 | 68853848 | 68855353 | d7Mseg2138 | 8278 |
| 7 | 97208150 | 97209700 | 68859907 | 68861111 | d7Mseg2139 | 8279 |
| 7 | 97276550 | 97278050 | 68948234 | 68948610 | d7Mseg2143 | 8280 |
| 7 | 97280450 | 97283100 | 68948351 | 68949764 | d7Mseg2144 | 8281 |
| 7 | 97353500 | 97355250 | 69001106 | 69002584 | d7Mseg2147 | 8282 |
| 7 | 97362850 | 97364600 | 69011200 | 69013384 | d7Mseg2148 | 8283 |
| 7 | 97373250 | 97374350 | 69015266 | 69015394 | d7Mseg2149 | 8284 |
| 7 | 97394350 | 97396150 | 69049359 | 69050825 | d7Mseg2150 | 8285 |
| 7 | 97419350 | 97421050 | 69096631 | 69097564 | d7Mseg2152 | 8286 |
| 7 | 97497450 | 97499150 | 69168894 | 69171682 | d7Mseg2153 | 8287 |
| 7 | 97631750 | 97633600 | 69288461 | 69290629 | d7Mseg2155 | 8288 |
| 7 | 97667400 | 97669350 | 69308113 | 69310041 | d7Mseg2158 | 8289 |
| 7 | 97696900 | 97698350 | 69364403 | 69366499 | d7Mseg2159 | 8290 |
| 7 | 97714300 | 97715900 | 69389319 | 69391386 | d7Mseg2160 | 8291 |
| 7 | 97754950 | 97756900 | 69443401 | 69443775 | d7Mseg2162 | 8292 |
| 7 | 97764150 | 97765750 | 69451053 | 69452103 | d7Mseg2163 | 8293 |
| 7 | 97800350 | 97801900 | 69487943 | 69489149 | d7Mseg2164 | 8294 |
| 7 | 97825850 | 97827400 | 69513101 | 69516256 | d7Mseg2165 | 8295 |
| 7 | 97861050 | 97862200 | 69550045 | 69550609 | d7Mseg2167 | 8296 |
| 7 | 97917850 | 97919000 | 69633087 | 69634269 | d7Mseg2168 | 8297 |
| 7 | 97927300 | 97928500 | 69644718 | 69645993 | d7Mseg2169 | 8298 |
| 7 | 97936300 | 97938350 | 69655173 | 69656658 | d7Mseg2170 | 8299 |
| 7 | 97962150 | 97963800 | 69663823 | 69665432 | d7Mseg2171 | 8300 |
| 7 | 97966450 | 97968300 | 69668211 | 69670157 | d7Mseg2172 | 8301 |
| 7 | 97970300 | 97972150 | 69672663 | 69674498 | d7Mseg2173 | 8302 |
| 7 | 97997000 | 98000650 | 69703880 | 69710197 | d7Mseg2174 | 8303 |
| 7 | 98082000 | 98083800 | 69830718 | 69831067 | d7Mseg2177 | 8304 |
| 7 | 98152700 | 98154150 | 69904476 | 69905520 | d7Mseg2180 | 8305 |
| 7 | 98228300 | 98230100 | 70073369 | 70073685 | d7Mseg2183 | 8306 |
| 7 | 98271000 | 98272400 | 70141064 | 70141627 | d7Mseg2187 | 8307 |
| 7 | 98404900 | 98406900 | 70276693 | 70278683 | d7Mseg2192 | 8308 |
| 7 | 98417000 | 98418400 | 70287366 | 70288797 | d7Mseg2193 | 8309 |
| 7 | 98449350 | 98457550 | 70315553 | 70324518 | d7Mseg2194 | 8310 |
| 7 | 98479950 | 98481450 | 70348213 | 70349616 | d7Mseg2195 | 8311 |
| 7 | 98495800 | 98497550 | 70365970 | 70367836 | d7Mseg2196 | 8312 |
| 7 | 98500850 | 98504650 | 70371755 | 70375526 | d7Mseg2197 | 8313 |
| 7 | 98515000 | 98516000 | 70389346 | 70390386 | d7Mseg2198 | 8314 |
| 7 | 98542750 | 98544500 | 70418460 | 70419705 | d7Mseg2199 | 8315 |
| 7 | 98577550 | 98581400 | 70441291 | 70445407 | d7Mseg2201 | 8316 |
| 7 | 98597100 | 98598750 | 70457979 | 70458617 | d7Mseg2202 | 8317 |
| 7 | 98601950 | 98603150 | 70461671 | 70462613 | d7Mseg2203 | 8318 |
| 7 | 98606800 | 98608250 | 70465443 | 70466971 | d7Mseg2204 | 8319 |
| 7 | 98610700 | 98612200 | 70469484 | 70470980 | d7Mseg2205 | 8320 |
| 7 | 98614550 | 98616450 | 70473386 | 70475393 | d7Mseg2206 | 8321 |
| 7 | 98632000 | 98633450 | 70510317 | 70510760 | d7Mseg2207 | 8322 |
| 7 | 98664300 | 98665850 | 70546542 | 70547433 | d7Mseg2208 | 8323 |
| 7 | 98834250 | 98836650 | 70751717 | 70754177 | d7Mseg2212 | 8324 |
| 7 | 98885050 | 98886650 | 150573759 | 150575541 | d7Mseg2213 | 8325 |
| 7 | 98890100 | 98894700 | 70798488 | 70799686 | d7Mseg2214 | 8326 |
| 7 | 98896200 | 98897900 | 70812316 | 70817013 | d7Mseg2215 | 8327 |
| 7 | 98921200 | 98922900 | 70832267 | 70833024 | d7Mseg2216 | 8328 |
| 7 | 98930900 | 98931950 | 70839985 | 70841756 | d7Mseg2217 | 8329 |
| 7 | 98965550 | 98967650 | 70870234 | 70872536 | d7Mseg2220 | 8330 |
| 7 | 98985950 | 98987350 | 70883129 | 70884479 | d7Mseg2222 | 8331 |
| 7 | 99040300 | 99051650 | 71125932 | 71136845 | d7Mseg2226 | 8332 |
| 7 | 99052850 | 99055500 | 71136951 | 71140016 | d7Mseg2227 | 8333 |
| 7 | 99057850 | 99061200 | 71143219 | 71145254 | d7Mseg2228 | 8334 |
| 7 | 99068150 | 99069450 | 71151999 | 71153362 | d7Mseg2229 | 8335 |
| 7 | 99074300 | 99075900 | 71159454 | 71160561 | d7Mseg2230 | 8336 |
| 7 | 99082500 | 99085400 | 71168029 | 71170297 | d7Mseg2231 | 8337 |
| 7 | 99095050 | 99096550 | 71175419 | 71176356 | d7Mseg2232 | 8338 |
| 7 | 99115600 | 99117300 | 71195136 | 71195784 | d7Mseg2234 | 8339 |
| 7 | 99124050 | 99125700 | 71210993 | 71212777 | d7Mseg2235 | 8340 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 99131150 | 99132900 | 71217094 | 71219660 | d7Mseg2236 | 8341 |
| 7 | 99138750 | 99140400 | 71225252 | 71225858 | d7Mseg2237 | 8342 |
| 7 | 99147350 | 99148700 | 71236183 | 71237644 | d7Mseg2238 | 8343 |
| 7 | 99213350 | 99215050 | 71300266 | 71302062 | d7Mseg2239 | 8344 |
| 7 | 99227050 | 99230800 | 71314616 | 71318626 | d7Mseg2240 | 8345 |
| 7 | 99233150 | 99234700 | 71321561 | 71323027 | d7Mseg2241 | 8346 |
| 7 | 99239300 | 99241650 | 71328369 | 71331157 | d7Mseg2242 | 8347 |
| 7 | 99264250 | 99267600 | 71349533 | 71352894 | d7Mseg2243 | 8348 |
| 7 | 99270150 | 99274150 | 71355176 | 71359620 | d7Mseg2244 | 8349 |
| 7 | 99286300 | 99288050 | 71372238 | 71373440 | d7Mseg2245 | 8350 |
| 7 | 99308450 | 99310450 | 71393655 | 71394970 | d7Mseg2247 | 8351 |
| 7 | 99352000 | 99354000 | 71458371 | 71460230 | d7Mseg2248 | 8352 |
| 7 | 99379100 | 99380400 | 71492402 | 71492552 | d7Mseg2249 | 8353 |
| 7 | 99383950 | 99385400 | 71496383 | 71498018 | d7Mseg2250 | 8354 |
| 7 | 99388600 | 99390750 | 71498578 | 71499771 | d7Mseg2251 | 8355 |
| 7 | 99435300 | 99437150 | 71515409 | 71516273 | d7Mseg2254 | 8356 |
| 7 | 99440450 | 99455050 | 71519113 | 71533421 | d7Mseg2255 | 8357 |
| 7 | 99475150 | 99476800 | 71546880 | 71547704 | d7Mseg2258 | 8358 |
| 7 | 99481200 | 99483150 | 71550607 | 71553137 | d7Mseg2259 | 8359 |
| 7 | 99501850 | 99503100 | 71570161 | 71571705 | d7Mseg2260 | 8360 |
| 7 | 99541150 | 99543000 | 71609615 | 71612031 | d7Mseg2261 | 8361 |
| 7 | 99596300 | 99598150 | 71679896 | 71682070 | d7Mseg2262 | 8362 |
| 7 | 99613250 | 99615000 | 71696761 | 71698836 | d7Mseg2263 | 8363 |
| 7 | 99622100 | 99623700 | 71707652 | 71708980 | d7Mseg2264 | 8364 |
| 7 | 99639950 | 99642550 | 71731355 | 71734116 | d7Mseg2265 | 8365 |
| 7 | 99698550 | 99700350 | 71790140 | 71792558 | d7Mseg2267 | 8366 |
| 7 | 99701750 | 99703400 | 71794120 | 71795437 | d7Mseg2268 | 8367 |
| 7 | 99727800 | 99729300 | 71822066 | 71822395 | d7Mseg2269 | 8368 |
| 7 | 99782050 | 99783150 | 71864638 | 71865814 | d7Mseg2270 | 8369 |
| 7 | 99838800 | 99841900 | 71933637 | 71937216 | d7Mseg2272 | 8370 |
| 7 | 99875550 | 99877400 | 71989055 | 71989710 | d7Mseg2275 | 8371 |
| 7 | 99879050 | 99881450 | 71999810 | 72001519 | d7Mseg2276 | 8372 |
| 7 | 99886500 | 99888050 | 72005806 | 72007577 | d7Mseg2277 | 8373 |
| 7 | 99974150 | 99977700 | 72089339 | 72094040 | d7Mseg2281 | 8374 |
| 7 | 100022700 | 100026500 | 72062507 | 72065178 | d7Mseg2285 | 8375 |
| 7 | 100075400 | 100076900 | 72092925 | 72094412 | d7Mseg2290 | 8376 |
| 7 | 100124700 | 100126550 | 72159049 | 72160676 | d7Mseg2291 | 8377 |
| 7 | 100213550 | 100217000 | 72293831 | 72295143 | d7Mseg2297 | 8378 |
| 7 | 100504850 | 100506850 | 72661883 | 72662491 | d7Mseg2309 | 8379 |
| 7 | 100515700 | 100520900 | 72666040 | 72670879 | d7Mseg2310 | 8380 |
| 7 | 100525950 | 100527850 | 72675705 | 72677950 | d7Mseg2311 | 8381 |
| 7 | 100549400 | 100551600 | 72780739 | 72782789 | d7Mseg2313 | 8382 |
| 7 | 100583300 | 100585600 | 72899465 | 72901608 | d7Mseg2314 | 8383 |
| 7 | 100611750 | 100613350 | 72957893 | 72958979 | d7Mseg2316 | 8384 |
| 7 | 100640950 | 100647050 | 73014340 | 73031761 | d7Mseg2320 | 8385 |
| 7 | 100816450 | 100818000 | 73510591 | 73512552 | d7Mseg2325 | 8386 |
| 7 | 100885800 | 100893650 | 73752843 | 73758155 | d7Mseg2326 | 8387 |
| 7 | 100907700 | 100909200 | 73738762 | 73740766 | d7Mseg2327 | 8388 |
| 7 | 100919650 | 100925050 | 73728433 | 73733622 | d7Mseg2328 | 8389 |
| 7 | 100928450 | 100930450 | 73723754 | 73725689 | d7Mseg2329 | 8390 |
| 7 | 100968200 | 100969200 | 73686886 | 73687446 | d7Mseg2331 | 8391 |
| 7 | 100971950 | 100972950 | 73685082 | 73685751 | d7Mseg2332 | 8392 |
| 7 | 100987700 | 100992000 | 73670146 | 73675778 | d7Mseg2333 | 8393 |
| 7 | 100994700 | 100996250 | 73665735 | 73667219 | d7Mseg2334 | 8394 |
| 7 | 101005850 | 101007250 | 73653443 | 73654615 | d7Mseg2335 | 8395 |
| 7 | 101014400 | 101019350 | 73639879 | 73644269 | d7Mseg2336 | 8396 |
| 7 | 101073300 | 101075150 | 73755977 | 73759178 | d7Mseg2341 | 8397 |
| 7 | 101154450 | 101156000 | 73807484 | 73809475 | d7Mseg2348 | 8398 |
| 7 | 101174700 | 101177750 | 73832504 | 73835755 | d7Mseg2349 | 8399 |
| 7 | 101182400 | 101184050 | 73842700 | 73843533 | d7Mseg2350 | 8400 |
| 7 | 101194400 | 101195550 | 73852053 | 73852303 | d7Mseg2351 | 8401 |
| 7 | 101205000 | 101206450 | 73885143 | 73885336 | d7Mseg2353 | 8402 |
| 7 | 101248550 | 101249900 | 73930218 | 73930486 | d7Mseg2358 | 8403 |
| 7 | 101276100 | 101277650 | 73956732 | 73958294 | d7Mseg2359 | 8404 |
| 7 | 101337850 | 101339050 | 74030026 | 74030809 | d7Mseg2361 | 8405 |
| 7 | 101392900 | 101398450 | 74141967 | 74147202 | d7Mseg2362 | 8406 |
| 7 | 101431300 | 101432800 | 74171676 | 74178727 | d7Mseg2363 | 8407 |
| 7 | 101483900 | 101485600 | 74277919 | 74279589 | d7Mseg2366 | 8408 |
| 7 | 101554450 | 101558800 | 74342555 | 74343332 | d7Mseg2369 | 8409 |
| 7 | 101593950 | 101595750 | 74371003 | 74371237 | d7Mseg2371 | 8410 |
| 7 | 101607300 | 101608650 | 74374996 | 74375546 | d7Mseg2372 | 8411 |
| 7 | 101612450 | 101614850 | 74378128 | 74378754 | d7Mseg2373 | 8412 |
| 7 | 101619150 | 101621000 | 74381236 | 74381481 | d7Mseg2374 | 8413 |
| 7 | 101672450 | 101674900 | 74448094 | 74462186 | d7Mseg2376 | 8414 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 101678000 | 101679800 | 74493782 | 74495431 | d7Mseg2377 | 8415 |
| 7 | 101682450 | 101685050 | 74497607 | 74506385 | d7Mseg2378 | 8416 |
| 7 | 101728100 | 101729700 | 74579675 | 74580110 | d7Mseg2380 | 8417 |
| 7 | 101758400 | 101759850 | 74641629 | 74642387 | d7Mseg2381 | 8418 |
| 7 | 101770400 | 101772100 | 74652160 | 74665048 | d7Mseg2382 | 8419 |
| 7 | 101805700 | 101809800 | 74701687 | 74702847 | d7Mseg2384 | 8420 |
| 7 | 101828350 | 101830050 | 74726161 | 74726408 | d7Mseg2385 | 8421 |
| 7 | 101858200 | 101859850 | 74738139 | 74738745 | d7Mseg2387 | 8422 |
| 7 | 101880900 | 101882600 | 74789202 | 74790481 | d7Mseg2388 | 8423 |
| 7 | 101887550 | 101889350 | 74816195 | 74825768 | d7Mseg2389 | 8424 |
| 7 | 101963650 | 101964850 | 74875823 | 74875982 | d7Mseg2395 | 8425 |
| 7 | 102007850 | 102009400 | 74956843 | 74957267 | d7Mseg2397 | 8426 |
| 7 | 102047050 | 102052750 | 74999999 | 75005276 | d7Mseg2398 | 8427 |
| 7 | 102148350 | 102149850 | 75204566 | 75206237 | d7Mseg2403 | 8428 |
| 7 | 102378650 | 102382900 | 75912882 | 75929363 | d7Mseg2415 | 8429 |
| 7 | 102402700 | 102403750 | 75938956 | 75954332 | d7Mseg2416 | 8430 |
| 7 | 102535150 | 102537200 | 76083865 | 76085210 | d7Mseg2418 | 8431 |
| 7 | 102565500 | 102566550 | 76197089 | 76198122 | d7Mseg2419 | 8432 |
| 7 | 102569400 | 102572600 | 76207160 | 76223209 | d7Mseg2420 | 8433 |
| 7 | 102586150 | 102587200 | 76233910 | 76235036 | d7Mseg2421 | 8434 |
| 7 | 102590900 | 102592150 | 76239172 | 76239969 | d7Mseg2422 | 8435 |
| 7 | 102623800 | 102625000 | 76320166 | 76320459 | d7Mseg2423 | 8436 |
| 7 | 102650750 | 102652450 | 76340173 | 76340697 | d7Mseg2424 | 8437 |
| 7 | 102740800 | 102742100 | 76395020 | 76395967 | d7Mseg2427 | 8438 |
| 7 | 102760000 | 102761900 | 76437917 | 76439779 | d7Mseg2429 | 8439 |
| 7 | 102869600 | 102871550 | 76618006 | 76619942 | d7Mseg2431 | 8440 |
| 7 | 102873250 | 102874850 | 76620537 | 76621892 | d7Mseg2432 | 8441 |
| 7 | 102956950 | 102964600 | 76703692 | 76707202 | d7Mseg2437 | 8442 |
| 7 | 102968450 | 102970900 | 76710891 | 76713740 | d7Mseg2438 | 8443 |
| 7 | 102987500 | 102989000 | 76748802 | 76757219 | d7Mseg2440 | 8444 |
| 7 | 102995600 | 102997350 | 76763912 | 76776911 | d7Mseg2441 | 8445 |
| 7 | 103002000 | 103003600 | 76782112 | 76789587 | d7Mseg2442 | 8446 |
| 7 | 103106750 | 103108550 | 76995713 | 77031704 | d7Mseg2443 | 8447 |
| 7 | 103164400 | 103166100 | 77082606 | 77083367 | d7Mseg2445 | 8448 |
| 7 | 103217400 | 103219450 | 77161601 | 77163026 | d7Mseg2446 | 8449 |
| 7 | 103277800 | 103279600 | 77242372 | 77243656 | d7Mseg2448 | 8450 |
| 7 | 103282650 | 103283900 | 77253611 | 77254234 | d7Mseg2449 | 8451 |
| 7 | 103403950 | 103405250 | 77387224 | 77389035 | d7Mseg2452 | 8452 |
| 7 | 103413900 | 103416300 | 77393634 | 77396311 | d7Mseg2453 | 8453 |
| 7 | 103540550 | 103542000 | 77452315 | 77452656 | d7Mseg2455 | 8454 |
| 7 | 103632900 | 103634000 | 77426690 | 77427277 | d7Mseg2461 | 8455 |
| 7 | 103644300 | 103645400 | 77456105 | 77456862 | d7Mseg2462 | 8456 |
| 7 | 103830700 | 103832900 | 77687818 | 77688543 | d7Mseg2470 | 8457 |
| 7 | 103992000 | 103993800 | 77811799 | 77829155 | d7Mseg2477 | 8458 |
| 7 | 103996250 | 103997400 | 77831167 | 77832199 | d7Mseg2478 | 8459 |
| 7 | 104004550 | 104006250 | 77854767 | 77860727 | d7Mseg2479 | 8460 |
| 7 | 104032750 | 104034450 | 77911905 | 77913589 | d7Mseg2481 | 8461 |
| 7 | 104035900 | 104037300 | 77914841 | 77916404 | d7Mseg2482 | 8462 |
| 7 | 104063850 | 104065350 | 77943574 | 77944393 | d7Mseg2484 | 8463 |
| 7 | 104092400 | 104093650 | 77963021 | 77964221 | d7Mseg2485 | 8464 |
| 7 | 104133900 | 104135500 | 78024094 | 78025716 | d7Mseg2486 | 8465 |
| 7 | 104151500 | 104153250 | 78063296 | 78064371 | d7Mseg2487 | 8466 |
| 7 | 104173900 | 104175100 | 78082496 | 78082929 | d7Mseg2488 | 8467 |
| 7 | 104286000 | 104287750 | 78202292 | 78206529 | d7Mseg2491 | 8468 |
| 7 | 104359700 | 104361000 | 78334790 | 78335538 | d7Mseg2495 | 8469 |
| 7 | 104416450 | 104418150 | 78366326 | 78368112 | d7Mseg2496 | 8470 |
| 7 | 104451600 | 104453900 | 78400489 | 78402691 | d7Mseg2498 | 8471 |
| 7 | 104492150 | 104493450 | 78430844 | 78431978 | d7Mseg2499 | 8472 |
| 7 | 104589800 | 104591100 | 78614809 | 78615152 | d7Mseg2501 | 8473 |
| 7 | 104605300 | 104607100 | 78628893 | 78631926 | d7Mseg2502 | 8474 |
| 7 | 104871000 | 104873650 | 79276534 | 79279315 | d7Mseg2507 | 8475 |
| 7 | 105005250 | 105006800 | 79586593 | 79587093 | d7Mseg2509 | 8476 |
| 7 | 105050800 | 105052150 | 79674840 | 79675962 | d7Mseg2510 | 8477 |
| 7 | 105075950 | 105077000 | 79709790 | 79710462 | d7Mseg2511 | 8478 |
| 7 | 106019450 | 106021400 | 80047116 | 80050237 | d7Mseg2522 | 8479 |
| 7 | 106089900 | 106091600 | 80208570 | 80209393 | d7Mseg2524 | 8480 |
| 7 | 106200850 | 106202150 | 80370403 | 80371112 | d7Mseg2528 | 8481 |
| 7 | 106208200 | 106209950 | 80376643 | 80378532 | d7Mseg2529 | 8482 |
| 7 | 106224900 | 106226300 | 80385189 | 80386503 | d7Mseg2531 | 8483 |
| 7 | 106232200 | 106233450 | 80419031 | 80419449 | d7Mseg2532 | 8484 |
| 7 | 106292100 | 106293250 | 80458875 | 80460054 | d7Mseg2533 | 8485 |
| 7 | 106299600 | 106301100 | 80468793 | 80469865 | d7Mseg2534 | 8486 |
| 7 | 106328050 | 106329950 | 80506047 | 80506741 | d7Mseg2535 | 8487 |
| 7 | 106380250 | 106382450 | 80603611 | 80605371 | d7Mseg2538 | 8488 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 106749050 | 106750450 | 80914954 | 80915477 | d7Mseg2543 | 8489 |
| 7 | 106823400 | 106825250 | 81022391 | 81022706 | d7Mseg2544 | 8490 |
| 7 | 106910800 | 106912600 | 81167029 | 81168155 | d7Mseg2545 | 8491 |
| 7 | 107161400 | 107163050 | 81685036 | 81685431 | d7Mseg2548 | 8492 |
| 7 | 107168000 | 107169000 | 81699524 | 81699963 | d7Mseg2549 | 8493 |
| 7 | 107549250 | 107550300 | 82021434 | 82024108 | d7Mseg2552 | 8494 |
| 7 | 107848000 | 107849900 | 82529123 | 82530770 | d7Mseg2555 | 8495 |
| 7 | 107858700 | 107861400 | 82558395 | 82559319 | d7Mseg2556 | 8496 |
| 7 | 107914500 | 107915550 | 82605146 | 82605290 | d7Mseg2557 | 8497 |
| 7 | 107962200 | 107963600 | 82699693 | 82700272 | d7Mseg2559 | 8498 |
| 7 | 108008300 | 108014500 | 82761881 | 82768249 | d7Mseg2563 | 8499 |
| 7 | 108018250 | 108019500 | 82771728 | 82772652 | d7Mseg2564 | 8500 |
| 7 | 108504700 | 108505750 | 83319992 | 83320825 | d7Mseg2569 | 8501 |
| 7 | 108605150 | 108606950 | 83472107 | 83473784 | d7Mseg2570 | 8502 |
| 7 | 108623050 | 108624950 | 83484874 | 83486458 | d7Mseg2571 | 8503 |
| 7 | 108627050 | 108628250 | 83488665 | 83489636 | d7Mseg2572 | 8504 |
| 7 | 108648150 | 108649850 | 83505320 | 83508447 | d7Mseg2573 | 8505 |
| 7 | 108653050 | 108654400 | 83511697 | 83512866 | d7Mseg2574 | 8506 |
| 7 | 108655700 | 108656900 | 83514401 | 83515341 | d7Mseg2575 | 8507 |
| 7 | 108723450 | 108724650 | 83611024 | 83612099 | d7Mseg2576 | 8508 |
| 7 | 108738050 | 108739900 | 83617262 | 83618183 | d7Mseg2577 | 8509 |
| 7 | 108766950 | 108768750 | 83699598 | 83700113 | d7Mseg2579 | 8510 |
| 7 | 108812150 | 108813450 | 83764530 | 83765579 | d7Mseg2580 | 8511 |
| 7 | 108815200 | 108817000 | 83765964 | 83768458 | d7Mseg2581 | 8512 |
| 7 | 109207250 | 109208650 | 83972876 | 83974143 | d7Mseg2590 | 8513 |
| 7 | 109359450 | 109361000 | 84235670 | 84238403 | d7Mseg2593 | 8514 |
| 7 | 109432450 | 109434250 | 84287702 | 84288484 | d7Mseg2598 | 8515 |
| 7 | 109459500 | 109461000 | 84306165 | 84307508 | d7Mseg2600 | 8516 |
| 7 | 109467550 | 109469200 | 84321914 | 84322609 | d7Mseg2601 | 8517 |
| 7 | 109470750 | 109472300 | 84324158 | 84325079 | d7Mseg2602 | 8518 |
| 7 | 109609700 | 109611500 | 84399238 | 84400141 | d7Mseg2603 | 8519 |
| 7 | 109622850 | 109624750 | 84400283 | 84400578 | d7Mseg2604 | 8520 |
| 7 | 109707900 | 109717600 | 84495477 | 84502272 | d7Mseg2608 | 8521 |
| 7 | 109723050 | 109725450 | 84507381 | 84508339 | d7Mseg2609 | 8522 |
| 7 | 109751800 | 109753050 | 84531624 | 84533356 | d7Mseg2610 | 8523 |
| 7 | 109808700 | 109810300 | 84631152 | 84632882 | d7Mseg2612 | 8524 |
| 7 | 109868000 | 109869800 | 84686651 | 84687968 | d7Mseg2614 | 8525 |
| 7 | 110039800 | 110040950 | 84825450 | 84826699 | d7Mseg2616 | 8526 |
| 7 | 110063550 | 110065600 | 84867079 | 84885987 | d7Mseg2618 | 8527 |
| 7 | 110097450 | 110098850 | 84959582 | 84960682 | d7Mseg2619 | 8528 |
| 7 | 110206600 | 110208550 | 85181784 | 85182679 | d7Mseg2620 | 8529 |
| 7 | 110410900 | 110414150 | 85402510 | 85405628 | d7Mseg2622 | 8530 |
| 7 | 110421350 | 110423100 | 85412968 | 85417097 | d7Mseg2623 | 8531 |
| 7 | 110434200 | 110438350 | 85441340 | 85448782 | d7Mseg2624 | 8532 |
| 7 | 110450000 | 110451600 | 85464759 | 85465555 | d7Mseg2625 | 8533 |
| 7 | 110538150 | 110539200 | 85586561 | 85587237 | d7Mseg2626 | 8534 |
| 7 | 110553950 | 110555000 | 85616690 | 85618075 | d7Mseg2627 | 8535 |
| 7 | 110575100 | 110576850 | 85642414 | 85642689 | d7Mseg2628 | 8536 |
| 7 | 110616900 | 110618350 | 85716922 | 85718257 | d7Mseg2630 | 8537 |
| 7 | 110753150 | 110754500 | 85905658 | 85909321 | d7Mseg2633 | 8538 |
| 7 | 110905600 | 110907200 | 86030155 | 86033030 | d7Mseg2634 | 8539 |
| 7 | 110923450 | 110925100 | 86062880 | 86064510 | d7Mseg2635 | 8540 |
| 7 | 110992500 | 110994200 | 86141119 | 86141430 | d7Mseg2637 | 8541 |
| 7 | 111432050 | 111433500 | 86575877 | 86576380 | d7Mseg2641 | 8542 |
| 7 | 111670700 | 111672500 | 86918130 | 86920065 | d7Mseg2642 | 8543 |
| 7 | 111761550 | 111763500 | 86990867 | 86991666 | d7Mseg2645 | 8544 |
| 7 | 112320000 | 112321600 | 87224641 | 87225114 | d7Mseg2650 | 8545 |
| 7 | 114815700 | 114817050 | 88879007 | 88880234 | d7Mseg2662 | 8546 |
| 7 | 117047500 | 117048950 | 90696104 | 90697538 | d7Mseg2673 | 8547 |
| 7 | 117401350 | 117410000 | 91031793 | 91040211 | d7Mseg2675 | 8548 |
| 7 | 117418450 | 117419650 | 91051219 | 91052327 | d7Mseg2676 | 8549 |
| 7 | 117485300 | 117486350 | 91097262 | 91097369 | d7Mseg2677 | 8550 |
| 7 | 117621350 | 117622500 | 91332196 | 91332690 | d7Mseg2678 | 8551 |
| 7 | 117727850 | 117729300 | 91480685 | 91484712 | d7Mseg2679 | 8552 |
| 7 | 117774500 | 117775650 | 91568504 | 91571115 | d7Mseg2680 | 8553 |
| 7 | 117860550 | 117862050 | 91658180 | 91659113 | d7Mseg2681 | 8554 |
| 7 | 117913350 | 117915150 | 91711855 | 91712846 | d7Mseg2682 | 8555 |
| 7 | 118586200 | 118587600 | 92212152 | 92213302 | d7Mseg2686 | 8556 |
| 7 | 119162950 | 119164650 | 92717855 | 92718276 | d7Mseg2690 | 8557 |
| 7 | 119266400 | 119267850 | 92782682 | 92784115 | d7Mseg2691 | 8558 |
| 7 | 119736800 | 119738500 | 93068622 | 93069012 | d7Mseg2693 | 8559 |
| 7 | 119907250 | 119909200 | 93247833 | 93248134 | d7Mseg2694 | 8560 |
| 7 | 120006850 | 120008600 | 93345203 | 93345625 | d7Mseg2695 | 8561 |
| 7 | 125055400 | 125056400 | 94987525 | 94988280 | d7Mseg2704 | 8562 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 125103800 | 125105100 | 95012096 | 95015191 | d7Mseg2705 | 8563 |
| 7 | 125289650 | 125290750 | 95164485 | 95165039 | d7Mseg2708 | 8564 |
| 7 | 125700950 | 125702650 | 95507790 | 95518748 | d7Mseg2711 | 8565 |
| 7 | 126029800 | 126031850 | 95730504 | 95732656 | d7Mseg2713 | 8566 |
| 7 | 126283350 | 126285600 | 95938881 | 95941157 | d7Mseg2714 | 8567 |
| 7 | 126415300 | 126416500 | 96099251 | 96100453 | d7Mseg2715 | 8568 |
| 7 | 126472700 | 126474250 | 96166158 | 96167631 | d7Mseg2716 | 8569 |
| 7 | 126480700 | 126482400 | 96176517 | 96177168 | d7Mseg2717 | 8570 |
| 7 | 126642750 | 126645500 | 96395621 | 96400962 | d7Mseg2718 | 8571 |
| 7 | 126739100 | 126740850 | 96520889 | 96522300 | d7Mseg2719 | 8572 |
| 7 | 126763100 | 126765000 | 96559133 | 96562065 | d7Mseg2720 | 8573 |
| 7 | 126822150 | 126823800 | 96637215 | 96638184 | d7Mseg2721 | 8574 |
| 7 | 126836250 | 126837850 | 96653618 | 96654964 | d7Mseg2722 | 8575 |
| 7 | 126858800 | 126860200 | 96679453 | 96680245 | d7Mseg2723 | 8576 |
| 7 | 126891500 | 126895700 | 96723510 | 96726970 | d7Mseg2724 | 8577 |
| 7 | 126948400 | 126950150 | 96802366 | 96803109 | d7Mseg2725 | 8578 |
| 7 | 126989050 | 126990400 | 96848062 | 96848525 | d7Mseg2726 | 8579 |
| 7 | 127040350 | 127041450 | 96894689 | 96895992 | d7Mseg2727 | 8580 |
| 7 | 127064700 | 127065800 | 96913549 | 96914466 | d7Mseg2729 | 8581 |
| 7 | 127100200 | 127102250 | 96933172 | 96934365 | d7Mseg2730 | 8582 |
| 7 | 127140700 | 127141900 | 96962872 | 96968041 | d7Mseg2731 | 8583 |
| 7 | 127204150 | 127206000 | 97011925 | 97012530 | d7Mseg2732 | 8584 |
| 7 | 127220400 | 127221450 | 97028126 | 97028265 | d7Mseg2733 | 8585 |
| 7 | 127296550 | 127298350 | 97061168 | 97062423 | d7Mseg2734 | 8586 |
| 7 | 127430050 | 127431800 | 97139667 | 97139969 | d7Mseg2735 | 8587 |
| 7 | 127614750 | 127616250 | 97291427 | 97292979 | d7Mseg2739 | 8588 |
| 7 | 127621850 | 127623800 | 97297043 | 97316629 | d7Mseg2740 | 8589 |
| 7 | 127643050 | 127645050 | 97329130 | 97331128 | d7Mseg2741 | 8590 |
| 7 | 127968550 | 127970100 | 97612010 | 97613239 | d7Mseg2745 | 8591 |
| 7 | 128168300 | 128169750 | 97770470 | 97770746 | d7Mseg2747 | 8592 |
| 7 | 128180100 | 128181600 | 97776995 | 97785666 | d7Mseg2748 | 8593 |
| 7 | 128281100 | 128282150 | 97892974 | 97894015 | d7Mseg2749 | 8594 |
| 7 | 128329300 | 128330850 | 97937798 | 97938085 | d7Mseg2750 | 8595 |
| 7 | 128455300 | 128458800 | 98053260 | 98056499 | d7Mseg2752 | 8596 |
| 7 | 128508750 | 128510050 | 98133946 | 98135139 | d7Mseg2753 | 8597 |
| 7 | 128701050 | 128703300 | 98262223 | 98264357 | d7Mseg2755 | 8598 |
| 7 | 128981250 | 128982900 | 98550719 | 98552396 | d7Mseg2758 | 8599 |
| 7 | 128989150 | 128990850 | 98558699 | 98560432 | d7Mseg2759 | 8600 |
| 7 | 129008350 | 129009500 | 98585324 | 98587034 | d7Mseg2760 | 8601 |
| 7 | 129277750 | 129278800 | 98853809 | 98854176 | d7Mseg2766 | 8602 |
| 7 | 129316000 | 129317400 | 98860259 | 98861376 | d7Mseg2768 | 8603 |
| 7 | 129397800 | 129399700 | 98918161 | 98919241 | d7Mseg2771 | 8604 |
| 7 | 129452100 | 129455450 | 98955784 | 98956458 | d7Mseg2772 | 8605 |
| 7 | 129497450 | 129498500 | 98989295 | 98990065 | d7Mseg2773 | 8606 |
| 7 | 129520900 | 129522850 | 99007744 | 99008695 | d7Mseg2774 | 8607 |
| 7 | 129720350 | 129721950 | 99211855 | 99212475 | d7Mseg2779 | 8608 |
| 7 | 129826550 | 129828250 | 99284420 | 99285145 | d7Mseg2782 | 8609 |
| 7 | 130000950 | 130002950 | 99432713 | 99438445 | d7Mseg2784 | 8610 |
| 7 | 130062950 | 130064800 | 99480168 | 99481316 | d7Mseg2785 | 8611 |
| 7 | 130157800 | 130159000 | 99594826 | 99596018 | d7Mseg2789 | 8612 |
| 7 | 130168100 | 130171500 | 99606301 | 99609897 | d7Mseg2790 | 8613 |
| 7 | 130189450 | 130191150 | 99631450 | 99633088 | d7Mseg2791 | 8614 |
| 7 | 130209200 | 130211750 | 99650863 | 99653061 | d7Mseg2792 | 8615 |
| 7 | 130215450 | 130229700 | 99657327 | 99671435 | d7Mseg2793 | 8616 |
| 7 | 130307600 | 130308750 | 99749651 | 99750622 | d7Mseg2795 | 8617 |
| 7 | 130359600 | 130361100 | 99779295 | 99780077 | d7Mseg2798 | 8618 |
| 7 | 130396500 | 130400750 | 99851667 | 99855846 | d7Mseg2799 | 8619 |
| 7 | 130402050 | 130403300 | 99859117 | 99860668 | d7Mseg2800 | 8620 |
| 7 | 130404500 | 130406400 | 99861906 | 99863702 | d7Mseg2801 | 8621 |
| 7 | 130419250 | 130423150 | 99877591 | 99882417 | d7Mseg2802 | 8622 |
| 7 | 130453500 | 130454700 | 99909306 | 99910520 | d7Mseg2803 | 8623 |
| 7 | 130496700 | 130498350 | 99956960 | 99962291 | d7Mseg2804 | 8624 |
| 7 | 130509250 | 130511200 | 99980485 | 99981774 | d7Mseg2805 | 8625 |
| 7 | 130514450 | 130517050 | 99985303 | 99987553 | d7Mseg2806 | 8626 |
| 7 | 130553650 | 130555500 | 100023838 | 100024048 | d7Mseg2808 | 8627 |
| 7 | 130628400 | 130630050 | 100104722 | 100105611 | d7Mseg2810 | 8628 |
| 7 | 130650450 | 130652250 | 100132725 | 100135550 | d7Mseg2811 | 8629 |
| 7 | 130655100 | 130656700 | 100137803 | 100138267 | d7Mseg2812 | 8630 |
| 7 | 130752300 | 130754400 | 100254979 | 100256079 | d7Mseg2813 | 8631 |
| 7 | 130797450 | 130799450 | 100292087 | 100293710 | d7Mseg2815 | 8632 |
| 7 | 130807800 | 130809550 | 100303728 | 100304878 | d7Mseg2816 | 8633 |
| 7 | 130828950 | 130830850 | 100333054 | 100334779 | d7Mseg2817 | 8634 |
| 7 | 130851800 | 130853450 | 100364369 | 100365674 | d7Mseg2818 | 8635 |
| 7 | 130937750 | 130939600 | 100473217 | 100475321 | d7Mseg2822 | 8636 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 130948900 | 130951450 | 100480891 | 100483100 | d7Mseg2823 | 8637 |
| 7 | 130963450 | 130964950 | 100491267 | 100492543 | d7Mseg2824 | 8638 |
| 7 | 130989600 | 130991400 | 100517951 | 100520414 | d7Mseg2825 | 8639 |
| 7 | 131008100 | 131010000 | 100543536 | 100546418 | d7Mseg2826 | 8640 |
| 7 | 131075800 | 131078700 | 100603304 | 100605404 | d7Mseg2829 | 8641 |
| 7 | 131096700 | 131098100 | 100620371 | 100621777 | d7Mseg2830 | 8642 |
| 7 | 131119150 | 131121200 | 100644951 | 100646916 | d7Mseg2832 | 8643 |
| 7 | 131174700 | 131175950 | 100714413 | 100714797 | d7Mseg2835 | 8644 |
| 7 | 131220750 | 131223850 | 100740062 | 100743543 | d7Mseg2838 | 8645 |
| 7 | 131227050 | 131229250 | 100747241 | 100749019 | d7Mseg2839 | 8646 |
| 7 | 131231900 | 131235450 | 100751314 | 100752719 | d7Mseg2840 | 8647 |
| 7 | 131251300 | 131252300 | 100804104 | 100805328 | d7Mseg2841 | 8648 |
| 7 | 131254100 | 131255850 | 100807361 | 100809065 | d7Mseg2842 | 8649 |
| 7 | 131271900 | 131273550 | 100863960 | 100864836 | d7Mseg2843 | 8650 |
| 7 | 131283700 | 131286250 | 100870694 | 100873309 | d7Mseg2844 | 8651 |
| 7 | 131290750 | 131295500 | 100877742 | 100882345 | d7Mseg2845 | 8652 |
| 7 | 131296600 | 131298150 | 100883382 | 100885038 | d7Mseg2846 | 8653 |
| 7 | 131305800 | 131307800 | 100887333 | 100888281 | d7Mseg2847 | 8654 |
| 7 | 131321900 | 131323550 | 100892763 | 100896673 | d7Mseg2848 | 8655 |
| 7 | 131334250 | 131336150 | 100908270 | 100908977 | d7Mseg2850 | 8656 |
| 7 | 131342300 | 131343750 | 100913589 | 100915052 | d7Mseg2851 | 8657 |
| 7 | 131349000 | 131350800 | 100918041 | 100921182 | d7Mseg2852 | 8658 |
| 7 | 131391350 | 131393250 | 100963909 | 100972160 | d7Mseg2853 | 8659 |
| 7 | 131396300 | 131398250 | 100982323 | 100982929 | d7Mseg2854 | 8660 |
| 7 | 131438050 | 131439950 | 101017881 | 101018668 | d7Mseg2855 | 8661 |
| 7 | 131472250 | 131474050 | 101083233 | 101084118 | d7Mseg2857 | 8662 |
| 7 | 131475600 | 131477400 | 101084434 | 101085443 | d7Mseg2858 | 8663 |
| 7 | 131517850 | 131519600 | 101143167 | 101143454 | d7Mseg2861 | 8664 |
| 7 | 131533550 | 131535550 | 101176309 | 101177363 | d7Mseg2862 | 8665 |
| 7 | 131539450 | 131543100 | 101182998 | 101186406 | d7Mseg2863 | 8666 |
| 7 | 131545550 | 131547100 | 101187995 | 101188498 | d7Mseg2864 | 8667 |
| 7 | 131552350 | 131553600 | 101197511 | 101198948 | d7Mseg2865 | 8668 |
| 7 | 131742950 | 131744450 | 101395223 | 101396706 | d7Mseg2874 | 8669 |
| 7 | 131863400 | 131867450 | 101694196 | 101694977 | d7Mseg2883 | 8670 |
| 7 | 132117050 | 132121150 | 101617778 | 101621948 | d7Mseg2886 | 8671 |
| 7 | 132252250 | 132254050 | 101768859 | 101769828 | d7Mseg2892 | 8672 |
| 7 | 132276800 | 132278550 | 101853975 | 101855890 | d7Mseg2894 | 8673 |
| 7 | 132280000 | 132281350 | 101857354 | 101858560 | d7Mseg2895 | 8674 |
| 7 | 132330100 | 132331650 | 101905772 | 101907266 | d7Mseg2897 | 8675 |
| 7 | 132376400 | 132377850 | 101969762 | 101971242 | d7Mseg2899 | 8676 |
| 7 | 132508100 | 132510050 | 102088070 | 102091071 | d7Mseg2903 | 8677 |
| 7 | 132523850 | 132525500 | 102440289 | 102440722 | d7Mseg2904 | 8678 |
| 7 | 132584400 | 132586450 | 102306692 | 102307679 | d7Mseg2906 | 8679 |
| 7 | 132595900 | 132597250 | 102312482 | 102314440 | d7Mseg2907 | 8680 |
| 7 | 132603300 | 132605250 | 102319645 | 102320416 | d7Mseg2908 | 8681 |
| 7 | 132612150 | 132613950 | 102336374 | 102338376 | d7Mseg2909 | 8682 |
| 7 | 132615800 | 132617600 | 102340169 | 102340550 | d7Mseg2910 | 8683 |
| 7 | 132628650 | 132630300 | 102373401 | 102376459 | d7Mseg2911 | 8684 |
| 7 | 132672500 | 132674100 | 102469705 | 102470657 | d7Mseg2913 | 8685 |
| 7 | 132688550 | 132691800 | 102488905 | 102490451 | d7Mseg2915 | 8686 |
| 7 | 132751950 | 132753500 | 102570679 | 102572390 | d7Mseg2916 | 8687 |
| 7 | 132803350 | 132805150 | 102629513 | 102631774 | d7Mseg2918 | 8688 |
| 7 | 133163900 | 133165700 | 102796940 | 102799433 | d7Mseg2931 | 8689 |
| 7 | 133178750 | 133179800 | 102819701 | 102819849 | d7Mseg2933 | 8690 |
| 7 | 133200550 | 133203200 | 102862543 | 102865211 | d7Mseg2935 | 8691 |
| 7 | 133242550 | 133244400 | 102883877 | 102885870 | d7Mseg2936 | 8692 |
| 7 | 133277450 | 133279250 | 102943017 | 102943909 | d7Mseg2937 | 8693 |
| 7 | 133295750 | 133298500 | 102966529 | 102969721 | d7Mseg2938 | 8694 |
| 7 | 133318550 | 133320650 | 102987526 | 102989858 | d7Mseg2939 | 8695 |
| 7 | 133324650 | 133326000 | 102993077 | 102994538 | d7Mseg2940 | 8696 |
| 7 | 133339350 | 133340450 | 103010115 | 103011864 | d7Mseg2941 | 8697 |
| 7 | 133381700 | 133384950 | 103066136 | 103068374 | d7Mseg2942 | 8698 |
| 7 | 133400300 | 133404050 | 103084646 | 103087874 | d7Mseg2943 | 8699 |
| 7 | 133428100 | 133429500 | 103098720 | 103099647 | d7Mseg2945 | 8700 |
| 7 | 133651500 | 133659650 | 103497403 | 103501568 | d7Mseg2952 | 8701 |
| 7 | 133687650 | 133689200 | 103520117 | 103520775 | d7Mseg2955 | 8702 |
| 7 | 133711000 | 133714050 | 103541795 | 103544702 | d7Mseg2956 | 8703 |
| 7 | 133730950 | 133732750 | 103563228 | 103564744 | d7Mseg2957 | 8704 |
| 7 | 133955600 | 133957350 | 103717164 | 103717936 | d7Mseg2960 | 8705 |
| 7 | 133983300 | 133985050 | 103732911 | 103733977 | d7Mseg2961 | 8706 |
| 7 | 133987500 | 133990850 | 103735948 | 103738496 | d7Mseg2962 | 8707 |
| 7 | 133992750 | 133994750 | 103739582 | 103742239 | d7Mseg2963 | 8708 |
| 7 | 134003050 | 134004350 | 103751161 | 103751770 | d7Mseg2964 | 8709 |
| 7 | 134103350 | 134107500 | 103808956 | 103813140 | d7Mseg2967 | 8710 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 134135300 | 134136950 | 103835665 | 103836445 | d7Mseg2969 | 8711 |
| 7 | 134143300 | 134145000 | 103841454 | 103842819 | d7Mseg2970 | 8712 |
| 7 | 134161550 | 134163000 | 103870583 | 103870735 | d7Mseg2972 | 8713 |
| 7 | 134249200 | 134250200 | 103951239 | 103952239 | d7Mseg2973 | 8714 |
| 7 | 134264950 | 134267150 | 103980063 | 103980352 | d7Mseg2974 | 8715 |
| 7 | 134292950 | 134294650 | 103989534 | 103989913 | d7Mseg2975 | 8716 |
| 7 | 134321550 | 134323650 | 104017107 | 104019756 | d7Mseg2976 | 8717 |
| 7 | 134339100 | 134340850 | 104033297 | 104035279 | d7Mseg2977 | 8718 |
| 7 | 134384450 | 134385600 | 104100048 | 104100924 | d7Mseg2979 | 8719 |
| 7 | 134564000 | 134565900 | 104282526 | 104290859 | d7Mseg2982 | 8720 |
| 7 | 134633250 | 134634850 | 104357605 | 104358310 | d7Mseg2983 | 8721 |
| 7 | 134669600 | 134671000 | 104386408 | 104388399 | d7Mseg2984 | 8722 |
| 7 | 134748800 | 134750050 | 104473547 | 104474449 | d7Mseg2985 | 8723 |
| 7 | 134791700 | 134793550 | 104537116 | 104537499 | d7Mseg2986 | 8724 |
| 7 | 134824550 | 134825800 | 104566464 | 104567080 | d7Mseg2987 | 8725 |
| 7 | 134909200 | 134911000 | 104630711 | 104630974 | d7Mseg2990 | 8726 |
| 7 | 134966500 | 134967950 | 104662178 | 104663764 | d7Mseg2993 | 8727 |
| 7 | 134986650 | 134988150 | 104681898 | 104682819 | d7Mseg2995 | 8728 |
| 7 | 134992300 | 134994100 | 104695101 | 104697016 | d7Mseg2996 | 8729 |
| 7 | 135014150 | 135015950 | 104713272 | 104715237 | d7Mseg2997 | 8730 |
| 7 | 135066400 | 135068350 | 104746234 | 104748206 | d7Mseg2999 | 8731 |
| 7 | 135143400 | 135144900 | 104797378 | 104800214 | d7Mseg3000 | 8732 |
| 7 | 135256150 | 135258800 | 104879874 | 104882551 | d7Mseg3002 | 8733 |
| 7 | 135268800 | 135271750 | 104890808 | 104893265 | d7Mseg3003 | 8734 |
| 7 | 135326000 | 135330250 | 104962196 | 104964823 | d7Mseg3005 | 8735 |
| 7 | 135355800 | 135358300 | 104988195 | 104990876 | d7Mseg3006 | 8736 |
| 7 | 135446400 | 135451500 | 105063912 | 105069173 | d7Mseg3007 | 8737 |
| 7 | 135488250 | 135490000 | 105116090 | 105118380 | d7Mseg3008 | 8738 |
| 7 | 135501850 | 135503650 | 105142202 | 105143460 | d7Mseg3009 | 8739 |
| 7 | 135575950 | 135577350 | 105253181 | 105253748 | d7Mseg3011 | 8740 |
| 7 | 135639300 | 135644900 | 105302419 | 105303360 | d7Mseg3014 | 8741 |
| 7 | 135751400 | 135752650 | 105421015 | 105422213 | d7Mseg3016 | 8742 |
| 7 | 135787300 | 135790900 | 105461775 | 105463503 | d7Mseg3018 | 8743 |
| 7 | 135834800 | 135836250 | 105535890 | 105536614 | d7Mseg3020 | 8744 |
| 7 | 135891400 | 135893050 | 105638898 | 105639361 | d7Mseg3021 | 8745 |
| 7 | 136013150 | 136015350 | 105854114 | 105855626 | d7Mseg3026 | 8746 |
| 7 | 136026150 | 136027250 | 105864919 | 105865951 | d7Mseg3027 | 8747 |
| 7 | 136066050 | 136068150 | 105891334 | 105892267 | d7Mseg3028 | 8748 |
| 7 | 136122200 | 136123350 | 105954295 | 105955102 | d7Mseg3029 | 8749 |
| 7 | 136144350 | 136147100 | 105969149 | 105971877 | d7Mseg3030 | 8750 |
| 7 | 136153000 | 136154650 | 105977261 | 105977885 | d7Mseg3031 | 8751 |
| 7 | 136197250 | 136198750 | 106030161 | 106033128 | d7Mseg3032 | 8752 |
| 7 | 136207950 | 136209200 | 106040873 | 106041628 | d7Mseg3033 | 8753 |
| 7 | 136218150 | 136224400 | 106044395 | 106050619 | d7Mseg3034 | 8754 |
| 7 | 136237250 | 136239300 | 106062740 | 106064240 | d7Mseg3035 | 8755 |
| 7 | 136301150 | 136302850 | 106132234 | 106132558 | d7Mseg3037 | 8756 |
| 7 | 136355250 | 136356700 | 106182761 | 106184218 | d7Mseg3039 | 8757 |
| 7 | 136398400 | 136399850 | 106235706 | 106237160 | d7Mseg3040 | 8758 |
| 7 | 136403900 | 136405900 | 106241224 | 106243187 | d7Mseg3041 | 8759 |
| 7 | 136412600 | 136413600 | 106252729 | 106253249 | d7Mseg3043 | 8760 |
| 7 | 136465750 | 136469500 | 106268520 | 106269137 | d7Mseg3045 | 8761 |
| 7 | 136553250 | 136554500 | 106387278 | 106389492 | d7Mseg3048 | 8762 |
| 7 | 136592300 | 136602000 | 106445399 | 106454986 | d7Mseg3049 | 8763 |
| 7 | 136609250 | 136610850 | 106459802 | 106461378 | d7Mseg3050 | 8764 |
| 7 | 136613550 | 136615250 | 106463517 | 106465142 | d7Mseg3051 | 8765 |
| 7 | 136634350 | 136635500 | 106480643 | 106481487 | d7Mseg3052 | 8766 |
| 7 | 136672000 | 136673100 | 106538071 | 106538521 | d7Mseg3053 | 8767 |
| 7 | 136684650 | 136685800 | 106554821 | 106555966 | d7Mseg3054 | 8768 |
| 7 | 136707850 | 136709550 | 106577305 | 106579105 | d7Mseg3056 | 8769 |
| 7 | 136716850 | 136718800 | 106585270 | 106586229 | d7Mseg3057 | 8770 |
| 7 | 136721500 | 136722550 | 106589619 | 106590235 | d7Mseg3058 | 8771 |
| 7 | 136729450 | 136730650 | 106598516 | 106599733 | d7Mseg3059 | 8772 |
| 7 | 136736300 | 136737900 | 106603923 | 106605395 | d7Mseg3060 | 8773 |
| 7 | 136740500 | 136742250 | 106614710 | 106618409 | d7Mseg3061 | 8774 |
| 7 | 136793950 | 136795650 | 106675212 | 106677973 | d7Mseg3063 | 8775 |
| 7 | 136801250 | 136803550 | 106683726 | 106685337 | d7Mseg3064 | 8776 |
| 7 | 136807150 | 136814550 | 106688055 | 106694972 | d7Mseg3065 | 8777 |
| 7 | 136819600 | 136821300 | 106700784 | 106702512 | d7Mseg3066 | 8778 |
| 7 | 136830350 | 136831950 | 106709895 | 106711571 | d7Mseg3067 | 8779 |
| 7 | 136871650 | 136873150 | 106745707 | 106746745 | d7Mseg3070 | 8780 |
| 7 | 136874300 | 136877700 | 106747802 | 106750865 | d7Mseg3071 | 8781 |
| 7 | 136885850 | 136887200 | 106757232 | 106759029 | d7Mseg3072 | 8782 |
| 7 | 136897100 | 136899200 | 106770265 | 106772217 | d7Mseg3073 | 8783 |
| 7 | 136902500 | 136904300 | 106775963 | 106777498 | d7Mseg3074 | 8784 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 136940800 | 136942300 | 106809370 | 106810817 | d7Mseg3075 | 8785 |
| 7 | 136945200 | 136946850 | 106813880 | 106815226 | d7Mseg3076 | 8786 |
| 7 | 136949650 | 136951200 | 106817236 | 106818062 | d7Mseg3077 | 8787 |
| 7 | 136964300 | 136970500 | 106842102 | 106849053 | d7Mseg3078 | 8788 |
| 7 | 136974450 | 136976200 | 106852488 | 106854245 | d7Mseg3079 | 8789 |
| 7 | 136984050 | 136985650 | 106859156 | 106859525 | d7Mseg3080 | 8790 |
| 7 | 136989950 | 136993450 | 106870756 | 106873713 | d7Mseg3081 | 8791 |
| 7 | 137005400 | 137007250 | 106887245 | 106888793 | d7Mseg3083 | 8792 |
| 7 | 137026450 | 137028300 | 106903031 | 106905423 | d7Mseg3084 | 8793 |
| 7 | 137043700 | 137046750 | 106919655 | 106921526 | d7Mseg3085 | 8794 |
| 7 | 137052300 | 137053900 | 106925332 | 106927240 | d7Mseg3086 | 8795 |
| 7 | 137066100 | 137067250 | 106945299 | 106947884 | d7Mseg3087 | 8796 |
| 7 | 137074650 | 137078000 | 106956989 | 106960573 | d7Mseg3088 | 8797 |
| 7 | 137085350 | 137087050 | 106967779 | 106969103 | d7Mseg3089 | 8798 |
| 7 | 137094550 | 137095650 | 106977652 | 106977866 | d7Mseg3090 | 8799 |
| 7 | 137122300 | 137125750 | 107007407 | 107011076 | d7Mseg3091 | 8800 |
| 7 | 137131200 | 137137750 | 107016847 | 107022121 | d7Mseg3092 | 8801 |
| 7 | 137142050 | 137143600 | 107026911 | 107027327 | d7Mseg3093 | 8802 |
| 7 | 137168750 | 137170000 | 107037035 | 107038019 | d7Mseg3096 | 8803 |
| 7 | 137193950 | 137195500 | 107060391 | 107064080 | d7Mseg3097 | 8804 |
| 7 | 137198450 | 137202100 | 107068335 | 107072988 | d7Mseg3098 | 8805 |
| 7 | 137223600 | 137225000 | 107093763 | 107095058 | d7Mseg3099 | 8806 |
| 7 | 137252200 | 137255750 | 107134868 | 107137424 | d7Mseg3100 | 8807 |
| 7 | 137263800 | 137265550 | 107141530 | 107142547 | d7Mseg3101 | 8808 |
| 7 | 137272200 | 137273950 | 107147962 | 107149654 | d7Mseg3102 | 8809 |
| 7 | 137278000 | 137279250 | 107155153 | 107156168 | d7Mseg3103 | 8810 |
| 7 | 137283600 | 137285450 | 107158429 | 107160825 | d7Mseg3104 | 8811 |
| 7 | 137288600 | 137289800 | 107163530 | 107163971 | d7Mseg3105 | 8812 |
| 7 | 137294450 | 137296100 | 107166342 | 107167957 | d7Mseg3106 | 8813 |
| 7 | 137326250 | 137329900 | 107209009 | 107212410 | d7Mseg3107 | 8814 |
| 7 | 137342550 | 137346250 | 107220701 | 107224366 | d7Mseg3109 | 8815 |
| 7 | 137403650 | 137405450 | 107252202 | 107253411 | d7Mseg3115 | 8816 |
| 7 | 137440150 | 137441600 | 107285902 | 107287184 | d7Mseg3117 | 8817 |
| 7 | 137457750 | 137459850 | 107307978 | 107309388 | d7Mseg3118 | 8818 |
| 7 | 137466850 | 137468400 | 107315464 | 107316985 | d7Mseg3119 | 8819 |
| 7 | 137514600 | 137516400 | 107364837 | 107365401 | d7Mseg3120 | 8820 |
| 7 | 137593900 | 137594950 | 107394373 | 107395281 | d7Mseg3123 | 8821 |
| 7 | 137598500 | 137600100 | 107397620 | 107399000 | d7Mseg3124 | 8822 |
| 7 | 137606700 | 137608700 | 107404896 | 107407314 | d7Mseg3125 | 8823 |
| 7 | 137610750 | 137612550 | 107409521 | 107411504 | d7Mseg3126 | 8824 |
| 7 | 137619700 | 137624900 | 107417078 | 107420206 | d7Mseg3127 | 8825 |
| 7 | 137652250 | 137654450 | 107447414 | 107449123 | d7Mseg3128 | 8826 |
| 7 | 137658900 | 137659950 | 107453570 | 107454673 | d7Mseg3129 | 8827 |
| 7 | 137669550 | 137671550 | 107465427 | 107468408 | d7Mseg3130 | 8828 |
| 7 | 137675800 | 137677500 | 107473323 | 107475127 | d7Mseg3131 | 8829 |
| 7 | 137703100 | 137705150 | 107498361 | 107501096 | d7Mseg3132 | 8830 |
| 7 | 137761850 | 137763850 | 107553890 | 107554850 | d7Mseg3135 | 8831 |
| 7 | 137766050 | 137767700 | 107556077 | 107556563 | d7Mseg3136 | 8832 |
| 7 | 137784950 | 137786600 | 107568094 | 107568751 | d7Mseg3137 | 8833 |
| 7 | 137813400 | 137815250 | 107588374 | 107589515 | d7Mseg3139 | 8834 |
| 7 | 137829150 | 137831000 | 107601027 | 107603219 | d7Mseg3140 | 8835 |
| 7 | 137862250 | 137864200 | 107622146 | 107623383 | d7Mseg3142 | 8836 |
| 7 | 137888150 | 137889900 | 107656540 | 107658592 | d7Mseg3143 | 8837 |
| 7 | 137893100 | 137895000 | 107662459 | 107664319 | d7Mseg3144 | 8838 |
| 7 | 137909200 | 137911500 | 107682283 | 107684615 | d7Mseg3145 | 8839 |
| 7 | 137913900 | 137916250 | 107686917 | 107689639 | d7Mseg3146 | 8840 |
| 7 | 137950050 | 137952350 | 107756867 | 107757185 | d7Mseg3149 | 8841 |
| 7 | 137982700 | 137984150 | 107806090 | 107806409 | d7Mseg3150 | 8842 |
| 7 | 138027700 | 138030250 | 107831065 | 107832687 | d7Mseg3153 | 8843 |
| 7 | 138046350 | 138047900 | 107840494 | 107841803 | d7Mseg3155 | 8844 |
| 7 | 138052850 | 138054650 | 107850161 | 107852252 | d7Mseg3156 | 8845 |
| 7 | 138056650 | 138058350 | 107854912 | 107856349 | d7Mseg3157 | 8846 |
| 7 | 138087250 | 138088850 | 107908162 | 107909838 | d7Mseg3159 | 8847 |
| 7 | 138106400 | 138108400 | 107924839 | 107929467 | d7Mseg3160 | 8848 |
| 7 | 138111750 | 138113550 | 107932078 | 107932981 | d7Mseg3161 | 8849 |
| 7 | 138117300 | 138121300 | 107935418 | 107938688 | d7Mseg3162 | 8850 |
| 7 | 138124950 | 138127450 | 107941924 | 107942819 | d7Mseg3163 | 8851 |
| 7 | 138142300 | 138143700 | 107960303 | 107961582 | d7Mseg3166 | 8852 |
| 7 | 138147500 | 138149300 | 107965118 | 107967886 | d7Mseg3167 | 8853 |
| 7 | 138151800 | 138162300 | 107971425 | 107982189 | d7Mseg3168 | 8854 |
| 7 | 138217300 | 138219350 | 108103061 | 108104893 | d7Mseg3169 | 8855 |
| 7 | 138222150 | 138223400 | 108106539 | 108106916 | d7Mseg3170 | 8856 |
| 7 | 138232550 | 138234100 | 108117283 | 108118081 | d7Mseg3171 | 8857 |
| 7 | 138264500 | 138266550 | 108211591 | 108224000 | d7Mseg3174 | 8858 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 138281800 | 138283800 | 108243711 | 108244277 | d7Mseg3175 | 8859 |
| 7 | 138293800 | 138295350 | 108285957 | 108286337 | d7Mseg3176 | 8860 |
| 7 | 138408650 | 138409950 | 108471797 | 108477883 | d7Mseg3179 | 8861 |
| 7 | 138423200 | 138424850 | 108510414 | 108511696 | d7Mseg3180 | 8862 |
| 7 | 138518100 | 138519750 | 108614112 | 108615772 | d7Mseg3182 | 8863 |
| 7 | 138524200 | 138527000 | 108619894 | 108623746 | d7Mseg3183 | 8864 |
| 7 | 138528750 | 138530650 | 108625369 | 108627261 | d7Mseg3184 | 8865 |
| 7 | 138533200 | 138534950 | 108629707 | 108631757 | d7Mseg3185 | 8866 |
| 7 | 138561600 | 138567200 | 108671263 | 108677554 | d7Mseg3186 | 8867 |
| 7 | 138621550 | 138623400 | 108716644 | 108718159 | d7Mseg3188 | 8868 |
| 7 | 138659450 | 138660700 | 108777715 | 108778654 | d7Mseg3189 | 8869 |
| 7 | 138679600 | 138681500 | 108790747 | 108791192 | d7Mseg3192 | 8870 |
| 7 | 138692450 | 138694100 | 108821604 | 108823023 | d7Mseg3193 | 8871 |
| 7 | 138738800 | 138740900 | 108866609 | 108868579 | d7Mseg3196 | 8872 |
| 7 | 138766000 | 138767700 | 108905719 | 108908087 | d7Mseg3198 | 8873 |
| 7 | 138769250 | 138771150 | 108909443 | 108910691 | d7Mseg3199 | 8874 |
| 7 | 138802500 | 138803550 | 108951055 | 108951586 | d7Mseg3200 | 8875 |
| 7 | 138817050 | 138818450 | 108969689 | 108971382 | d7Mseg3201 | 8876 |
| 7 | 138820350 | 138822000 | 108972908 | 108973901 | d7Mseg3202 | 8877 |
| 7 | 138824350 | 138826200 | 108975868 | 108977708 | d7Mseg3203 | 8878 |
| 7 | 138863550 | 138864600 | 109019189 | 109020105 | d7Mseg3204 | 8879 |
| 7 | 138884550 | 138886500 | 109036918 | 109041452 | d7Mseg3205 | 8880 |
| 7 | 138917250 | 138919200 | 109086888 | 109087309 | d7Mseg3206 | 8881 |
| 7 | 138962400 | 138964050 | 109122175 | 109123179 | d7Mseg3207 | 8882 |
| 7 | 138981250 | 138982750 | 109149466 | 109152513 | d7Mseg3208 | 8883 |
| 7 | 138988900 | 138990450 | 109154404 | 109157400 | d7Mseg3209 | 8884 |
| 7 | 139000950 | 139002800 | 109160992 | 109164535 | d7Mseg3211 | 8885 |
| 7 | 139004650 | 139005800 | 109166314 | 109166873 | d7Mseg3212 | 8886 |
| 7 | 139017300 | 139018700 | 109176959 | 109177870 | d7Mseg3213 | 8887 |
| 7 | 139020200 | 139022150 | 109179238 | 109180283 | d7Mseg3214 | 8888 |
| 7 | 139052200 | 139054200 | 109201560 | 109202933 | d7Mseg3216 | 8889 |
| 7 | 139061350 | 139063050 | 109207875 | 109208490 | d7Mseg3218 | 8890 |
| 7 | 139092200 | 139093250 | 109219388 | 109220169 | d7Mseg3223 | 8891 |
| 7 | 139097850 | 139099350 | 109230553 | 109230762 | d7Mseg3224 | 8892 |
| 7 | 139162400 | 139164300 | 109290242 | 109291815 | d7Mseg3226 | 8893 |
| 7 | 139174600 | 139175950 | 109299347 | 109299990 | d7Mseg3227 | 8894 |
| 7 | 139212950 | 139214700 | 109362669 | 109363674 | d7Mseg3229 | 8895 |
| 7 | 139220550 | 139221750 | 109368319 | 109369594 | d7Mseg3230 | 8896 |
| 7 | 139228550 | 139229750 | 109374293 | 109375173 | d7Mseg3231 | 8897 |
| 7 | 139267400 | 139269050 | 109415001 | 109416739 | d7Mseg3233 | 8898 |
| 7 | 139378150 | 139379250 | 109535031 | 109536166 | d7Mseg3234 | 8899 |
| 7 | 139399350 | 139403250 | 109559439 | 109563236 | d7Mseg3235 | 8900 |
| 7 | 139423200 | 139425050 | 109580360 | 109581853 | d7Mseg3236 | 8901 |
| 7 | 139436550 | 139438500 | 109603573 | 109605145 | d7Mseg3237 | 8902 |
| 7 | 139443800 | 139445450 | 109610883 | 109616857 | d7Mseg3238 | 8903 |
| 7 | 139479300 | 139480350 | 109644807 | 109645113 | d7Mseg3240 | 8904 |
| 7 | 139495350 | 139497000 | 109658437 | 109660121 | d7Mseg3242 | 8905 |
| 7 | 139513950 | 139516200 | 109674292 | 109676555 | d7Mseg3243 | 8906 |
| 7 | 139517850 | 139519250 | 109678640 | 109679489 | d7Mseg3244 | 8907 |
| 7 | 139524850 | 139528650 | 109685038 | 109688559 | d7Mseg3245 | 8908 |
| 7 | 139529900 | 139531750 | 109689803 | 109691391 | d7Mseg3246 | 8909 |
| 7 | 139599250 | 139600400 | 109760060 | 109761082 | d7Mseg3248 | 8910 |
| 7 | 139819950 | 139821450 | 110030447 | 110031541 | d7Mseg3253 | 8911 |
| 7 | 139827450 | 139830300 | 110038100 | 110040925 | d7Mseg3254 | 8912 |
| 7 | 139832100 | 139833300 | 110042620 | 110043169 | d7Mseg3255 | 8913 |
| 7 | 139869350 | 139872550 | 110078155 | 110079210 | d7Mseg3256 | 8914 |
| 7 | 139936700 | 139940500 | 110158552 | 110161098 | d7Mseg3259 | 8915 |
| 7 | 139949100 | 139950350 | 110184289 | 110185133 | d7Mseg3261 | 8916 |
| 7 | 139952800 | 139955200 | 110187318 | 110189585 | d7Mseg3262 | 8917 |
| 7 | 140012500 | 140013750 | 110245776 | 110246469 | d7Mseg3263 | 8918 |
| 7 | 140015300 | 140017000 | 110248032 | 110249346 | d7Mseg3264 | 8919 |
| 7 | 140075050 | 140076950 | 110305481 | 110310141 | d7Mseg3266 | 8920 |
| 7 | 140099200 | 140101150 | 110339683 | 110341701 | d7Mseg3267 | 8921 |
| 7 | 140120500 | 140122300 | 110361199 | 110362042 | d7Mseg3268 | 8922 |
| 7 | 140124350 | 140127400 | 110364009 | 110365910 | d7Mseg3269 | 8923 |
| 7 | 140130050 | 140131150 | 110368675 | 110369855 | d7Mseg3270 | 8924 |
| 7 | 140178000 | 140179750 | 110415161 | 110418374 | d7Mseg3272 | 8925 |
| 7 | 140200100 | 140201850 | 110436064 | 110438052 | d7Mseg3273 | 8926 |
| 7 | 140207550 | 140209350 | 110438424 | 110439541 | d7Mseg3274 | 8927 |
| 7 | 140269400 | 140270750 | 110518960 | 110520340 | d7Mseg3275 | 8928 |
| 7 | 140284200 | 140286100 | 110530553 | 110532112 | d7Mseg3276 | 8929 |
| 7 | 140287350 | 140288650 | 110533461 | 110534446 | d7Mseg3277 | 8930 |
| 7 | 140318700 | 140321300 | 110591481 | 110594963 | d7Mseg3278 | 8931 |
| 7 | 140331400 | 140333250 | 110609285 | 110611393 | d7Mseg3279 | 8932 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 140345350 | 140347300 | 110625889 | 110628080 | d7Mseg3280 | 8933 |
| 7 | 140365550 | 140367400 | 110653329 | 110655158 | d7Mseg3281 | 8934 |
| 7 | 140541200 | 140542600 | 110735570 | 110736249 | d7Mseg3284 | 8935 |
| 7 | 140572500 | 140574100 | 110747285 | 110747744 | d7Mseg3285 | 8936 |
| 7 | 140588600 | 140590100 | 110755209 | 110756686 | d7Mseg3286 | 8937 |
| 7 | 140597000 | 140598250 | 110761855 | 110763057 | d7Mseg3287 | 8938 |
| 7 | 140600200 | 140601650 | 110765075 | 110766358 | d7Mseg3288 | 8939 |
| 7 | 140630750 | 140632450 | 110806446 | 110807444 | d7Mseg3290 | 8940 |
| 7 | 140753350 | 140755250 | 110925177 | 110926040 | d7Mseg3293 | 8941 |
| 7 | 140766800 | 140768750 | 110948098 | 110948959 | d7Mseg3294 | 8942 |
| 7 | 140784350 | 140786050 | 110968453 | 110970741 | d7Mseg3295 | 8943 |
| 7 | 140792500 | 140794450 | 110980426 | 110982130 | d7Mseg3296 | 8944 |
| 7 | 140816150 | 140818050 | 111018679 | 111020387 | d7Mseg3297 | 8945 |
| 7 | 140819500 | 140820700 | 111022027 | 111022506 | d7Mseg3298 | 8946 |
| 7 | 140895450 | 140899900 | 111127964 | 111130522 | d7Mseg3300 | 8947 |
| 7 | 140957250 | 140958650 | 111194459 | 111195910 | d7Mseg3303 | 8948 |
| 7 | 141062250 | 141064150 | 111263463 | 111265156 | d7Mseg3306 | 8949 |
| 7 | 141083500 | 141084750 | 111289905 | 111290648 | d7Mseg3307 | 8950 |
| 7 | 141094000 | 141095650 | 111305509 | 111306359 | d7Mseg3308 | 8951 |
| 7 | 141119500 | 141127700 | 111322217 | 111330457 | d7Mseg3309 | 8952 |
| 7 | 141220650 | 141221850 | 111400582 | 111401079 | d7Mseg3314 | 8953 |
| 7 | 141267700 | 141272150 | 111429188 | 111438980 | d7Mseg3316 | 8954 |
| 7 | 141314100 | 141315100 | 111462230 | 111462680 | d7Mseg3318 | 8955 |
| 7 | 141333400 | 141335250 | 111480444 | 111481290 | d7Mseg3319 | 8956 |
| 7 | 141349350 | 141351100 | 111490471 | 111491871 | d7Mseg3320 | 8957 |
| 7 | 141367700 | 141369400 | 111508506 | 111512804 | d7Mseg3321 | 8958 |
| 7 | 141405200 | 141407000 | 111537976 | 111538889 | d7Mseg3322 | 8959 |
| 7 | 141449950 | 141451950 | 111581820 | 111583018 | d7Mseg3323 | 8960 |
| 7 | 141453350 | 141455100 | 111584261 | 111585449 | d7Mseg3324 | 8961 |
| 7 | 141537700 | 141539250 | 111679833 | 111680409 | d7Mseg3325 | 8962 |
| 7 | 141543700 | 141545350 | 111689059 | 111690830 | d7Mseg3326 | 8963 |
| 7 | 141603900 | 141606000 | 111754275 | 111756680 | d7Mseg3327 | 8964 |
| 7 | 141617900 | 141619250 | 111768568 | 111769663 | d7Mseg3328 | 8965 |
| 7 | 141621750 | 141623450 | 111772015 | 111773002 | d7Mseg3329 | 8966 |
| 7 | 141764800 | 141767500 | 111907708 | 111908384 | d7Mseg3333 | 8967 |
| 7 | 141769600 | 141771100 | 111910145 | 111911273 | d7Mseg3334 | 8968 |
| 7 | 141787600 | 141790400 | 111925682 | 111926276 | d7Mseg3335 | 8969 |
| 7 | 141838200 | 141839650 | 111978992 | 111979520 | d7Mseg3336 | 8970 |
| 7 | 141844200 | 141845350 | 111984183 | 111984714 | d7Mseg3337 | 8971 |
| 7 | 141886300 | 141887900 | 112023445 | 112025773 | d7Mseg3338 | 8972 |
| 7 | 141895400 | 141897250 | 112034682 | 112036861 | d7Mseg3339 | 8973 |
| 7 | 141906350 | 141907950 | 112050181 | 112050777 | d7Mseg3340 | 8974 |
| 7 | 141916300 | 141917350 | 112060767 | 112061838 | d7Mseg3341 | 8975 |
| 7 | 141935250 | 141936550 | 112079617 | 112081072 | d7Mseg3342 | 8976 |
| 7 | 141938500 | 141942750 | 112083066 | 112087861 | d7Mseg3343 | 8977 |
| 7 | 142102950 | 142104900 | 112240339 | 112243025 | d7Mseg3348 | 8978 |
| 7 | 142123150 | 142124300 | 112281785 | 112282907 | d7Mseg3349 | 8979 |
| 7 | 142249800 | 142251500 | 112459907 | 112462746 | d7Mseg3351 | 8980 |
| 7 | 142264950 | 142266350 | 112467889 | 112468180 | d7Mseg3352 | 8981 |
| 7 | 142273600 | 142274850 | 112484419 | 112485260 | d7Mseg3353 | 8982 |
| 7 | 142451450 | 142452500 | 112621802 | 112622393 | d7Mseg3356 | 8983 |
| 7 | 142898600 | 142902200 | 113239476 | 113239928 | d7Mseg3361 | 8984 |
| 7 | 143010350 | 143011600 | 113343945 | 113344663 | d7Mseg3364 | 8985 |
| 7 | 143203700 | 143205300 | 113601424 | 113602052 | d7Mseg3367 | 8986 |
| 7 | 143322650 | 143324000 | 113760920 | 113761136 | d7Mseg3368 | 8987 |
| 7 | 143361100 | 143362950 | 113784437 | 113785624 | d7Mseg3369 | 8988 |
| 7 | 143391700 | 143399450 | 113813330 | 113820682 | d7Mseg3370 | 8989 |
| 7 | 143434600 | 143436400 | 113871299 | 113872955 | d7Mseg3371 | 8990 |
| 7 | 143493650 | 143494850 | 113941481 | 113941685 | d7Mseg3373 | 8991 |
| 7 | 143515400 | 143517300 | 113982665 | 113984434 | d7Mseg3374 | 8992 |
| 7 | 143622500 | 143624150 | 114135137 | 114135837 | d7Mseg3376 | 8993 |
| 7 | 143632850 | 143634550 | 114145020 | 114145660 | d7Mseg3377 | 8994 |
| 7 | 143798250 | 143800100 | 114213062 | 114214256 | d7Mseg3383 | 8995 |
| 7 | 143963900 | 143965650 | 114446851 | 114448580 | d7Mseg3385 | 8996 |
| 7 | 143988000 | 143989850 | 114468015 | 114469855 | d7Mseg3386 | 8997 |
| 7 | 144006300 | 144007350 | 114502213 | 114502652 | d7Mseg3387 | 8998 |
| 7 | 146942100 | 146943100 | 52971036 | 52971195 | d7Mseg3397 | 8999 |
| 7 | 146984600 | 146986000 | 55053197 | 55054435 | d7Mseg3398 | 9000 |
| 7 | 147006600 | 147007650 | 55032762 | 55033578 | d7Mseg3399 | 9001 |
| 7 | 147048400 | 147049400 | 54984813 | 54985377 | d7Mseg3401 | 9002 |
| 7 | 147079250 | 147080800 | 54957122 | 54958354 | d7Mseg3402 | 9003 |
| 7 | 147232000 | 147233000 | 54868422 | 54868599 | d7Mseg3410 | 9004 |
| 7 | 147238050 | 147239950 | 54844956 | 54846982 | d7Mseg3411 | 9005 |
| 7 | 147242050 | 147243450 | 54839795 | 54841281 | d7Mseg3412 | 9006 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 147251800 | 147254850 | 54828856 | 54830093 | d7Mseg3413 | 9007 |
| 7 | 147277250 | 147280500 | 54800904 | 54815394 | d7Mseg3414 | 9008 |
| 7 | 147286350 | 147288050 | 54780266 | 54781770 | d7Mseg3415 | 9009 |
| 7 | 147311600 | 147313300 | 54754944 | 54755417 | d7Mseg3416 | 9010 |
| 7 | 147421600 | 147423400 | 54583234 | 54586090 | d7Mseg3418 | 9011 |
| 7 | 147442200 | 147443900 | 54560614 | 54561460 | d7Mseg3419 | 9012 |
| 7 | 147465050 | 147468750 | 54531430 | 54537362 | d7Mseg3421 | 9013 |
| 7 | 147478700 | 147483450 | 54520505 | 54525870 | d7Mseg3422 | 9014 |
| 7 | 147491600 | 147495800 | 54505520 | 54507798 | d7Mseg3423 | 9015 |
| 7 | 147508100 | 147509100 | 54489526 | 54490295 | d7Mseg3424 | 9016 |
| 7 | 147623550 | 147625100 | 54365864 | 54366273 | d7Mseg3427 | 9017 |
| 7 | 147779150 | 147780400 | 54207955 | 54209261 | d7Mseg3431 | 9018 |
| 7 | 147954450 | 147956800 | 54069347 | 54071787 | d7Mseg3434 | 9019 |
| 7 | 147976150 | 147977650 | 54055511 | 54055761 | d7Mseg3436 | 9020 |
| 7 | 148070000 | 148072100 | 53961562 | 53962537 | d7Mseg3438 | 9021 |
| 7 | 148235950 | 148238050 | 53710937 | 53713068 | d7Mseg3446 | 9022 |
| 7 | 148277350 | 148278450 | 53671825 | 53672791 | d7Mseg3447 | 9023 |
| 7 | 148309350 | 148311000 | 53630304 | 53631519 | d7Mseg3448 | 9024 |
| 7 | 148351400 | 148352950 | 53576439 | 53578409 | d7Mseg3449 | 9025 |
| 7 | 148401250 | 148403000 | 53486649 | 53490244 | d7Mseg3451 | 9026 |
| 7 | 148436000 | 148437150 | 53460580 | 53461738 | d7Mseg3452 | 9027 |
| 7 | 148448100 | 148452250 | 53448361 | 53451724 | d7Mseg3453 | 9028 |
| 7 | 148466750 | 148468400 | 53432729 | 53434296 | d7Mseg3454 | 9029 |
| 7 | 148525550 | 148527250 | 53383097 | 53384418 | d7Mseg3456 | 9030 |
| 7 | 148530350 | 148532150 | 53381817 | 53382169 | d7Mseg3457 | 9031 |
| 7 | 148564650 | 148567200 | 53359327 | 53362767 | d7Mseg3459 | 9032 |
| 7 | 148578400 | 148581050 | 53348023 | 53350933 | d7Mseg3460 | 9033 |
| 7 | 148599100 | 148600650 | 53322029 | 53323583 | d7Mseg3461 | 9034 |
| 7 | 148605950 | 148608800 | 53315296 | 53317427 | d7Mseg3462 | 9035 |
| 7 | 148632800 | 148634100 | 53289589 | 53291266 | d7Mseg3463 | 9036 |
| 7 | 148635150 | 148636850 | 53285821 | 53287615 | d7Mseg3464 | 9037 |
| 7 | 148645700 | 148646700 | 53277282 | 53278119 | d7Mseg3465 | 9038 |
| 7 | 148649700 | 148651600 | 53269829 | 53273042 | d7Mseg3466 | 9039 |
| 7 | 148653000 | 148654250 | 53267506 | 53268880 | d7Mseg3467 | 9040 |
| 7 | 148656400 | 148658050 | 53263780 | 53265466 | d7Mseg3468 | 9041 |
| 7 | 148735200 | 148736850 | 53150809 | 53151406 | d7Mseg3469 | 9042 |
| 7 | 148775450 | 148777250 | 53111284 | 53113157 | d7Mseg3470 | 9043 |
| 7 | 148780600 | 148782500 | 53105176 | 53107227 | d7Mseg3471 | 9044 |
| 7 | 148791600 | 148793400 | 53094978 | 53096520 | d7Mseg3472 | 9045 |
| 7 | 149057600 | 149058800 | 9899748 | 9901003 | d7Mseg3482 | 9046 |
| 7 | 149203250 | 149205000 | 9753596 | 9755294 | d7Mseg3484 | 9047 |
| 7 | 149216550 | 149218150 | 9731609 | 9733894 | d7Mseg3486 | 9048 |
| 7 | 149232900 | 149234850 | 9707159 | 9707778 | d7Mseg3487 | 9049 |
| 7 | 149236050 | 149237750 | 9704243 | 9705597 | d7Mseg3488 | 9050 |
| 7 | 149250950 | 149252750 | 9661638 | 9661901 | d7Mseg3489 | 9051 |
| 7 | 149405900 | 149408400 | 55477112 | 55477642 | d7Mseg3494 | 9052 |
| 7 | 149433550 | 149434650 | 55492392 | 55493438 | d7Mseg3496 | 9053 |
| 7 | 149440700 | 149441900 | 55515319 | 55516529 | d7Mseg3497 | 9054 |
| 7 | 149448450 | 149450400 | 55517426 | 55517660 | d7Mseg3498 | 9055 |
| 7 | 149455050 | 149456700 | 55531701 | 55533137 | d7Mseg3499 | 9056 |
| 7 | 149474000 | 149475800 | 55556711 | 55557153 | d7Mseg3500 | 9057 |
| 7 | 149556350 | 149557850 | 55633524 | 55633795 | d7Mseg3505 | 9058 |
| 7 | 149559000 | 149560750 | 55634152 | 55635302 | d7Mseg3506 | 9059 |
| 7 | 149576600 | 149578300 | 55746681 | 55748238 | d7Mseg3508 | 9060 |
| 7 | 149675100 | 149676900 | 55936552 | 55937868 | d7Mseg3512 | 9061 |
| 7 | 149689800 | 149690850 | 55951120 | 55952650 | d7Mseg3513 | 9062 |
| 7 | 149724050 | 149725750 | 56049263 | 56049706 | d7Mseg3515 | 9063 |
| 7 | 149743900 | 149745650 | 56145263 | 56148059 | d7Mseg3516 | 9064 |
| 7 | 149794050 | 149795950 | 56258774 | 56260707 | d7Mseg3517 | 9065 |
| 7 | 149823750 | 149826250 | 56308384 | 56310177 | d7Mseg3518 | 9066 |
| 7 | 149931200 | 149934200 | 56588443 | 56591468 | d7Mseg3523 | 9067 |
| 7 | 149938300 | 149940100 | 56596230 | 56596915 | d7Mseg3524 | 9068 |
| 7 | 150133100 | 150136500 | 56640085 | 56640811 | d7Mseg3529 | 9069 |
| 7 | 150266350 | 150268050 | 57095794 | 57097543 | d7Mseg3533 | 9070 |
| 7 | 151460850 | 151462100 | 141234918 | 141235496 | d7Mseg3543 | 9071 |
| 7 | 151603350 | 151605050 | 23838101 | 23840843 | d7Mseg3547 | 9072 |
| 7 | 151685450 | 151686650 | 23792048 | 23792709 | d7Mseg3549 | 9073 |
| 7 | 151696250 | 151698050 | 23760756 | 23761726 | d7Mseg3550 | 9074 |
| 7 | 151947900 | 151949450 | 23498961 | 23499766 | d7Mseg3559 | 9075 |
| 7 | 151972050 | 151973200 | 23433517 | 23434186 | d7Mseg3561 | 9076 |
| 7 | 152020250 | 152022200 | 23397105 | 23399091 | d7Mseg3562 | 9077 |
| 7 | 152034050 | 152035800 | 23382968 | 23384712 | d7Mseg3563 | 9078 |
| 7 | 152040550 | 152041750 | 23368914 | 23370631 | d7Mseg3564 | 9079 |
| 7 | 152055450 | 152061650 | 23349239 | 23355376 | d7Mseg3565 | 9080 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| 7 | 152066700 | 152068350 | 23344902 | 23345899 | d7Mseg3566 | 9081 |
| 7 | 152084050 | 152085850 | 23327861 | 23328207 | d7Mseg3567 | 9082 |
| 7 | 152193050 | 152194850 | 23246260 | 23248154 | d7Mseg3569 | 9083 |
| 7 | 152317000 | 152318450 | 23169555 | 23170629 | d7Mseg3571 | 9084 |
| 7 | 152359450 | 152360700 | 23138093 | 23138412 | d7Mseg3572 | 9085 |
| 7 | 152538800 | 152540350 | 23056272 | 23056544 | d7Mseg3573 | 9086 |
| 7 | 152541650 | 152543200 | 23054454 | 23055361 | d7Mseg3574 | 9087 |
| 7 | 152570550 | 152573700 | 23029661 | 23032856 | d7Mseg3576 | 9088 |
| 7 | 152714750 | 152716400 | 22922511 | 22922946 | d7Mseg3578 | 9089 |
| 7 | 152943750 | 152945500 | 22726175 | 22727205 | d7Mseg3580 | 9090 |
| 7 | 153284700 | 153285700 | 22490321 | 22490459 | d7Mseg3589 | 9091 |
| 7 | 153321250 | 153322400 | 22465004 | 22465689 | d7Mseg3590 | 9092 |
| 7 | 153345750 | 153347250 | 22427283 | 22428966 | d7Mseg3591 | 9093 |
| 7 | 153354600 | 153356050 | 22419728 | 22420373 | d7Mseg3592 | 9094 |
| 7 | 153359500 | 153363650 | 22409298 | 22416916 | d7Mseg3593 | 9095 |
| 7 | 153517400 | 153518900 | 22315097 | 22316711 | d7Mseg3595 | 9096 |
| 7 | 153558300 | 153559550 | 22292827 | 22293525 | d7Mseg3596 | 9097 |
| 7 | 153599650 | 153601350 | 22265814 | 22266414 | d7Mseg3597 | 9098 |
| 7 | 153662350 | 153663350 | 22203565 | 22204211 | d7Mseg3598 | 9099 |
| 7 | 153770550 | 153771850 | 22138020 | 22138468 | d7Mseg3599 | 9100 |
| 7 | 153784650 | 153786150 | 22118840 | 22124325 | d7Mseg3600 | 9101 |
| 7 | 153813700 | 153815300 | 22090650 | 22091668 | d7Mseg3601 | 9102 |
| 7 | 153835650 | 153837300 | 22068131 | 22071744 | d7Mseg3602 | 9103 |
| 7 | 153914450 | 153916200 | 21974126 | 21976976 | d7Mseg3603 | 9104 |
| 7 | 153925100 | 153929050 | 21959662 | 21965543 | d7Mseg3604 | 9105 |
| 7 | 153974950 | 153976600 | 21920450 | 21920938 | d7Mseg3605 | 9106 |
| 7 | 154024050 | 154025900 | 21864898 | 21865863 | d7Mseg3606 | 9107 |
| 7 | 154029100 | 154030900 | 21861717 | 21863666 | d7Mseg3607 | 9108 |
| 7 | 154167750 | 154171300 | 21742716 | 21747077 | d7Mseg3608 | 9109 |
| 7 | 154184500 | 154186700 | 21728894 | 21731965 | d7Mseg3609 | 9110 |
| 7 | 154194750 | 154196550 | 21719063 | 21720797 | d7Mseg3610 | 9111 |
| 7 | 154254100 | 154257400 | 21674872 | 21678135 | d7Mseg3611 | 9112 |
| 7 | 154380900 | 154383000 | 21508922 | 21510647 | d7Mseg3612 | 9113 |
| 7 | 154427750 | 154429650 | 21458224 | 21458960 | d7Mseg3613 | 9114 |
| 7 | 154478350 | 154484050 | 21389368 | 21395519 | d7Mseg3614 | 9115 |
| 7 | 154488400 | 154489850 | 21378807 | 21379224 | d7Mseg3615 | 9116 |
| 7 | 154648550 | 154649750 | 21183339 | 21183461 | d7Mseg3619 | 9117 |
| 7 | 154678600 | 154679600 | 21165875 | 21167460 | d7Mseg3621 | 9118 |
| 7 | 154722900 | 154724000 | 21132154 | 21133292 | d7Mseg3622 | 9119 |
| 7 | 154857150 | 154858450 | 20989212 | 20991061 | d7Mseg3624 | 9120 |
| 7 | 154860400 | 154865200 | 20977540 | 20985474 | d7Mseg3625 | 9121 |
| 7 | 154881250 | 154882650 | 20962671 | 20963007 | d7Mseg3626 | 9122 |
| 7 | 154891400 | 154893000 | 20958210 | 20959832 | d7Mseg3627 | 9123 |
| 7 | 154898600 | 154900100 | 20952400 | 20953095 | d7Mseg3628 | 9124 |
| 7 | 155013800 | 155015450 | 20849446 | 20850148 | d7Mseg3630 | 9125 |
| 7 | 155018750 | 155020450 | 20844081 | 20844501 | d7Mseg3631 | 9126 |
| 7 | 155050350 | 155051350 | 20823092 | 20824468 | d7Mseg3632 | 9127 |
| 7 | 155104750 | 155106100 | 20751953 | 20753841 | d7Mseg3633 | 9128 |
| 7 | 155131750 | 155133450 | 20738380 | 20743875 | d7Mseg3634 | 9129 |
| 7 | 155141200 | 155142200 | 20732686 | 20733737 | d7Mseg3635 | 9130 |
| 7 | 155205700 | 155207350 | 20655507 | 20657151 | d7Mseg3637 | 9131 |
| 7 | 155208900 | 155210900 | 20652824 | 20653527 | d7Mseg3638 | 9132 |
| 7 | 155239600 | 155241250 | 20632847 | 20635035 | d7Mseg3639 | 9133 |
| 7 | 155273950 | 155275550 | 20614370 | 20615008 | d7Mseg3640 | 9134 |
| 7 | 155293600 | 155295400 | 20585892 | 20587631 | d7Mseg3641 | 9135 |
| 7 | 155358000 | 155359000 | 20549830 | 20550735 | d7Mseg3643 | 9136 |
| 7 | 155405700 | 155407450 | 20515014 | 20516017 | d7Mseg3645 | 9137 |
| 7 | 155430700 | 155431700 | 20491373 | 20492388 | d7Mseg3647 | 9138 |
| 7 | 155462550 | 155464250 | 20473783 | 20474427 | d7Mseg3648 | 9139 |
| 7 | 155477000 | 155478900 | 20463273 | 20466091 | d7Mseg3649 | 9140 |
| 7 | 155480650 | 155481850 | 20460549 | 20461795 | d7Mseg3650 | 9141 |
| 7 | 155499850 | 155501950 | 20447748 | 20449457 | d7Mseg3651 | 9142 |
| 7 | 155519150 | 155521100 | 20428353 | 20430233 | d7Mseg3652 | 9143 |
| 7 | 155613850 | 155615100 | 20356629 | 20356895 | d7Mseg3653 | 9144 |
| 7 | 155693500 | 155698350 | 20280719 | 20285258 | d7Mseg3654 | 9145 |
| 7 | 155714000 | 155715350 | 20260528 | 20261193 | d7Mseg3655 | 9146 |
| 7 | 155782900 | 155784550 | 20186390 | 20188004 | d7Mseg3656 | 9147 |
| 7 | 155805900 | 155807750 | 20162824 | 20168308 | d7Mseg3657 | 9148 |
| 7 | 155851050 | 155854450 | 20133359 | 20135681 | d7Mseg3660 | 9149 |
| 7 | 155863500 | 155866700 | 20116365 | 20116820 | d7Mseg3661 | 9150 |
| 7 | 155970350 | 155971650 | 20008177 | 20009478 | d7Mseg3665 | 9151 |
| 7 | 156030450 | 156031650 | 19933930 | 19934962 | d7Mseg3666 | 9152 |
| 7 | 156065150 | 156067100 | 19903898 | 19905882 | d7Mseg3667 | 9153 |
| 7 | 156082200 | 156083700 | 19886421 | 19887967 | d7Mseg3668 | 9154 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 156163900 | 156165350 | 19799037 | 19800050 | d7Mseg3669 | 9155 |
| 7 | 156202700 | 156204100 | 19762439 | 19763702 | d7Mseg3670 | 9156 |
| 7 | 156208000 | 156209950 | 19756581 | 19757848 | d7Mseg3671 | 9157 |
| 7 | 156223400 | 156225250 | 19741414 | 19742908 | d7Mseg3672 | 9158 |
| 7 | 156248200 | 156250000 | 19718352 | 19720075 | d7Mseg3673 | 9159 |
| 7 | 156264500 | 156266000 | 19702474 | 19703946 | d7Mseg3674 | 9160 |
| 7 | 156272650 | 156274300 | 19692640 | 19694087 | d7Mseg3675 | 9161 |
| 7 | 156327600 | 156329350 | 19635805 | 19638252 | d7Mseg3676 | 9162 |
| 7 | 156336700 | 156337750 | 19628440 | 19630205 | d7Mseg3677 | 9163 |
| 7 | 156353000 | 156354750 | 19610530 | 19612194 | d7Mseg3678 | 9164 |
| 7 | 156370950 | 156372450 | 19591353 | 19592414 | d7Mseg3679 | 9165 |
| 7 | 156396800 | 156398550 | 19565692 | 19567526 | d7Mseg3680 | 9166 |
| 7 | 156410850 | 156413050 | 19552602 | 19554763 | d7Mseg3681 | 9167 |
| 7 | 156421000 | 156428900 | 19530521 | 19539789 | d7Mseg3682 | 9168 |
| 7 | 156438500 | 156439650 | 19507194 | 19509568 | d7Mseg3683 | 9169 |
| 7 | 156516300 | 156518000 | 19433220 | 19442283 | d7Mseg3684 | 9170 |
| 7 | 156520400 | 156521950 | 19427941 | 19428602 | d7Mseg3685 | 9171 |
| 7 | 156573550 | 156576200 | 19362199 | 19364908 | d7Mseg3686 | 9172 |
| 7 | 156577950 | 156579850 | 19358186 | 19359792 | d7Mseg3687 | 9173 |
| 7 | 156637700 | 156639100 | 19318361 | 19318925 | d7Mseg3691 | 9174 |
| 7 | 156677050 | 156678350 | 19269741 | 19270971 | d7Mseg3692 | 9175 |
| 7 | 156693250 | 156694750 | 19255838 | 19256631 | d7Mseg3693 | 9176 |
| 7 | 156747750 | 156749200 | 19220733 | 19221544 | d7Mseg3694 | 9177 |
| 7 | 156751200 | 156754650 | 19217027 | 19217480 | d7Mseg3695 | 9178 |
| 7 | 156781350 | 156782900 | 19187590 | 19189211 | d7Mseg3696 | 9179 |
| 7 | 156793500 | 156795350 | 19180256 | 19181871 | d7Mseg3697 | 9180 |
| 7 | 156808400 | 156809400 | 19170885 | 19171807 | d7Mseg3698 | 9181 |
| 7 | 156819150 | 156824150 | 19144922 | 19151607 | d7Mseg3699 | 9182 |
| 7 | 156827050 | 156832350 | 19136810 | 19142338 | d7Mseg3700 | 9183 |
| 7 | 156847650 | 156850300 | 19119895 | 19122036 | d7Mseg3701 | 9184 |
| 7 | 156869500 | 156873650 | 19093266 | 19099449 | d7Mseg3702 | 9185 |
| 7 | 156885300 | 156886650 | 19074354 | 19074877 | d7Mseg3703 | 9186 |
| 7 | 156907450 | 156909250 | 19042535 | 19045689 | d7Mseg3704 | 9187 |
| 7 | 156924600 | 156925850 | 19017828 | 19019661 | d7Mseg3705 | 9188 |
| 7 | 156938150 | 156941850 | 19001009 | 19005346 | d7Mseg3706 | 9189 |
| 7 | 157034600 | 157036250 | 18906777 | 18908444 | d7Mseg3707 | 9190 |
| 7 | 157037950 | 157039650 | 18902896 | 18904851 | d7Mseg3708 | 9191 |
| 7 | 157075300 | 157077100 | 18807052 | 18818223 | d7Mseg3710 | 9192 |
| 7 | 157087900 | 157089000 | 18792722 | 18793330 | d7Mseg3711 | 9193 |
| 7 | 157136950 | 157138600 | 18740075 | 18740711 | d7Mseg3712 | 9194 |
| 7 | 157145700 | 157147100 | 18731761 | 18732705 | d7Mseg3713 | 9195 |
| 7 | 157172950 | 157174650 | 18717474 | 18718966 | d7Mseg3714 | 9196 |
| 7 | 157184600 | 157186450 | 18712330 | 18712944 | d7Mseg3715 | 9197 |
| 7 | 157193050 | 157194550 | 18704292 | 18706464 | d7Mseg3716 | 9198 |
| 7 | 157230350 | 157232000 | 18660553 | 18662100 | d7Mseg3717 | 9199 |
| 7 | 157241500 | 157242700 | 18650360 | 18651565 | d7Mseg3718 | 9200 |
| 7 | 157253100 | 157254750 | 18638158 | 18639878 | d7Mseg3719 | 9201 |
| 7 | 157268300 | 157269800 | 18624941 | 18626585 | d7Mseg3720 | 9202 |
| 7 | 157322300 | 157326650 | 18570053 | 18571290 | d7Mseg3722 | 9203 |
| 7 | 157337000 | 157338950 | 18555617 | 18555869 | d7Mseg3723 | 9204 |
| 7 | 157347250 | 157349350 | 18539273 | 18541551 | d7Mseg3724 | 9205 |
| 7 | 157360000 | 157361300 | 18530849 | 18531087 | d7Mseg3725 | 9206 |
| 7 | 157372600 | 157374450 | 18513158 | 18515812 | d7Mseg3726 | 9207 |
| 7 | 157378250 | 157380550 | 18508174 | 18509568 | d7Mseg3727 | 9208 |
| 7 | 157416900 | 157418500 | 18455960 | 18457412 | d7Mseg3728 | 9209 |
| 7 | 157431550 | 157434400 | 18441880 | 18444759 | d7Mseg3729 | 9210 |
| 7 | 157600100 | 157601850 | 18371731 | 18373454 | d7Mseg3737 | 9211 |
| 7 | 157806950 | 157810800 | 18162013 | 18162693 | d7Mseg3743 | 9212 |
| 7 | 157813300 | 157814500 | 18165052 | 18166634 | d7Mseg3744 | 9213 |
| 7 | 157884400 | 157886300 | 18129247 | 18129866 | d7Mseg3745 | 9214 |
| 7 | 157894250 | 157896750 | 18107141 | 18108043 | d7Mseg3746 | 9215 |
| 7 | 157909600 | 157910800 | 18093365 | 18094482 | d7Mseg3747 | 9216 |
| 7 | 157934300 | 157936200 | 18061687 | 18065612 | d7Mseg3748 | 9217 |
| 7 | 157942500 | 157944100 | 18056166 | 18058138 | d7Mseg3749 | 9218 |
| 7 | 157956150 | 157957800 | 18041407 | 18043092 | d7Mseg3750 | 9219 |
| 7 | 157966900 | 157968850 | 18030549 | 18031571 | d7Mseg3751 | 9220 |
| 7 | 157972950 | 157974750 | 18023228 | 18026100 | d7Mseg3752 | 9221 |
| 7 | 157989950 | 157991700 | 18016193 | 18018966 | d7Mseg3753 | 9222 |
| 7 | 158022100 | 158023900 | 17984861 | 17986656 | d7Mseg3754 | 9223 |
| 7 | 158032000 | 158034200 | 17976679 | 17978311 | d7Mseg3755 | 9224 |
| 7 | 158048750 | 158049900 | 17964595 | 17965716 | d7Mseg3756 | 9225 |
| 7 | 158099500 | 158100700 | 17914594 | 17915912 | d7Mseg3758 | 9226 |
| 7 | 158123700 | 158125400 | 17899971 | 17901823 | d7Mseg3760 | 9227 |
| 7 | 158131800 | 158132850 | 17893090 | 17893977 | d7Mseg3761 | 9228 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 158152800 | 158159150 | 17875193 | 17881545 | d7Mseg3762 | 9229 |
| 7 | 158160800 | 158165450 | 17869197 | 17873683 | d7Mseg3763 | 9230 |
| 7 | 158167500 | 158169750 | 17864739 | 17867567 | d7Mseg3764 | 9231 |
| 7 | 158171950 | 158175900 | 17858359 | 17862317 | d7Mseg3765 | 9232 |
| 7 | 158177800 | 158180200 | 17854021 | 17856909 | d7Mseg3766 | 9233 |
| 7 | 158187400 | 158189050 | 17845470 | 17847194 | d7Mseg3767 | 9234 |
| 7 | 158222800 | 158224650 | 17810797 | 17812620 | d7Mseg3768 | 9235 |
| 7 | 158227850 | 158231800 | 17805582 | 17807246 | d7Mseg3769 | 9236 |
| 7 | 158256150 | 158257750 | 17768522 | 17769580 | d7Mseg3772 | 9237 |
| 7 | 158266150 | 158267200 | 17760642 | 17761760 | d7Mseg3774 | 9238 |
| 7 | 158273150 | 158274350 | 17750984 | 17752196 | d7Mseg3775 | 9239 |
| 7 | 158281350 | 158282950 | 17741640 | 17743260 | d7Mseg3776 | 9240 |
| 7 | 158300000 | 158301200 | 17720045 | 17721921 | d7Mseg3777 | 9241 |
| 7 | 158307850 | 158309600 | 17710389 | 17711788 | d7Mseg3778 | 9242 |
| 7 | 158311950 | 158313050 | 17706139 | 17708100 | d7Mseg3779 | 9243 |
| 7 | 158332650 | 158333750 | 17686846 | 17687985 | d7Mseg3780 | 9244 |
| 7 | 158344900 | 158348950 | 17671633 | 17675749 | d7Mseg3781 | 9245 |
| 7 | 158354100 | 158356150 | 17662194 | 17666106 | d7Mseg3782 | 9246 |
| 7 | 158362350 | 158363600 | 17654308 | 17655578 | d7Mseg3783 | 9247 |
| 7 | 158366400 | 158367900 | 17647756 | 17651988 | d7Mseg3784 | 9248 |
| 7 | 158369900 | 158371600 | 17645250 | 17646047 | d7Mseg3785 | 9249 |
| 7 | 158372700 | 158374350 | 17641646 | 17642872 | d7Mseg3786 | 9250 |
| 7 | 158385000 | 158386450 | 17628573 | 17629690 | d7Mseg3787 | 9251 |
| 7 | 158400450 | 158402400 | 17612859 | 17614865 | d7Mseg3788 | 9252 |
| 7 | 158407100 | 158408950 | 17605732 | 17608201 | d7Mseg3789 | 9253 |
| 7 | 158411850 | 158413350 | 17600863 | 17602280 | d7Mseg3790 | 9254 |
| 7 | 158436300 | 158437750 | 17566158 | 17566874 | d7Mseg3791 | 9255 |
| 7 | 158439500 | 158441000 | 17563937 | 17564728 | d7Mseg3792 | 9256 |
| 7 | 158447000 | 158448350 | 17555628 | 17557193 | d7Mseg3793 | 9257 |
| 7 | 158452300 | 158453850 | 17549904 | 17551190 | d7Mseg3794 | 9258 |
| 7 | 158456400 | 158457750 | 17546584 | 17547101 | d7Mseg3795 | 9259 |
| 7 | 158467350 | 158468800 | 17536301 | 17537187 | d7Mseg3796 | 9260 |
| 7 | 158477750 | 158480550 | 17523733 | 17526556 | d7Mseg3797 | 9261 |
| 7 | 158512350 | 158514350 | 17486485 | 17488684 | d7Mseg3798 | 9262 |
| 7 | 158516450 | 158518100 | 17483117 | 17484456 | d7Mseg3799 | 9263 |
| 7 | 158544800 | 158545800 | 17448946 | 17450054 | d7Mseg3800 | 9264 |
| 7 | 158580050 | 158582050 | 17409254 | 17413200 | d7Mseg3801 | 9265 |
| 7 | 158594350 | 158598550 | 17392706 | 17396719 | d7Mseg3802 | 9266 |
| 7 | 158604100 | 158605600 | 17387098 | 17388655 | d7Mseg3803 | 9267 |
| 7 | 158655250 | 158657000 | 17348116 | 17349522 | d7Mseg3804 | 9268 |
| 7 | 158672700 | 158674300 | 17313280 | 17314399 | d7Mseg3805 | 9269 |
| 7 | 158703700 | 158705450 | 17270576 | 17271638 | d7Mseg3806 | 9270 |
| 7 | 158716500 | 158718050 | 17260053 | 17261508 | d7Mseg3807 | 9271 |
| 7 | 158763350 | 158764950 | 17217788 | 17218072 | d7Mseg3808 | 9272 |
| 7 | 158848300 | 158850200 | 17171100 | 17171878 | d7Mseg3810 | 9273 |
| 7 | 158959750 | 158961000 | 17070410 | 17071287 | d7Mseg3812 | 9274 |
| 7 | 158965750 | 158967350 | 17061835 | 17062371 | d7Mseg3813 | 9275 |
| 7 | 159005900 | 159007700 | 17020930 | 17022484 | d7Mseg3814 | 9276 |
| 7 | 159070450 | 159074800 | 16972503 | 16975038 | d7Mseg3816 | 9277 |
| 7 | 159081150 | 159082600 | 16963951 | 16965309 | d7Mseg3817 | 9278 |
| 7 | 159087800 | 159089350 | 16943710 | 16945316 | d7Mseg3818 | 9279 |
| 7 | 159090800 | 159092150 | 16942409 | 16942570 | d7Mseg3819 | 9280 |
| 7 | 159140650 | 159142400 | 16925579 | 16926170 | d7Mseg3821 | 9281 |
| 7 | 159196600 | 159198200 | 16888587 | 16890265 | d7Mseg3822 | 9282 |
| 7 | 159320700 | 159322150 | 16753321 | 16754269 | d7Mseg3823 | 9283 |
| 7 | 159325300 | 159326500 | 16737653 | 16738512 | d7Mseg3824 | 9284 |
| 7 | 159393400 | 159395300 | 16677446 | 16677747 | d7Mseg3828 | 9285 |
| 7 | 159465400 | 159467200 | 16609389 | 16609668 | d7Mseg3829 | 9286 |
| 7 | 159565600 | 159566750 | 16508485 | 16510219 | d7Mseg3830 | 9287 |
| 7 | 159568750 | 159570400 | 16502395 | 16502963 | d7Mseg3831 | 9288 |
| 7 | 159598350 | 159600400 | 16475880 | 16477721 | d7Mseg3832 | 9289 |
| 7 | 159629200 | 159630950 | 16449924 | 16451704 | d7Mseg3833 | 9290 |
| 7 | 159733200 | 159735050 | 16255454 | 16257479 | d7Mseg3836 | 9291 |
| 7 | 159767900 | 159769500 | 16307082 | 16308258 | d7Mseg3837 | 9292 |
| 7 | 159825000 | 159826750 | 16333884 | 16334119 | d7Mseg3838 | 9293 |
| 7 | 159856000 | 159857200 | 16231566 | 16232313 | d7Mseg3839 | 9294 |
| 7 | 159858700 | 159860300 | 16228672 | 16229883 | d7Mseg3840 | 9295 |
| 7 | 159862700 | 159864150 | 16226766 | 16227212 | d7Mseg3841 | 9296 |
| 7 | 159889050 | 159890850 | 16204511 | 16205766 | d7Mseg3842 | 9297 |
| 7 | 159950050 | 159952000 | 16171612 | 16173876 | d7Mseg3844 | 9298 |
| 7 | 160039650 | 160041300 | 16105055 | 16105359 | d7Mseg3845 | 9299 |
| 7 | 160050550 | 160052250 | 16099494 | 16100037 | d7Mseg3846 | 9300 |
| 7 | 160053700 | 160055250 | 16097410 | 16098623 | d7Mseg3847 | 9301 |
| 7 | 160074850 | 160076800 | 16079614 | 16081468 | d7Mseg3848 | 9302 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 160110900 | 160114550 | 16032227 | 16034284 | d7Mseg3849 | 9303 |
| 7 | 160125150 | 160126700 | 16020782 | 16022269 | d7Mseg3850 | 9304 |
| 7 | 160165300 | 160167050 | 16004352 | 16005544 | d7Mseg3854 | 9305 |
| 7 | 160175500 | 160179400 | 15998005 | 15999524 | d7Mseg3855 | 9306 |
| 7 | 160185900 | 160187550 | 15993783 | 15994666 | d7Mseg3856 | 9307 |
| 7 | 160242850 | 160244600 | 15960716 | 15961007 | d7Mseg3859 | 9308 |
| 7 | 160305750 | 160307450 | 15913061 | 15921504 | d7Mseg3860 | 9309 |
| 7 | 160319550 | 160320550 | 15903185 | 15904160 | d7Mseg3861 | 9310 |
| 7 | 160345250 | 160347350 | 15872654 | 15874787 | d7Mseg3862 | 9311 |
| 7 | 160365350 | 160367100 | 15848626 | 15850288 | d7Mseg3863 | 9312 |
| 7 | 160371650 | 160373050 | 15842639 | 15843879 | d7Mseg3864 | 9313 |
| 7 | 160394650 | 160396700 | 15808198 | 15811430 | d7Mseg3865 | 9314 |
| 7 | 160425400 | 160427050 | 15793002 | 15794628 | d7Mseg3866 | 9315 |
| 7 | 160465750 | 160467450 | 15755251 | 15756599 | d7Mseg3869 | 9316 |
| 7 | 160525750 | 160528700 | 15682438 | 15686472 | d7Mseg3871 | 9317 |
| 7 | 160536350 | 160538050 | 15671976 | 15672622 | d7Mseg3872 | 9318 |
| 7 | 160539750 | 160541200 | 15663972 | 15665034 | d7Mseg3873 | 9319 |
| 7 | 160562550 | 160564000 | 15635171 | 15637203 | d7Mseg3874 | 9320 |
| 7 | 160568700 | 160570700 | 15629434 | 15630996 | d7Mseg3875 | 9321 |
| 7 | 160591850 | 160593500 | 15610568 | 15612173 | d7Mseg3876 | 9322 |
| 7 | 160594900 | 160596700 | 15609012 | 15610231 | d7Mseg3877 | 9323 |
| 7 | 160609450 | 160610700 | 15593687 | 15594447 | d7Mseg3878 | 9324 |
| 7 | 160633550 | 160635350 | 15567581 | 15569062 | d7Mseg3879 | 9325 |
| 7 | 160665900 | 160667150 | 15546868 | 15547017 | d7Mseg3880 | 9326 |
| 7 | 160670400 | 160671400 | 15543003 | 15543166 | d7Mseg3881 | 9327 |
| 7 | 160681600 | 160683750 | 15530072 | 15533635 | d7Mseg3882 | 9328 |
| 7 | 160690250 | 160691800 | 15521928 | 15523039 | d7Mseg3883 | 9329 |
| 7 | 160731250 | 160732850 | 15478841 | 15480483 | d7Mseg3885 | 9330 |
| 7 | 160734400 | 160736800 | 15475688 | 15477656 | d7Mseg3886 | 9331 |
| 7 | 160751900 | 160753550 | 15457599 | 15463065 | d7Mseg3887 | 9332 |
| 7 | 160796900 | 160798850 | 15413668 | 15415549 | d7Mseg3889 | 9333 |
| 7 | 160806950 | 160808700 | 15406916 | 15408400 | d7Mseg3890 | 9334 |
| 7 | 160816950 | 160818100 | 15395182 | 15396967 | d7Mseg3891 | 9335 |
| 7 | 160884250 | 160886000 | 15319533 | 15320260 | d7Mseg3893 | 9336 |
| 7 | 160902900 | 160904000 | 62518794 | 62519151 | d7Mseg3894 | 9337 |
| 7 | 160943300 | 160948650 | 15281443 | 15289262 | d7Mseg3896 | 9338 |
| 7 | 160972350 | 160974000 | 15266541 | 15267669 | d7Mseg3898 | 9339 |
| 7 | 161075700 | 161076800 | 15187715 | 15188700 | d7Mseg3900 | 9340 |
| 7 | 161079700 | 161081400 | 15183461 | 15185574 | d7Mseg3901 | 9341 |
| 7 | 161236300 | 161238000 | 15088564 | 15089476 | d7Mseg3905 | 9342 |
| 7 | 161245750 | 161247500 | 15078794 | 15079222 | d7Mseg3906 | 9343 |
| 7 | 161281500 | 161282700 | 15045434 | 15050767 | d7Mseg3907 | 9344 |
| 7 | 161305050 | 161306250 | 15018950 | 15019189 | d7Mseg3908 | 9345 |
| 7 | 161380050 | 161381550 | 14934263 | 14935279 | d7Mseg3910 | 9346 |
| 7 | 161389200 | 161391000 | 14923116 | 14927495 | d7Mseg3911 | 9347 |
| 7 | 161489500 | 161491200 | 14817931 | 14819938 | d7Mseg3913 | 9348 |
| 7 | 161498000 | 161499650 | 14804662 | 14805869 | d7Mseg3914 | 9349 |
| 7 | 161554350 | 161555950 | 14763241 | 14764225 | d7Mseg3916 | 9350 |
| 7 | 161558450 | 161560200 | 14760841 | 14761695 | d7Mseg3917 | 9351 |
| 7 | 161623450 | 161624550 | 14700545 | 14707141 | d7Mseg3918 | 9352 |
| 7 | 161637200 | 161638600 | 14682156 | 14683516 | d7Mseg3919 | 9353 |
| 7 | 161661000 | 161664500 | 14662936 | 14665723 | d7Mseg3920 | 9354 |
| 7 | 161723200 | 161724950 | 14595902 | 14597908 | d7Mseg3921 | 9355 |
| 7 | 161742950 | 161746350 | 14565249 | 14569346 | d7Mseg3922 | 9356 |
| 7 | 161757400 | 161758600 | 14553216 | 14554433 | d7Mseg3923 | 9357 |
| 7 | 161772150 | 161773650 | 14537330 | 14539003 | d7Mseg3924 | 9358 |
| 7 | 162318400 | 162319800 | 14247638 | 14249710 | d7Mseg3928 | 9359 |
| 7 | 162490200 | 162491350 | 14117238 | 14117556 | d7Mseg3930 | 9360 |
| 7 | 162545650 | 162549900 | 14087147 | 14090777 | d7Mseg3932 | 9361 |
| 7 | 162571800 | 162575750 | 14078089 | 14078585 | d7Mseg3933 | 9362 |
| 7 | 162580250 | 162581750 | 14074400 | 14075622 | d7Mseg3934 | 9363 |
| 7 | 162649100 | 162650850 | 13989303 | 13989948 | d7Mseg3935 | 9364 |
| 7 | 162655350 | 162657350 | 13983977 | 13985610 | d7Mseg3936 | 9365 |
| 7 | 162673400 | 162679400 | 13954346 | 13967216 | d7Mseg3937 | 9366 |
| 7 | 162688100 | 162689800 | 13945319 | 13946151 | d7Mseg3938 | 9367 |
| 7 | 162694500 | 162695500 | 13938023 | 13939350 | d7Mseg3939 | 9368 |
| 7 | 162711350 | 162712750 | 13920659 | 13921757 | d7Mseg3940 | 9369 |
| 7 | 162715450 | 162716700 | 13917589 | 13918237 | d7Mseg3941 | 9370 |
| 7 | 162774350 | 162775450 | 13844855 | 13845263 | d7Mseg3942 | 9371 |
| 7 | 162783300 | 162785150 | 13832733 | 13834670 | d7Mseg3943 | 9372 |
| 7 | 162792050 | 162793750 | 13824572 | 13825325 | d7Mseg3944 | 9373 |
| 7 | 162794950 | 162796100 | 13822721 | 13823685 | d7Mseg3945 | 9374 |
| 7 | 162809550 | 162812800 | 13802456 | 13805049 | d7Mseg3946 | 9375 |
| 7 | 162869100 | 162870900 | 13756425 | 13757988 | d7Mseg3947 | 9376 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| 7 | 162877500 | 162879500 | 13750750 | 13753578 | d7Mseg3948 | 9377 |
| 7 | 162910650 | 162912350 | 13712690 | 13714036 | d7Mseg3949 | 9378 |
| 7 | 162925100 | 162926700 | 13694633 | 13695493 | d7Mseg3950 | 9379 |
| 7 | 162946950 | 162949350 | 13670688 | 13672284 | d7Mseg3951 | 9380 |
| 7 | 162955150 | 162956850 | 13665773 | 13666890 | d7Mseg3952 | 9381 |
| 7 | 162971200 | 162972350 | 13640589 | 13641010 | d7Mseg3953 | 9382 |
| 7 | 162993600 | 162995100 | 13618014 | 13618305 | d7Mseg3954 | 9383 |
| 7 | 163015600 | 163017100 | 13595709 | 13598183 | d7Mseg3955 | 9384 |
| 7 | 163022500 | 163026200 | 13585343 | 13588986 | d7Mseg3956 | 9385 |
| 7 | 163112100 | 163113100 | 13490965 | 13491333 | d7Mseg3957 | 9386 |
| 7 | 163115700 | 163116750 | 13488562 | 13489141 | d7Mseg3958 | 9387 |
| 7 | 163140600 | 163142350 | 13472970 | 13473661 | d7Mseg3959 | 9388 |
| 7 | 163197000 | 163198800 | 13419794 | 13421210 | d7Mseg3961 | 9389 |
| 7 | 163213850 | 163215350 | 13401755 | 13402474 | d7Mseg3962 | 9390 |
| 7 | 163232900 | 163234750 | 13383176 | 13385440 | d7Mseg3963 | 9391 |
| 7 | 163290550 | 163292150 | 13351902 | 13352109 | d7Mseg3964 | 9392 |
| 7 | 163329150 | 163330950 | 13307690 | 13307949 | d7Mseg3965 | 9393 |
| 7 | 163440450 | 163442000 | 13217591 | 13217945 | d7Mseg3966 | 9394 |
| 7 | 163448550 | 163450150 | 13208901 | 13211039 | d7Mseg3967 | 9395 |
| 7 | 163510900 | 163512850 | 13138849 | 13139323 | d7Mseg3968 | 9396 |
| 7 | 163538850 | 163540800 | 13110200 | 13111787 | d7Mseg3969 | 9397 |
| 7 | 163570500 | 163571850 | 13077748 | 13078839 | d7Mseg3970 | 9398 |
| 7 | 163576150 | 163577500 | 13069780 | 13070648 | d7Mseg3971 | 9399 |
| 7 | 163595000 | 163597000 | 13043120 | 13044105 | d7Mseg3972 | 9400 |
| 7 | 163635100 | 163636800 | 13002804 | 13004920 | d7Mseg3973 | 9401 |
| 7 | 163645250 | 163648400 | 12991834 | 12995106 | d7Mseg3974 | 9402 |
| 7 | 163650850 | 163652250 | 12988549 | 12989008 | d7Mseg3975 | 9403 |
| 7 | 163712250 | 163714450 | 12920512 | 12921530 | d7Mseg3976 | 9404 |
| 7 | 163790500 | 163791850 | 12836869 | 12837610 | d7Mseg3978 | 9405 |
| 7 | 163810250 | 163812250 | 12817303 | 12818970 | d7Mseg3979 | 9406 |
| 7 | 163818250 | 163825700 | 12804545 | 12811333 | d7Mseg3980 | 9407 |
| 7 | 163851150 | 163852900 | 12778335 | 12778683 | d7Mseg3981 | 9408 |
| 7 | 163855300 | 163856800 | 12773739 | 12775482 | d7Mseg3982 | 9409 |
| 7 | 163967950 | 163969150 | 12687052 | 12687310 | d7Mseg3984 | 9410 |
| 7 | 163977000 | 163978450 | 12677461 | 12677754 | d7Mseg3985 | 9411 |
| 7 | 163990500 | 163992150 | 12666294 | 12667710 | d7Mseg3986 | 9412 |
| 7 | 164044800 | 164046750 | 12629193 | 12630773 | d7Mseg3987 | 9413 |
| 7 | 164067000 | 164069100 | 12617812 | 12618660 | d7Mseg3988 | 9414 |
| 7 | 164072300 | 164075250 | 12614831 | 12615812 | d7Mseg3989 | 9415 |
| 7 | 164078000 | 164080000 | 12610568 | 12611868 | d7Mseg3990 | 9416 |
| 7 | 164090100 | 164091950 | 12597023 | 12598120 | d7Mseg3991 | 9417 |
| 7 | 164133650 | 164136100 | 12567467 | 12569464 | d7Mseg3992 | 9418 |
| 7 | 164164450 | 164166400 | 12517492 | 12518769 | d7Mseg3993 | 9419 |
| 7 | 164168350 | 164169400 | 12514816 | 12515872 | d7Mseg3994 | 9420 |
| 7 | 164211300 | 164212350 | 12470607 | 12471694 | d7Mseg3996 | 9421 |
| 7 | 164221200 | 164223700 | 12461865 | 12464316 | d7Mseg3998 | 9422 |
| 7 | 164225050 | 164226650 | 12459042 | 12460360 | d7Mseg3999 | 9423 |
| 7 | 164253550 | 164255000 | 12428520 | 12429933 | d7Mseg4000 | 9424 |
| 7 | 164299600 | 164301550 | 12390305 | 12391689 | d7Mseg4001 | 9425 |
| 7 | 164317450 | 164319850 | 12378648 | 12380082 | d7Mseg4002 | 9426 |
| 7 | 164330500 | 164332050 | 12362525 | 12364290 | d7Mseg4003 | 9427 |
| 7 | 164346750 | 164348000 | 12346699 | 12348304 | d7Mseg4004 | 9428 |
| 7 | 164354200 | 164355800 | 12340287 | 12341588 | d7Mseg4005 | 9429 |
| 7 | 164434950 | 164436800 | 12272025 | 12272718 | d7Mseg4006 | 9430 |
| 7 | 164447950 | 164449550 | 12260594 | 12262785 | d7Mseg4008 | 9431 |
| 7 | 164513100 | 164515200 | 12202605 | 12204549 | d7Mseg4009 | 9432 |
| 7 | 164552550 | 164554400 | 12162347 | 12163817 | d7Mseg4011 | 9433 |
| 7 | 164557250 | 164563100 | 12154660 | 12160662 | d7Mseg4012 | 9434 |
| 7 | 164635150 | 164636800 | 12097633 | 12098895 | d7Mseg4014 | 9435 |
| 7 | 164672800 | 164674200 | 12075323 | 12075826 | d7Mseg4016 | 9436 |
| 7 | 164714850 | 164717700 | 12034565 | 12038500 | d7Mseg4017 | 9437 |
| 7 | 164750200 | 164752150 | 12007922 | 12009274 | d7Mseg4018 | 9438 |
| 7 | 164758500 | 164760150 | 11996895 | 11998040 | d7Mseg4019 | 9439 |
| 7 | 164771200 | 164772450 | 11984879 | 11986032 | d7Mseg4020 | 9440 |
| 7 | 164777150 | 164778600 | 11977102 | 11978777 | d7Mseg4021 | 9441 |
| 7 | 164997350 | 165002300 | 11848071 | 11849766 | d7Mseg4025 | 9442 |
| 7 | 165006750 | 165008550 | 11843708 | 11845086 | d7Mseg4026 | 9443 |
| 7 | 165152700 | 165154600 | 11744793 | 11746727 | d7Mseg4029 | 9444 |
| 7 | 165161850 | 165163800 | 11736502 | 11738345 | d7Mseg4030 | 9445 |
| 7 | 165188800 | 165190500 | 11716811 | 11717463 | d7Mseg4031 | 9446 |
| 7 | 165210250 | 165211550 | 11705495 | 11706467 | d7Mseg4032 | 9447 |
| 7 | 165215800 | 165217400 | 11695662 | 11697464 | d7Mseg4033 | 9448 |
| 7 | 165221800 | 165224100 | 11689558 | 11691909 | d7Mseg4034 | 9449 |
| 7 | 165227600 | 165228750 | 11686051 | 11686880 | d7Mseg4035 | 9450 |

TABLE IVB-continued

Mouse Binding Sites with Human Liftovers

| Cell/ Day | Mouse Start | Mouse end | Human start | Human end | Segment name | SEQ ID NO: |
|---|---|---|---|---|---|---|
| 7 | 165232150 | 165237050 | 11680029 | 11685033 | d7Mseg4036 | 9451 |
| 7 | 165258400 | 165259750 | 11654579 | 11655709 | d7Mseg4037 | 9452 |
| 7 | 165300150 | 165301800 | 11623649 | 11624667 | d7Mseg4039 | 9453 |
| 7 | 165310300 | 165312200 | 11611236 | 11613127 | d7Mseg4040 | 9454 |
| 7 | 165330300 | 165331950 | 11587603 | 11588494 | d7Mseg4041 | 9455 |
| 7 | 165382350 | 165384050 | 11532746 | 11534360 | d7Mseg4042 | 9456 |
| 7 | 165394000 | 165395650 | 11517684 | 11518499 | d7Mseg4043 | 9457 |
| 7 | 165410700 | 165412600 | 11506593 | 11509034 | d7Mseg4044 | 9458 |
| 7 | 165460500 | 165462450 | 11456195 | 11457315 | d7Mseg4045 | 9459 |
| 7 | 165473150 | 165476600 | 11443827 | 11447248 | d7Mseg4046 | 9460 |
| 7 | 165555900 | 165557500 | 11363246 | 11365143 | d7Mseg4047 | 9461 |
| 7 | 165630250 | 165631250 | 11306984 | 11307601 | d7Mseg4048 | 9462 |
| 7 | 165635950 | 165637850 | 11298533 | 11299503 | d7Mseg4049 | 9463 |
| 7 | 165677150 | 165679000 | 11210925 | 11212213 | d7Mseg4050 | 9464 |
| 7 | 165720100 | 165721450 | 11173030 | 11174543 | d7Mseg4051 | 9465 |
| 7 | 165731800 | 165733450 | 11166321 | 11168458 | d7Mseg4052 | 9466 |
| 7 | 165791050 | 165792400 | 11102656 | 11104386 | d7Mseg4055 | 9467 |
| 7 | 165891050 | 165892850 | 11028156 | 11029924 | d7Mseg4058 | 9468 |
| 7 | 165904200 | 165905700 | 11010938 | 11012447 | d7Mseg4060 | 9469 |
| 7 | 165994900 | 165996350 | 10951348 | 10951854 | d7Mseg4062 | 9470 |
| 7 | 166121700 | 166123350 | 10851640 | 10853211 | d7Mseg4064 | 9471 |
| 7 | 166129550 | 166131300 | 10837425 | 10839146 | d7Mseg4065 | 9472 |
| 7 | 166170450 | 166174000 | 10737875 | 10791476 | d7Mseg4066 | 9473 |
| 7 | 166220100 | 166221350 | 10705777 | 10705972 | d7Mseg4067 | 9474 |
| 7 | 166280950 | 166282450 | 10628207 | 10630024 | d7Mseg4068 | 9475 |
| 7 | 166317350 | 166319550 | 10586688 | 10588813 | d7Mseg4069 | 9476 |
| 7 | 166340200 | 166341750 | 10564244 | 10566188 | d7Mseg4070 | 9477 |
| 7 | 166401250 | 166402300 | 10493356 | 10494554 | d7Mseg4071 | 9478 |
| 7 | 166404250 | 166406600 | 10488260 | 10491055 | d7Mseg4072 | 9479 |
| 7 | 166409850 | 166412250 | 10483386 | 10485756 | d7Mseg4073 | 9480 |
| 7 | 166415700 | 166417350 | 10460030 | 10461598 | d7Mseg4074 | 9481 |
| 7 | 166421500 | 166423550 | 10437413 | 10443204 | d7Mseg4075 | 9482 |
| M | 5748350 | 5749350 | 51076415 | 51076838 | MMseg11 | 9483 |
| M | 6151800 | 6153600 | 50387471 | 50389367 | MMseg13 | 9484 |
| M | 6251450 | 6253100 | 50297516 | 50298857 | MMseg14 | 9485 |
| M | 6354150 | 6359200 | 50210609 | 50215118 | MMseg15 | 9486 |
| M | 6444600 | 6445900 | 50174373 | 50175731 | MMseg16 | 9487 |
| M | 6451700 | 6453400 | 50164201 | 50166211 | MMseg17 | 9488 |
| M | 6645900 | 6647150 | 49964146 | 49964441 | MMseg20 | 9489 |
| M | 6871600 | 6873400 | 49721136 | 49722419 | MMseg21 | 9490 |
| M | 6895150 | 6896750 | 49686843 | 49688480 | MMseg22 | 9491 |
| M | 6963850 | 6965200 | 49628587 | 49629075 | MMseg23 | 9492 |
| M | 7182750 | 7184300 | 49089742 | 49091735 | MMseg26 | 9493 |
| M | 7216850 | 7218700 | 49053893 | 49055605 | MMseg27 | 9494 |
| M | 7307150 | 7308550 | 48927622 | 48930003 | MMseg28 | 9495 |
| M | 7365450 | 7366900 | 48858892 | 48860456 | MMseg29 | 9496 |
| M | 7498350 | 7500750 | 48689020 | 48692360 | MMseg30 | 9497 |
| M | 7752000 | 7753650 | 48397691 | 48399229 | MMseg32 | 9498 |
| M | 7766550 | 7767650 | 48381991 | 48382586 | MMseg33 | 9499 |
| M | 9012500 | 9013500 | 37672040 | 37673140 | MMseg36 | 9500 |
| M | 9365300 | 9367150 | 37800545 | 37802015 | MMseg39 | 9501 |
| M | 9740000 | 9741000 | 38132920 | 38133612 | MMseg41 | 9502 |
| M | 9762250 | 9763600 | 38152546 | 38154871 | MMseg42 | 9503 |
| M | 9815700 | 9817000 | 38200888 | 38202758 | MMseg43 | 9504 |
| M | 9943300 | 9944700 | 38315122 | 38315456 | MMseg44 | 9505 |
| M | 10221200 | 10222600 | 38606653 | 38607440 | MMseg45 | 9506 |
| M | 10251500 | 10253050 | 38626548 | 38627586 | MMseg46 | 9507 |
| M | 10486550 | 10487700 | 38875963 | 38877219 | MMseg47 | 9508 |
| M | 10751900 | 10753500 | 39082845 | 39084269 | MMseg49 | 9509 |
| M | 10759300 | 10760500 | 39089012 | 39090211 | MMseg50 | 9510 |
| M | 10778750 | 10780600 | 39108583 | 39110442 | MMseg51 | 9511 |
| M | 10971250 | 10972650 | 39284868 | 39286426 | MMseg52 | 9512 |
| M | 11124000 | 11125500 | 39430776 | 39432700 | MMseg53 | 9513 |
| M | 11262550 | 11264300 | 39569328 | 39570589 | MMseg54 | 9514 |
| M | 11383300 | 11385350 | 39679214 | 39681342 | MMseg55 | 9515 |
| M | 11550700 | 11551900 | 39837771 | 39838402 | MMseg56 | 9516 |
| M | 11576300 | 11578800 | 39865577 | 39868181 | MMseg57 | 9517 |
| M | 11582850 | 11585650 | 39872571 | 39875449 | MMseg58 | 9518 |
| M | 11645900 | 11647550 | 39945175 | 39946956 | MMseg59 | 9519 |
| M | 11654800 | 11659450 | 39954283 | 39958991 | MMseg60 | 9520 |
| M | 11662100 | 11669800 | 39961797 | 39969863 | MMseg61 | 9521 |
| M | 11703550 | 11705350 | 40003903 | 40005703 | MMseg62 | 9522 |
| M | 11707150 | 11708850 | 40007611 | 40009366 | MMseg63 | 9523 |
| M | 11710650 | 11718750 | 40011139 | 40018589 | MMseg64 | 9524 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| M | 11728200 | 11730500 | 40026472 | 40028777 | MMseg65 | 9525 |
| M | 11735100 | 11736450 | 40033943 | 40035274 | MMseg66 | 9526 |
| M | 11766750 | 11767900 | 40063878 | 40064124 | MMseg67 | 9527 |
| M | 12338050 | 12339450 | 40593930 | 40595293 | MMseg68 | 9528 |
| M | 12417200 | 12418250 | 40704659 | 40705382 | MMseg69 | 9529 |
| M | 12428000 | 12429350 | 40714842 | 40715317 | MMseg70 | 9530 |
| M | 12743200 | 12744650 | 41089659 | 41090124 | MMseg71 | 9531 |
| M | 12818100 | 12819950 | 41150505 | 41157947 | MMseg72 | 9532 |
| M | 12921500 | 12923400 | 41240932 | 41242415 | MMseg73 | 9533 |
| M | 13068150 | 13070050 | 41337552 | 41338312 | MMseg76 | 9534 |
| M | 13199900 | 13201100 | 41526219 | 41527502 | MMseg78 | 9535 |
| M | 13586650 | 13588100 | 41899542 | 41900594 | MMseg82 | 9536 |
| M | 13948700 | 13950050 | 42150821 | 42151310 | MMseg84 | 9537 |
| M | 14275600 | 14276850 | 42401359 | 42401723 | MMseg87 | 9538 |
| M | 15079050 | 15080900 | 42964831 | 42965428 | MMseg90 | 9539 |
| M | 15633350 | 15634500 | 43219518 | 43220620 | MMseg96 | 9540 |
| M | 16215950 | 16217100 | 43552275 | 43552776 | MMseg98 | 9541 |
| M | 16310150 | 16311550 | 43653789 | 43655204 | MMseg99 | 9542 |
| M | 16352600 | 16353700 | 43708265 | 43709514 | MMseg100 | 9543 |
| M | 16474850 | 16476200 | 43821516 | 43822646 | MMseg101 | 9544 |
| M | 16520600 | 16522000 | 43860750 | 43862275 | MMseg102 | 9545 |
| M | 16577900 | 16579200 | 43904022 | 43906946 | MMseg103 | 9546 |
| M | 17104850 | 17106650 | 44370097 | 44372478 | MMseg107 | 9547 |
| M | 17719850 | 17721600 | 44701005 | 44702677 | MMseg109 | 9548 |
| M | 17857950 | 17859250 | 44972915 | 44974806 | MMseg110 | 9549 |
| M | 18017950 | 18019350 | 45045628 | 45046309 | MMseg111 | 9550 |
| M | 18258950 | 18260700 | 45156771 | 45157187 | MMseg114 | 9551 |
| M | 18628650 | 18629650 | 45526439 | 45526711 | MMseg116 | 9552 |
| M | 19143000 | 19144250 | 45944608 | 45945570 | MMseg118 | 9553 |
| M | 19400450 | 19402100 | 46153370 | 46155321 | MMseg121 | 9554 |
| M | 19648350 | 19649700 | 46448372 | 46449437 | MMseg123 | 9555 |
| M | 19767600 | 19768650 | 46532957 | 46533394 | MMseg124 | 9556 |
| M | 19788100 | 19789650 | 46546448 | 46546847 | MMseg125 | 9557 |
| M | 19830550 | 19831800 | 46592650 | 46596786 | MMseg127 | 9558 |
| M | 19852500 | 19853950 | 46608662 | 46610205 | MMseg128 | 9559 |
| M | 19867300 | 19869950 | 46616951 | 46619601 | MMseg129 | 9560 |
| M | 20004300 | 20005900 | 46773536 | 46774882 | MMseg132 | 9561 |
| M | 20081300 | 20083100 | 46900462 | 46902001 | MMseg134 | 9562 |
| M | 20281100 | 20282500 | 47092449 | 47093871 | MMseg136 | 9563 |
| M | 20395550 | 20397400 | 47382119 | 47383886 | MMseg137 | 9564 |
| M | 20508200 | 20509400 | 47488820 | 47490031 | MMseg138 | 9565 |
| M | 20755850 | 20756900 | 47966043 | 47967443 | MMseg141 | 9566 |
| M | 21112950 | 21114100 | 115367118 | 115367917 | MMseg145 | 9567 |
| M | 21323400 | 21325100 | 115594479 | 115595982 | MMseg146 | 9568 |
| M | 21859450 | 21861050 | 116088825 | 116089315 | MMseg150 | 9569 |
| M | 22252950 | 22254200 | 116521907 | 116523099 | MMseg151 | 9570 |
| M | 22365000 | 22366700 | 116627963 | 116628490 | MMseg152 | 9571 |
| M | 22591250 | 22593200 | 116844814 | 116846302 | MMseg154 | 9572 |
| M | 22891300 | 22892700 | 117160204 | 117162745 | MMseg155 | 9573 |
| M | 22900300 | 22901850 | 117197807 | 117198634 | MMseg156 | 9574 |
| M | 23064000 | 23065200 | 117341955 | 117343454 | MMseg157 | 9575 |
| M | 23269850 | 23271200 | 117479737 | 117481070 | MMseg158 | 9576 |
| M | 31061350 | 31063000 | 57160736 | 57161825 | MMseg164 | 9577 |
| M | 33506600 | 33507900 | 117703737 | 117705042 | MMseg166 | 9578 |
| M | 33655950 | 33657600 | 117865709 | 117865993 | MMseg167 | 9579 |
| M | 33677500 | 33678650 | 117887912 | 117889641 | MMseg169 | 9580 |
| M | 33719150 | 33720800 | 117936088 | 117937432 | MMseg170 | 9581 |
| M | 33813200 | 33814300 | 118050315 | 118050806 | MMseg171 | 9582 |
| M | 33866800 | 33870650 | 118106993 | 118110700 | MMseg172 | 9583 |
| M | 34264100 | 34265200 | 118498370 | 118498922 | MMseg174 | 9584 |
| M | 34447150 | 34448350 | 118743838 | 118744484 | MMseg176 | 9585 |
| M | 34528700 | 34530250 | 118826374 | 118827918 | MMseg177 | 9586 |
| M | 34587900 | 34590700 | 118891626 | 118894438 | MMseg178 | 9587 |
| M | 34642500 | 34644100 | 118977552 | 118978563 | MMseg179 | 9588 |
| M | 35869800 | 35871200 | 119641379 | 119642247 | MMseg184 | 9589 |
| M | 35983400 | 35984750 | 119759361 | 119760471 | MMseg186 | 9590 |
| M | 36033000 | 36034750 | 119822855 | 119823422 | MMseg188 | 9591 |
| M | 36079100 | 36080150 | 119872729 | 119873853 | MMseg189 | 9592 |
| M | 36147600 | 36149700 | 119915366 | 119916215 | MMseg190 | 9593 |
| M | 36218750 | 36220550 | 119959781 | 119968254 | MMseg191 | 9594 |
| M | 36597100 | 36598600 | 120291848 | 120292317 | MMseg194 | 9595 |
| M | 36924550 | 36926150 | 120568820 | 120570886 | MMseg197 | 9596 |
| M | 37551900 | 37553550 | 120965147 | 120968022 | MMseg201 | 9597 |
| M | 37969400 | 37970450 | 121501507 | 121501725 | MMseg202 | 9598 |

TABLE IVB-continued

Mouse Binding Sites with Human Liftovers

| Cell/Day | Mouse | | Human | | Segment | |
| --- | --- | --- | --- | --- | --- | --- |
| | Start | end | start | end | name | SEQ ID NO: |
| M | 38079150 | 38080750 | 121618886 | 121619926 | MMseg203 | 9599 |
| M | 38281750 | 38283400 | 121879773 | 121881361 | MMseg204 | 9600 |
| M | 38444000 | 38445050 | 122013409 | 122013642 | MMseg206 | 9601 |
| M | 38561450 | 38563000 | 122121499 | 122122409 | MMseg209 | 9602 |
| M | 38731100 | 38732300 | 122294096 | 122294864 | MMseg210 | 9603 |
| M | 38790800 | 38792350 | 122352832 | 122354054 | MMseg211 | 9604 |
| M | 39492400 | 39494100 | 123081818 | 123083882 | MMseg213 | 9605 |
| M | 39805700 | 39807700 | 123426566 | 123428759 | MMseg215 | 9606 |
| M | 39846000 | 39847400 | 123470567 | 123471902 | MMseg216 | 9607 |
| M | 39967500 | 39969050 | 123590168 | 123591761 | MMseg217 | 9608 |
| M | 40023850 | 40025400 | 123642627 | 123643161 | MMseg218 | 9609 |
| M | 40425400 | 40426600 | 124026728 | 124028624 | MMseg219 | 9610 |
| M | 40781400 | 40785400 | 124337576 | 124341322 | MMseg220 | 9611 |
| M | 40953300 | 40954650 | 124462957 | 124463685 | MMseg221 | 9612 |
| M | 41102400 | 41103750 | 124544235 | 124544653 | MMseg223 | 9613 |
| M | 41718450 | 41719750 | 125297300 | 125298487 | MMseg226 | 9614 |
| M | 41756150 | 41757350 | 125334297 | 125334538 | MMseg227 | 9615 |
| M | 42069950 | 42071000 | 125601592 | 125601936 | MMseg229 | 9616 |
| M | 42181700 | 42182750 | 125731578 | 125731807 | MMseg230 | 9617 |
| M | 42202000 | 42203700 | 125740154 | 125741540 | MMseg231 | 9618 |
| M | 42450900 | 42452150 | 125959401 | 125959828 | MMseg232 | 9619 |
| M | 42819700 | 42821000 | 126373406 | 126373921 | MMseg233 | 9620 |
| M | 43831900 | 43833250 | 127461185 | 127466799 | MMseg241 | 9621 |
| M | 43886350 | 43887600 | 127479682 | 127481326 | MMseg243 | 9622 |
| M | 44252100 | 44253150 | 127832599 | 127832980 | MMseg244 | 9623 |
| M | 44378250 | 44379750 | 127951857 | 127952536 | MMseg245 | 9624 |
| M | 44806550 | 44808000 | 128238615 | 128238902 | MMseg247 | 9625 |
| M | 45404500 | 45405900 | 128808886 | 128810670 | MMseg249 | 9626 |
| M | 45449100 | 45452700 | 128856715 | 128859696 | MMseg250 | 9627 |
| M | 45518700 | 45520450 | 128933211 | 128934320 | MMseg251 | 9628 |
| M | 45696600 | 45698250 | 129116279 | 129117903 | MMseg253 | 9629 |
| M | 45817450 | 45818700 | 129256327 | 129256969 | MMseg254 | 9630 |
| M | 46526200 | 46527800 | 129921536 | 129923301 | MMseg257 | 9631 |
| M | 46589400 | 46590700 | 129991567 | 129995308 | MMseg258 | 9632 |
| M | 46730900 | 46732150 | 130129392 | 130130576 | MMseg259 | 9633 |
| M | 46786550 | 46787900 | 130159266 | 130160128 | MMseg260 | 9634 |
| M | 46845350 | 46847000 | 130214690 | 130216304 | MMseg261 | 9635 |
| M | 47096950 | 47098300 | 130370676 | 130372022 | MMseg266 | 9636 |
| M | 47277800 | 47278800 | 130480480 | 130481488 | MMseg268 | 9637 |
| M | 47820550 | 47821700 | 130740685 | 130741323 | MMseg271 | 9638 |
| M | 48193550 | 48196000 | 131156178 | 131158689 | MMseg275 | 9639 |
| M | 48251350 | 48252400 | 131215697 | 131216878 | MMseg276 | 9640 |
| M | 48284900 | 48286650 | 131251254 | 131253314 | MMseg277 | 9641 |
| M | 48343450 | 48344900 | 131321266 | 131322624 | MMseg279 | 9642 |
| M | 48483100 | 48484100 | 131524685 | 131525682 | MMseg280 | 9643 |
| M | 48522450 | 48523550 | 131578848 | 131579779 | MMseg281 | 9644 |
| M | 48526400 | 48528150 | 131590554 | 131591740 | MMseg282 | 9645 |
| M | 48558700 | 48559900 | 131623600 | 131624736 | MMseg283 | 9646 |
| M | 48856950 | 48859000 | 131881678 | 131884124 | MMseg284 | 9647 |
| M | 48862150 | 48863550 | 131887966 | 131889731 | MMseg285 | 9648 |
| M | 49064500 | 49065800 | 132122111 | 132122636 | MMseg287 | 9649 |
| M | 49405600 | 49407250 | 132436079 | 132437528 | MMseg288 | 9650 |
| M | 49497350 | 49498800 | 132526484 | 132527990 | MMseg289 | 9651 |
| M | 49510150 | 49511400 | 132540477 | 132541995 | MMseg290 | 9652 |
| M | 49571550 | 49572800 | 132617041 | 132619498 | MMseg291 | 9653 |
| M | 49740150 | 49741750 | 132824815 | 132826853 | MMseg292 | 9654 |
| M | 49809350 | 49810500 | 132929400 | 132930721 | MMseg293 | 9655 |
| M | 49899250 | 49900700 | 133043990 | 133045826 | MMseg294 | 9656 |
| M | 49917950 | 49919150 | 133067381 | 133069727 | MMseg295 | 9657 |
| M | 49942600 | 49944300 | 133093735 | 133095552 | MMseg296 | 9658 |
| M | 49965300 | 49968700 | 133117792 | 133121448 | MMseg297 | 9659 |
| M | 49997500 | 49998900 | 133151877 | 133153912 | MMseg298 | 9660 |
| M | 50096400 | 50100350 | 133304977 | 133309222 | MMseg299 | 9661 |
| M | 50143700 | 50145100 | 133370577 | 133371992 | MMseg300 | 9662 |
| M | 50209600 | 50210750 | 133429054 | 133429874 | MMseg301 | 9663 |
| M | 50282750 | 50284400 | 133524919 | 133527179 | MMseg303 | 9664 |
| M | 50634750 | 50635800 | 133947550 | 133948902 | MMseg304 | 9665 |
| M | 50641850 | 50643450 | 133956560 | 133960476 | MMseg305 | 9666 |
| M | 51018750 | 51021000 | 134231382 | 134233395 | MMseg308 | 9667 |
| M | 51194850 | 51195900 | 141433590 | 141434225 | MMseg312 | 9668 |
| M | 53704500 | 53706200 | 134650548 | 134652493 | MMseg318 | 9669 |
| M | 54161400 | 54163150 | 135423230 | 135425026 | MMseg321 | 9670 |
| M | 54279000 | 54280500 | 135545720 | 135547150 | MMseg323 | 9671 |
| M | 54756100 | 54757650 | 136115263 | 136116820 | MMseg325 | 9672 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| M | 54774300 | 54775600 | 136134507 | 136135864 | MMseg326 | 9673 |
| M | 55169950 | 55176500 | 136506849 | 136513628 | MMseg328 | 9674 |
| M | 55261000 | 55262400 | 136622712 | 136623264 | MMseg329 | 9675 |
| M | 55268150 | 55273600 | 136628118 | 136633739 | MMseg330 | 9676 |
| M | 55279300 | 55288700 | 136643767 | 136653231 | MMseg331 | 9677 |
| M | 55290250 | 55292700 | 136654785 | 136657531 | MMseg332 | 9678 |
| M | 55399650 | 55401100 | 136814120 | 136817847 | MMseg333 | 9679 |
| M | 55407300 | 55408950 | 136828203 | 136829801 | MMseg334 | 9680 |
| M | 55925700 | 55927050 | 137302884 | 137304328 | MMseg339 | 9681 |
| M | 56152550 | 56153650 | 137525692 | 137526681 | MMseg341 | 9682 |
| M | 56379050 | 56380550 | 137785121 | 137787005 | MMseg342 | 9683 |
| M | 56386350 | 56388150 | 137792291 | 137794091 | MMseg343 | 9684 |
| M | 56634900 | 56635950 | 138062404 | 138063181 | MMseg344 | 9685 |
| M | 56736450 | 56737550 | 138193708 | 138194646 | MMseg345 | 9686 |
| M | 56819900 | 56822800 | 138285889 | 138289094 | MMseg346 | 9687 |
| M | 56834000 | 56835200 | 138300941 | 138301824 | MMseg347 | 9688 |
| M | 57004650 | 57006100 | 138405725 | 138414513 | MMseg349 | 9689 |
| M | 57259550 | 57261150 | 138620974 | 138621419 | MMseg351 | 9690 |
| M | 57425750 | 57427250 | 138770044 | 138770603 | MMseg352 | 9691 |
| M | 57430550 | 57433250 | 138772853 | 138775256 | MMseg353 | 9692 |
| M | 57727450 | 57728900 | 139057731 | 139058887 | MMseg354 | 9693 |
| M | 57800350 | 57802150 | 139173183 | 139174842 | MMseg356 | 9694 |
| M | 58140650 | 58142300 | 139580864 | 139582747 | MMseg357 | 9695 |
| M | 58143500 | 58152650 | 139584079 | 139593995 | MMseg358 | 9696 |
| M | 58439750 | 58441150 | 139867257 | 139868724 | MMseg361 | 9697 |
| M | 58988650 | 58990100 | 140259998 | 140260628 | MMseg366 | 9698 |
| M | 59262150 | 59263950 | 140736943 | 140738104 | MMseg367 | 9699 |
| M | 59592700 | 59593750 | 141194357 | 141195534 | MMseg370 | 9700 |
| M | 60583050 | 60584350 | 141937515 | 141938138 | MMseg373 | 9701 |
| M | 61043950 | 61045450 | 142350411 | 142351908 | MMseg380 | 9702 |
| M | 61527800 | 61529150 | 142720439 | 142721781 | MMseg383 | 9703 |
| M | 61671850 | 61673650 | 142878749 | 142880327 | MMseg385 | 9704 |
| M | 61963800 | 61965550 | 143163639 | 143164033 | MMseg389 | 9705 |
| M | 63929250 | 63930400 | 144926811 | 144927653 | MMseg402 | 9706 |
| M | 63959550 | 63960750 | 144961489 | 144961806 | MMseg403 | 9707 |
| M | 64147050 | 64148450 | 145231449 | 145232903 | MMseg404 | 9708 |
| M | 64432550 | 64433850 | 145449800 | 145449964 | MMseg407 | 9709 |
| M | 64982900 | 64984650 | 145928315 | 145929114 | MMseg411 | 9710 |
| M | 65565600 | 65566600 | 146682637 | 146683663 | MMseg413 | 9711 |
| M | 66032050 | 66033150 | 147094190 | 147094515 | MMseg414 | 9712 |
| M | 66147050 | 66148400 | 148136452 | 148137558 | MMseg416 | 9713 |
| M | 66414450 | 66415550 | 147376479 | 147377512 | MMseg418 | 9714 |
| M | 66466200 | 66467250 | 147416032 | 147416633 | MMseg419 | 9715 |
| M | 66565900 | 66567800 | 147532436 | 147533070 | MMseg420 | 9716 |
| M | 66791050 | 66792100 | 147740529 | 147740681 | MMseg421 | 9717 |
| M | 66910950 | 66912600 | 147855324 | 147856060 | MMseg422 | 9718 |
| M | 67053550 | 67055100 | 148002184 | 148003665 | MMseg423 | 9719 |
| M | 67107250 | 67108750 | 148056834 | 148058356 | MMseg424 | 9720 |
| M | 67336350 | 67337900 | 148289250 | 148290266 | MMseg426 | 9721 |
| M | 67438050 | 67439250 | 148394750 | 148396004 | MMseg427 | 9722 |
| M | 67492950 | 67494400 | 148463656 | 148465512 | MMseg428 | 9723 |
| M | 67582600 | 67583950 | 148549872 | 148552716 | MMseg430 | 9724 |
| M | 68201300 | 68202800 | 149440019 | 149444320 | MMseg431 | 9725 |
| M | 68566200 | 68567250 | 149838808 | 149840325 | MMseg433 | 9726 |
| M | 68809850 | 68811350 | 150152649 | 150154190 | MMseg435 | 9727 |
| M | 68913850 | 68920450 | 150341780 | 150348993 | MMseg436 | 9728 |
| M | 69023100 | 69024500 | 150507372 | 150509706 | MMseg437 | 9729 |
| M | 69206150 | 69207800 | 150861757 | 150863431 | MMseg438 | 9730 |
| M | 69289200 | 69290200 | 150932386 | 150933007 | MMseg439 | 9731 |
| M | 69573500 | 69575000 | 151193056 | 151194306 | MMseg441 | 9732 |
| M | 69898700 | 69902050 | 151616721 | 151620206 | MMseg444 | 9733 |
| M | 70703250 | 70704700 | 152734500 | 152736473 | MMseg448 | 9734 |
| M | 70747600 | 70749950 | 152782383 | 152784617 | MMseg449 | 9735 |
| M | 70788600 | 70789950 | 152819817 | 152821149 | MMseg450 | 9736 |
| M | 70804450 | 70805500 | 152834446 | 152835361 | MMseg451 | 9737 |
| M | 70934050 | 70935750 | 152968441 | 152970287 | MMseg453 | 9738 |
| M | 71284600 | 71286450 | 153300874 | 153306329 | MMseg455 | 9739 |
| M | 71297900 | 71299400 | 153330015 | 153330874 | MMseg456 | 9740 |
| M | 71335900 | 71337000 | 153371046 | 153371498 | MMseg457 | 9741 |
| M | 71490050 | 71491150 | 153597854 | 153598989 | MMseg460 | 9742 |
| M | 71617950 | 71619050 | 153718278 | 153719140 | MMseg461 | 9743 |
| M | 72290150 | 72291600 | 153956437 | 153957872 | MMseg467 | 9744 |
| M | 72365450 | 72366450 | 154017342 | 154017499 | MMseg468 | 9745 |
| M | 72582600 | 72584050 | 154215357 | 154215869 | MMseg470 | 9746 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| M | 72624100 | 72625150 | 154250623 | 154250998 | MMseg471 | 9747 |
| M | 73054650 | 73055950 | 114860457 | 114861747 | MMseg473 | 9748 |
| M | 73071500 | 73072900 | 114844362 | 114844984 | MMseg474 | 9749 |
| M | 73155600 | 73157200 | 114767260 | 114768562 | MMseg475 | 9750 |
| M | 73261100 | 73262650 | 114691960 | 114692435 | MMseg476 | 9751 |
| M | 73327750 | 73329150 | 114644793 | 114645241 | MMseg478 | 9752 |
| M | 73341100 | 73342200 | 114627636 | 114628019 | MMseg479 | 9753 |
| M | 73349000 | 73350400 | 114615075 | 114616059 | MMseg480 | 9754 |
| M | 73643150 | 73644150 | 9936073 | 9936323 | MMseg482 | 9755 |
| M | 73943550 | 73944700 | 8802904 | 8808683 | MMseg486 | 9756 |
| M | 74132400 | 74133750 | 8891298 | 8892121 | MMseg487 | 9757 |
| M | 74765750 | 74767100 | 9439444 | 9445152 | MMseg492 | 9758 |
| M | 74813350 | 74814550 | 9517999 | 9518540 | MMseg494 | 9759 |
| M | 74824650 | 74825850 | 9526588 | 9527688 | MMseg495 | 9760 |
| M | 74836600 | 74837700 | 9541735 | 9542753 | MMseg496 | 9761 |
| M | 74849700 | 74851450 | 9568569 | 9570768 | MMseg497 | 9762 |
| M | 75704950 | 75706650 | 37305235 | 37305481 | MMseg503 | 9763 |
| M | 75868550 | 75870150 | 50648371 | 50648543 | MMseg504 | 9764 |
| M | 76513450 | 76514900 | 36399442 | 36400549 | Mmseg508 | 9765 |
| M | 77125950 | 77127250 | 35519498 | 35521293 | Mmseg510 | 9766 |
| M | 77574450 | 77575900 | 35150260 | 35160220 | MMseg514 | 9767 |
| M | 78182700 | 78184200 | 34748285 | 34748895 | MMseg520 | 9768 |
| M | 78325850 | 78327400 | 34660292 | 34661661 | MMseg521 | 9769 |
| M | 78385750 | 78387700 | 34610115 | 34612020 | MMseg522 | 9770 |
| M | 79062350 | 79063600 | 34199143 | 34199280 | MMseg526 | 9771 |
| M | 79173000 | 79174450 | 34038122 | 34038418 | MMseg528 | 9772 |
| M | 79501300 | 79502300 | 33814292 | 33814675 | MMseg530 | 9773 |
| M | 80079150 | 80080250 | 33335447 | 33336215 | MMseg533 | 9774 |
| M | 80214700 | 80215850 | 33211441 | 33212426 | MMseg534 | 9775 |
| M | 80289550 | 80291150 | 33143296 | 33145129 | MMseg535 | 9776 |
| M | 80951950 | 80953100 | 32598589 | 32599876 | MMseg539 | 9777 |
| M | 80986250 | 80987500 | 32547715 | 32548917 | MMseg540 | 9778 |
| M | 81013650 | 81014950 | 32525825 | 32527469 | MMseg541 | 9779 |
| M | 81201750 | 81202950 | 32321843 | 32326932 | MMseg542 | 9780 |
| M | 81227950 | 81229600 | 32274064 | 32278591 | MMseg543 | 9781 |
| M | 81279900 | 81281750 | 32217187 | 32218420 | MMseg544 | 9782 |
| M | 81329500 | 81330500 | 32165214 | 32165919 | MMseg545 | 9783 |
| M | 81504450 | 81505850 | 31991565 | 31993741 | MMseg546 | 9784 |
| M | 81921950 | 81922950 | 31614505 | 31615576 | MMseg547 | 9785 |
| M | 82168250 | 82169850 | 31382553 | 31384566 | MMseg548 | 9786 |
| M | 82230400 | 82232100 | 31329148 | 31332982 | MMseg549 | 9787 |
| M | 82607750 | 82609250 | 31029272 | 31030516 | MMseg551 | 9788 |
| M | 82630250 | 82631250 | 31020288 | 31024031 | MMseg552 | 9789 |
| M | 82936850 | 82937950 | 30752842 | 30753334 | MMseg553 | 9790 |
| M | 83220450 | 83222100 | 30492715 | 30493672 | MMseg554 | 9791 |
| M | 83313000 | 83314550 | 30436903 | 30437909 | MMseg555 | 9792 |
| M | 83567400 | 83568850 | 30257600 | 30258223 | MMseg559 | 9793 |
| M | 83691900 | 83693400 | 30203246 | 30205467 | MMseg561 | 9794 |
| M | 84027100 | 84028200 | 29940164 | 29940830 | MMseg562 | 9795 |
| M | 84064350 | 84066050 | 29904001 | 29906944 | MMseg563 | 9796 |
| M | 84476400 | 84477600 | 29474201 | 29476636 | MMseg564 | 9797 |
| M | 84508350 | 84509700 | 29458782 | 29460076 | MMseg565 | 9798 |
| M | 84762400 | 84763950 | 29208421 | 29208751 | MMseg567 | 9799 |
| M | 84897200 | 84898200 | 29066918 | 29067892 | MMseg568 | 9800 |
| M | 84910100 | 84911200 | 29051254 | 29052897 | MMseg569 | 9801 |
| M | 84961950 | 84963350 | 29000756 | 29002298 | MMseg570 | 9802 |
| M | 84978950 | 84980450 | 28981962 | 28982362 | MMseg571 | 9803 |
| M | 85005100 | 85006350 | 28936463 | 28938576 | MMseg572 | 9804 |
| M | 85562100 | 85563150 | 28487115 | 28487606 | MMseg574 | 9805 |
| M | 85703250 | 85704650 | 28368422 | 28370314 | MMseg576 | 9806 |
| M | 86279900 | 86281250 | 28017133 | 28018798 | MMseg579 | 9807 |
| M | 86798900 | 86800500 | 27646071 | 27646646 | MMseg580 | 9808 |
| M | 86802650 | 86804100 | 27637492 | 27641190 | MMseg581 | 9809 |
| M | 87221250 | 87222450 | 27271213 | 27272126 | MMseg582 | 9810 |
| M | 88018550 | 88020000 | 26584683 | 26585735 | MMseg589 | 9811 |
| M | 89366350 | 89367900 | 26149133 | 26156488 | MMseg597 | 9812 |
| M | 89562150 | 89563950 | 25920772 | 25921401 | MMseg598 | 9813 |
| M | 89828050 | 89829600 | 25563318 | 25564678 | MMseg599 | 9814 |
| M | 90202250 | 90204300 | 25254918 | 25256191 | MMseg602 | 9815 |
| M | 90256200 | 90257300 | 25217098 | 25218123 | MMseg605 | 9816 |
| M | 90492400 | 90495350 | 25070572 | 25072276 | MMseg607 | 9817 |
| M | 90525900 | 90545400 | 25019886 | 25040035 | MMseg608 | 9818 |
| M | 90579500 | 90580700 | 24992157 | 24994070 | MMseg609 | 9819 |
| M | 90607700 | 90609050 | 24961318 | 24962578 | MMseg610 | 9820 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| M | 90929350 | 90930500 | 24657766 | 24658741 | MMseg611 | 9821 |
| M | 90945250 | 90947150 | 24637311 | 24639225 | MMseg612 | 9822 |
| M | 90949050 | 90950550 | 24626926 | 24629015 | MMseg613 | 9823 |
| M | 91012250 | 91014050 | 24552230 | 24555573 | MMseg614 | 9824 |
| M | 91069350 | 91070800 | 24490772 | 24494009 | MMseg615 | 9825 |
| M | 91265450 | 91266800 | 24288541 | 24291243 | MMseg616 | 9826 |
| M | 91478500 | 91482600 | 24040129 | 24045037 | MMseg619 | 9827 |
| M | 91509800 | 91511600 | 24014166 | 24015401 | MMseg620 | 9828 |
| M | 91594050 | 91595650 | 23942739 | 23944821 | MMseg622 | 9829 |
| M | 91606250 | 91607550 | 23929612 | 23930914 | MMseg623 | 9830 |
| M | 91610000 | 91611950 | 23926353 | 23928328 | MMseg624 | 9831 |
| M | 91787200 | 91788950 | 51635116 | 51636882 | MMseg626 | 9832 |
| M | 91880600 | 91882350 | 51485545 | 51487465 | MMseg628 | 9833 |
| M | 91890700 | 91891950 | 51491994 | 51492497 | MMseg629 | 9834 |
| M | 91975350 | 91977250 | 57623737 | 57625519 | MMseg630 | 9835 |
| M | 92328500 | 92329550 | 62946889 | 62948473 | MMseg635 | 9836 |
| M | 92654950 | 92656600 | 63431904 | 63432726 | MMseg638 | 9837 |
| M | 93011600 | 93013100 | 64424882 | 64425267 | MMseg641 | 9838 |
| M | 93178550 | 93179550 | 64774397 | 64775385 | MMseg644 | 9839 |
| M | 93201000 | 93202800 | 64801053 | 64802481 | MMseg645 | 9840 |
| M | 93346300 | 93347850 | 64948633 | 64949287 | MMseg646 | 9841 |
| M | 93551450 | 93552700 | 65333221 | 65334136 | MMseg651 | 9842 |
| M | 93691200 | 93692500 | 65416247 | 65417202 | MMseg652 | 9843 |
| M | 93785250 | 93787100 | 65507408 | 65519374 | MMseg653 | 9844 |
| M | 93905900 | 93907550 | 65654925 | 65655818 | MMseg654 | 9845 |
| M | 94839450 | 94840900 | 66125640 | 66126153 | MMseg662 | 9846 |
| M | 95231150 | 95232550 | 66749817 | 66751352 | MMseg665 | 9847 |
| M | 95524350 | 95526200 | 66956140 | 66956678 | MMseg669 | 9848 |
| M | 96034550 | 96035750 | 67585112 | 67585837 | MMseg671 | 9849 |
| M | 96193450 | 96195200 | 67860712 | 67862062 | MMseg673 | 9850 |
| M | 96293100 | 96294700 | 67971552 | 67971788 | MMseg674 | 9851 |
| M | 96322100 | 96323600 | 68039404 | 68041384 | MMseg675 | 9852 |
| M | 96329300 | 96330550 | 68046721 | 68047958 | MMseg676 | 9853 |
| M | 96402650 | 96404150 | 68125654 | 68126415 | MMseg677 | 9854 |
| M | 96434900 | 96436150 | 68158317 | 68159610 | MMseg678 | 9855 |
| M | 96528000 | 96529350 | 68250249 | 68251386 | MMseg679 | 9856 |
| M | 96555200 | 96556400 | 68282865 | 68284098 | MMseg680 | 9857 |
| M | 96567850 | 96569300 | 68293701 | 68295952 | MMseg681 | 9858 |
| M | 96641750 | 96642850 | 68360234 | 68361899 | MMseg682 | 9859 |
| M | 96671450 | 96672700 | 68391414 | 68392929 | MMseg683 | 9860 |
| M | 97014600 | 97018200 | 68723299 | 68726946 | MMseg684 | 9861 |
| M | 97483900 | 97485300 | 69152100 | 69152567 | MMseg686 | 9862 |
| M | 97559900 | 97561600 | 69223359 | 69223957 | MMseg687 | 9863 |
| M | 97754400 | 97755900 | 69442930 | 69443397 | MMseg689 | 9864 |
| M | 97772150 | 97773850 | 69459091 | 69460567 | MMseg690 | 9865 |
| M | 97898200 | 97899350 | 69605476 | 69606446 | MMseg692 | 9866 |
| M | 97915450 | 97916650 | 69630187 | 69631537 | MMseg693 | 9867 |
| M | 97922950 | 97924000 | 69641034 | 69641198 | MMseg694 | 9868 |
| M | 98138900 | 98140200 | 69884475 | 69884970 | MMseg695 | 9869 |
| M | 98148200 | 98149400 | 69901327 | 69901844 | MMseg696 | 9870 |
| M | 98577450 | 98581300 | 70441275 | 70445393 | MMseg698 | 9871 |
| M | 98585400 | 98586850 | 70450799 | 70451047 | MMseg699 | 9872 |
| M | 98834400 | 98836350 | 70751877 | 70753896 | MMseg701 | 9873 |
| M | 98858150 | 98859400 | 70774823 | 70776014 | MMseg702 | 9874 |
| M | 99043850 | 99047200 | 71129786 | 71133325 | MMseg706 | 9875 |
| M | 99220750 | 99222500 | 71306682 | 71307389 | MMseg708 | 9876 |
| M | 99236450 | 99237800 | 71324304 | 71325351 | MMseg709 | 9877 |
| M | 99442050 | 99449500 | 71520901 | 71528981 | MMseg711 | 9878 |
| M | 99506100 | 99507650 | 71574921 | 71576860 | MMseg712 | 9879 |
| M | 99591750 | 99593400 | 71676716 | 71678233 | MMseg713 | 9880 |
| M | 99610950 | 99612600 | 71694597 | 71696111 | MMseg714 | 9881 |
| M | 99883150 | 99884950 | 72002658 | 72004150 | MMseg715 | 9882 |
| M | 100128600 | 100130250 | 72162720 | 72164453 | MMseg716 | 9883 |
| M | 100380450 | 100382750 | 72433129 | 72435454 | MMseg721 | 9884 |
| M | 100516450 | 100519300 | 72666631 | 72669541 | MMseg722 | 9885 |
| M | 100551250 | 100553100 | 72782399 | 72784236 | MMseg723 | 9886 |
| M | 100889900 | 100891800 | 73754833 | 73756926 | MMseg727 | 9887 |
| M | 100920200 | 100921800 | 73731598 | 73733113 | MMseg728 | 9888 |
| M | 101016150 | 101017800 | 73640803 | 73642498 | MMseg729 | 9889 |
| M | 101131950 | 101133750 | 73796281 | 73797015 | MMseg731 | 9890 |
| M | 101287900 | 101288950 | 73973440 | 73973792 | MMseg733 | 9891 |
| M | 101393850 | 101397150 | 74142849 | 74145904 | MMseg734 | 9892 |
| M | 101440500 | 101442050 | 74185725 | 74187823 | MMseg735 | 9893 |
| M | 101608350 | 101609750 | 74375221 | 74376789 | MMseg737 | 9894 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| M | 101624200 | 101625400 | 74384265 | 74384853 | MMseg738 | 9895 |
| M | 101758800 | 101760500 | 74641629 | 74644014 | MMseg739 | 9896 |
| M | 101883300 | 101884350 | 74799734 | 74800662 | MMseg740 | 9897 |
| M | 101942950 | 101944550 | 74835923 | 74842905 | MMseg742 | 9898 |
| M | 102400850 | 102402350 | 75938514 | 75938837 | MMseg745 | 9899 |
| M | 102759850 | 102761150 | 76438759 | 76439779 | MMseg747 | 9900 |
| M | 102957550 | 102961000 | 76703692 | 76704302 | MMseg750 | 9901 |
| M | 103179700 | 103181050 | 77110993 | 77112114 | MMseg752 | 9902 |
| M | 103222250 | 103223250 | 77165896 | 77166862 | MMseg753 | 9903 |
| M | 103797050 | 103798750 | 77581313 | 77582989 | MMseg759 | 9904 |
| M | 104041050 | 104042050 | 77920198 | 77923241 | MMseg764 | 9905 |
| M | 104099950 | 104101250 | 77979366 | 77980418 | MMseg765 | 9906 |
| M | 104463100 | 104465750 | 78411164 | 78413511 | MMseg767 | 9907 |
| M | 104556500 | 104558250 | 78540264 | 78542569 | MMseg769 | 9908 |
| M | 105066950 | 105068650 | 79699365 | 79701033 | MMseg773 | 9909 |
| M | 105983300 | 105984500 | 79983579 | 79984013 | MMseg780 | 9910 |
| M | 106050950 | 106052850 | 80129449 | 80129941 | MMseg781 | 9911 |
| M | 106212850 | 106214050 | 80381063 | 80382416 | MMseg782 | 9912 |
| M | 106612450 | 106613650 | 80774911 | 80776408 | MMseg784 | 9913 |
| M | 106910650 | 106912100 | 81166951 | 81168123 | MMseg786 | 9914 |
| M | 106955950 | 106957650 | 81327625 | 81328065 | MMseg787 | 9915 |
| M | 107128550 | 107129600 | 81575374 | 81576152 | MMseg788 | 9916 |
| M | 107389750 | 107390850 | 81863934 | 81864504 | MMseg789 | 9917 |
| M | 107489050 | 107490200 | 81952668 | 81953486 | MMseg790 | 9918 |
| M | 107965600 | 107967500 | 82707442 | 82708367 | MMseg793 | 9919 |
| M | 108384350 | 108385650 | 83186738 | 83189593 | MMseg794 | 9920 |
| M | 108496050 | 108497650 | 83311277 | 83312698 | MMseg795 | 9921 |
| M | 108577100 | 108578150 | 83443492 | 83444507 | MMseg796 | 9922 |
| M | 109472300 | 109473950 | 84325456 | 84326692 | MMseg806 | 9923 |
| M | 109713400 | 109717700 | 84498068 | 84502366 | MMseg809 | 9924 |
| M | 109867750 | 109869150 | 84686651 | 84687277 | MMseg811 | 9925 |
| M | 110000500 | 110001900 | 84791126 | 84791744 | MMseg812 | 9926 |
| M | 110207650 | 110208750 | 85181784 | 85182876 | MMseg813 | 9927 |
| M | 110275150 | 110276350 | 85284751 | 85286471 | MMseg815 | 9928 |
| M | 110386100 | 110387900 | 85386249 | 85387255 | MMseg816 | 9929 |
| M | 110411350 | 110412600 | 85402933 | 85404168 | MMseg817 | 9930 |
| M | 110439050 | 110440700 | 85456591 | 85457025 | MMseg818 | 9931 |
| M | 110486750 | 110488100 | 85493114 | 85493510 | MMseg819 | 9932 |
| M | 110560900 | 110562550 | 85625105 | 85627165 | MMseg820 | 9933 |
| M | 110578450 | 110579900 | 85643982 | 85645513 | MMseg821 | 9934 |
| M | 110610000 | 110611350 | 85713602 | 85714772 | MMseg822 | 9935 |
| M | 110950700 | 110951700 | 86089353 | 86089588 | MMseg823 | 9936 |
| M | 110992250 | 110993400 | 86140876 | 86141430 | MMseg825 | 9937 |
| M | 111466400 | 111468000 | 86645506 | 86646572 | MMseg827 | 9938 |
| M | 111514000 | 111515400 | 86681076 | 86681942 | MMseg828 | 9939 |
| M | 111659150 | 111660350 | 86882669 | 86883398 | MMseg829 | 9940 |
| M | 112319150 | 112320900 | 87221875 | 87224746 | MMseg831 | 9941 |
| M | 112660900 | 112662600 | 87499718 | 87499920 | MMseg832 | 9942 |
| M | 113009850 | 113011300 | 87649181 | 87650356 | MMseg834 | 9943 |
| M | 114285300 | 114286700 | 88407592 | 88408662 | MMseg839 | 9944 |
| M | 114516300 | 114517450 | 88631528 | 88632064 | MMseg842 | 9945 |
| M | 116209950 | 116211450 | 89785792 | 89786465 | MMseg852 | 9946 |
| M | 116417150 | 116419000 | 90000094 | 90001613 | MMseg853 | 9947 |
| M | 117145150 | 117146450 | 90801422 | 90802560 | MMseg856 | 9948 |
| M | 117349000 | 117350350 | 90980144 | 90981122 | MMseg858 | 9949 |
| M | 117402250 | 117407550 | 91032710 | 91037887 | MMseg860 | 9950 |
| M | 117618800 | 117620450 | 91331021 | 91331322 | MMseg861 | 9951 |
| M | 117696400 | 117698100 | 91431278 | 91433116 | MMseg863 | 9952 |
| M | 117701900 | 117702950 | 91446852 | 91450061 | MMseg864 | 9953 |
| M | 117779000 | 117780650 | 91578843 | 91580649 | MMseg865 | 9954 |
| M | 117808300 | 117809500 | 91613712 | 91614566 | MMseg866 | 9955 |
| M | 117859750 | 117861300 | 91658180 | 91658535 | MMseg867 | 9956 |
| M | 119283500 | 119285050 | 92797309 | 92803533 | MMseg872 | 9957 |
| M | 119509650 | 119511600 | 92927439 | 92929203 | MMseg874 | 9958 |
| M | 119858200 | 119859900 | 93177479 | 93180391 | MMseg875 | 9959 |
| M | 123745200 | 123746200 | 93753922 | 93754506 | MMseg882 | 9960 |
| M | 123952950 | 123954600 | 93884923 | 93887134 | MMseg885 | 9961 |
| M | 125052000 | 125053100 | 94984431 | 94985552 | MMseg892 | 9962 |
| M | 126010150 | 126011350 | 95714394 | 95714657 | MMseg896 | 9963 |
| M | 126128050 | 126129100 | 95811359 | 95811866 | MMseg897 | 9964 |
| M | 126134100 | 126135350 | 95818665 | 95819541 | MMseg898 | 9965 |
| M | 126335050 | 126338850 | 95990007 | 95993886 | MMseg900 | 9966 |
| M | 126476300 | 126478050 | 96169827 | 96171966 | MMseg901 | 9967 |
| M | 126491100 | 126492850 | 96193486 | 96195772 | MMseg902 | 9968 |

TABLE IVB-continued

Mouse Binding Sites with Human Liftovers

| Cell/ | Mouse | | Human | | Segment | |
|---|---|---|---|---|---|---|
| Day | Start | end | start | end | name | SEQ ID NO: |
| M | 127858250 | 127860200 | 97533217 | 97534531 | MMseg908 | 9969 |
| M | 127936450 | 127938050 | 97588006 | 97588532 | MMseg910 | 9970 |
| M | 127990550 | 127991950 | 97624348 | 97625702 | MMseg911 | 9971 |
| M | 128030850 | 128032500 | 97669577 | 97674316 | MMseg912 | 9972 |
| M | 128097900 | 128099450 | 97730698 | 97731095 | MMseg913 | 9973 |
| M | 128324700 | 128325800 | 97934513 | 97935472 | MMseg914 | 9974 |
| M | 128536450 | 128538050 | 98150460 | 98151481 | MMseg915 | 9975 |
| M | 128595000 | 128596400 | 98198615 | 98200051 | MMseg916 | 9976 |
| M | 128642500 | 128643600 | 98230930 | 98231359 | MMseg917 | 9977 |
| M | 128785100 | 128786450 | 98325940 | 98327127 | MMseg918 | 9978 |
| M | 128802650 | 128803900 | 98337034 | 98338007 | MMseg919 | 9979 |
| M | 128846350 | 128847450 | 98369489 | 98370229 | MMseg920 | 9980 |
| M | 129381700 | 129383100 | 98906297 | 98906620 | MMseg923 | 9981 |
| M | 129513350 | 129514750 | 99003189 | 99003961 | MMseg925 | 9982 |
| M | 129596000 | 129597300 | 99106530 | 99107422 | MMseg926 | 9983 |
| M | 129661550 | 129663100 | 99176861 | 99178047 | MMseg927 | 9984 |
| M | 130093500 | 130094900 | 99529255 | 99530631 | MMseg928 | 9985 |
| M | 130135200 | 130136250 | 99569187 | 99570014 | MMseg929 | 9986 |
| M | 130209050 | 130210200 | 99650657 | 99651760 | MMseg930 | 9987 |
| M | 130224300 | 130226000 | 99665979 | 99667550 | MMseg931 | 9988 |
| M | 130320100 | 130321900 | 99767037 | 99767713 | MMseg932 | 9989 |
| M | 130515200 | 130516800 | 99985954 | 99987439 | MMseg933 | 9990 |
| M | 130648400 | 130649900 | 100131007 | 100131589 | MMseg935 | 9991 |
| M | 130970750 | 130971750 | 100499362 | 100500206 | MMseg939 | 9992 |
| M | 131743800 | 131745450 | 101396017 | 101397733 | MMseg944 | 9993 |
| M | 132278600 | 132280000 | 101855946 | 101857354 | MMseg948 | 9994 |
| M | 132446250 | 132447450 | 102776478 | 102777421 | MMseg950 | 9995 |
| M | 132593250 | 132594900 | 102311063 | 102311634 | MMseg952 | 9996 |
| M | 132614950 | 132616550 | 102339045 | 102340550 | MMseg953 | 9997 |
| M | 132749600 | 132751200 | 102565461 | 102566671 | MMseg956 | 9998 |
| M | 132778000 | 132779550 | 102610275 | 102611320 | MMseg957 | 9999 |
| M | 133200550 | 133202600 | 102862543 | 102864520 | MMseg965 | 10000 |
| M | 133252200 | 133253750 | 102917394 | 102918313 | MMseg967 | 10001 |
| M | 133255450 | 133256950 | 102919433 | 102920854 | MMseg968 | 10002 |
| M | 133422650 | 133424150 | 103097167 | 103098085 | MMseg969 | 10003 |
| M | 133427250 | 133429050 | 103098720 | 103098948 | MMseg970 | 10004 |
| M | 133524100 | 133525100 | 103353886 | 103354572 | MMseg971 | 10005 |
| M | 133526500 | 133528150 | 103355958 | 103357778 | MMseg972 | 10006 |
| M | 133650600 | 133655950 | 103495632 | 103500851 | MMseg976 | 10007 |
| M | 133996300 | 133997600 | 103743455 | 103744895 | MMseg978 | 10008 |
| M | 134056750 | 134057900 | 103771272 | 103775617 | MMseg979 | 10009 |
| M | 134221850 | 134223150 | 103938931 | 103940001 | MMseg980 | 10010 |
| M | 134369750 | 134371200 | 104055433 | 104056038 | MMseg982 | 10011 |
| M | 134785850 | 134787600 | 104532420 | 104532985 | MMseg987 | 10012 |
| M | 135011900 | 135012950 | 104711775 | 104712044 | MMseg989 | 10013 |
| M | 135466650 | 135468200 | 105087702 | 105089227 | MMseg991 | 10014 |
| M | 135535550 | 135537550 | 105193829 | 105196084 | MMseg992 | 10015 |
| M | 136318750 | 136320400 | 106148299 | 106149674 | MMseg996 | 10016 |
| M | 136514200 | 136515550 | 106345421 | 106346746 | MMseg998 | 10017 |
| M | 136568750 | 136570250 | 106410404 | 106411812 | MMseg1000 | 10018 |
| M | 136600400 | 136602000 | 106453320 | 106454986 | MMseg1002 | 10019 |
| M | 136627450 | 136628700 | 106471463 | 106472244 | MMseg1003 | 10020 |
| M | 136630700 | 136632400 | 106475854 | 106477674 | MMseg1004 | 10021 |
| M | 136727100 | 136728350 | 106596842 | 106597598 | MMseg1005 | 10022 |
| M | 136745700 | 136746800 | 106626313 | 106627239 | MMseg1006 | 10023 |
| M | 136794150 | 136795900 | 106677025 | 106678088 | MMseg1007 | 10024 |
| M | 136805700 | 136807600 | 106687753 | 106688404 | MMseg1009 | 10025 |
| M | 136810900 | 136814000 | 106691572 | 106694448 | MMseg1010 | 10026 |
| M | 136887000 | 136888100 | 106758820 | 106761610 | MMseg1011 | 10027 |
| M | 137133700 | 137135950 | 107019244 | 107021093 | MMseg1013 | 10028 |
| M | 137149650 | 137150700 | 107032531 | 107033387 | MMseg1014 | 10029 |
| M | 137168150 | 137169300 | 107036909 | 107037517 | MMseg1015 | 10030 |
| M | 137249050 | 137250750 | 107125059 | 107127384 | MMseg1016 | 10031 |
| M | 137459150 | 137460700 | 107309195 | 107309955 | MMseg1018 | 10032 |
| M | 137509650 | 137511350 | 107360048 | 107361592 | MMseg1019 | 10033 |
| M | 137518150 | 137519300 | 107367247 | 107368380 | MMseg1020 | 10034 |
| M | 137609150 | 137610750 | 107407807 | 107409521 | MMseg1021 | 10035 |
| M | 137661150 | 137662400 | 107455959 | 107457400 | MMseg1022 | 10036 |
| M | 137814550 | 137815750 | 107588053 | 107588914 | MMseg1023 | 10037 |
| M | 137866850 | 137868200 | 107625514 | 107625717 | MMseg1024 | 10038 |
| M | 137909200 | 137910750 | 107682283 | 107683870 | MMseg1025 | 10039 |
| M | 138155550 | 138162100 | 107975275 | 107981988 | MMseg1027 | 10040 |
| M | 138344900 | 138346350 | 108371115 | 108371394 | MMseg1028 | 10041 |
| M | 138497500 | 138499200 | 108595607 | 108599114 | MMseg1030 | 10042 |

TABLE IVB-continued

Mouse Binding Sites with Human Liftovers

| Cell/Day | Mouse | | Human | | Segment | |
|---|---|---|---|---|---|---|
| | Start | end | start | end | name | SEQ ID NO: |
| M | 138577300 | 138578350 | 108684940 | 108685646 | MMseg1031 | 10043 |
| M | 138655950 | 138657600 | 108773752 | 108776368 | MMseg1033 | 10044 |
| M | 138861000 | 138862150 | 109017789 | 109018788 | MMseg1034 | 10045 |
| M | 138943650 | 138945000 | 109104066 | 109104577 | MMseg1035 | 10046 |
| M | 139058150 | 139059900 | 109206160 | 109206963 | MMseg1036 | 10047 |
| M | 139234500 | 139235900 | 109378304 | 109379245 | MMseg1037 | 10048 |
| M | 139316300 | 139317700 | 109463676 | 109465986 | MMseg1038 | 10049 |
| M | 139430050 | 139431350 | 109591776 | 109592916 | MMseg1039 | 10050 |
| M | 139458550 | 139459900 | 109629485 | 109630972 | MMseg1040 | 10051 |
| M | 139635450 | 139636700 | 109879988 | 109880299 | MMseg1041 | 10052 |
| M | 139697400 | 139698650 | 109805172 | 109805516 | MMseg1042 | 10053 |
| M | 139745550 | 139747050 | 109943807 | 109944715 | MMseg1043 | 10054 |
| M | 139987100 | 139988850 | 110226213 | 110228387 | MMseg1044 | 10055 |
| M | 140083250 | 140085000 | 110315590 | 110316674 | MMseg1045 | 10056 |
| M | 140155900 | 140157150 | 110398096 | 110399281 | MMseg1046 | 10057 |
| M | 140262750 | 140264100 | 110514566 | 110515987 | MMseg1047 | 10058 |
| M | 140324750 | 140325800 | 110599252 | 110599767 | MMseg1048 | 10059 |
| M | 141011100 | 141014550 | 111234907 | 111235760 | Mmseg1050 | 10060 |
| M | 141122750 | 141124850 | 111325473 | 111327688 | Mmseg1051 | 10061 |
| M | 141629350 | 141630950 | 111773174 | 111780006 | Mmseg1052 | 10062 |
| M | 141813150 | 141814300 | 111949839 | 111950020 | Mmseg1054 | 10063 |
| M | 142949600 | 142951350 | 113265897 | 113266178 | MMseg1056 | 10064 |
| M | 143325300 | 143326350 | 113762632 | 113762826 | MMseg1058 | 10065 |
| M | 143346200 | 143347600 | 113770324 | 113771336 | MMseg1059 | 10066 |
| M | 143396550 | 143399200 | 113818163 | 113820605 | MMseg1060 | 10067 |
| M | 143828450 | 143829600 | 114247925 | 114249029 | MMseg1062 | 10068 |
| M | 143832100 | 143833150 | 114251373 | 114252988 | MMseg1063 | 10069 |
| M | 143915100 | 143916350 | 114357412 | 114358718 | MMseg1064 | 10070 |
| M | 147004500 | 147006350 | 55033828 | 55036153 | MMseg1067 | 10071 |
| M | 147499650 | 147500750 | 54497893 | 54498387 | MMseg1070 | 10072 |
| M | 147668750 | 147670150 | 54319993 | 54320661 | MMseg1074 | 10073 |
| M | 147998550 | 148000100 | 54028933 | 54029207 | MMseg1075 | 10074 |
| M | 148054700 | 148056250 | 53988742 | 53989670 | MMseg1076 | 10075 |
| M | 148457400 | 148458950 | 53441694 | 53442006 | MMseg1077 | 10076 |
| M | 148511500 | 148512800 | 53393244 | 53394295 | MMseg1078 | 10077 |
| M | 148514600 | 148516600 | 53389862 | 53391858 | MMseg1079 | 10078 |
| M | 148666800 | 148668500 | 53253670 | 53255198 | MMseg1080 | 10079 |
| M | 149107700 | 149109050 | 9857299 | 9859449 | MMseg1085 | 10080 |
| M | 149139800 | 149141150 | 9829894 | 9830916 | MMseg1086 | 10081 |
| M | 149517250 | 149519000 | 55584450 | 55586933 | MMseg1089 | 10082 |
| M | 151469900 | 151471600 | 148630369 | 148630574 | MMseg1102 | 10083 |
| M | 152044650 | 152046100 | 23364640 | 23366242 | MMseg1103 | 10084 |
| M | 152055650 | 152060200 | 23350792 | 23355162 | MMseg1104 | 10085 |
| M | 152070600 | 152071700 | 23340912 | 23342050 | MMseg1105 | 10086 |
| M | 152133950 | 152135050 | 23302181 | 23303309 | MMseg1106 | 10087 |
| M | 152611900 | 152613600 | 22996612 | 22998738 | MMseg1107 | 10088 |
| M | 152708250 | 152709500 | 22922991 | 22924300 | MMseg1108 | 10089 |
| M | 153097150 | 153098600 | 22635976 | 22637590 | MMseg1109 | 10090 |
| M | 153259450 | 153260850 | 22514326 | 22516734 | MMseg1110 | 10091 |
| M | 153310450 | 153311550 | 22476010 | 22476361 | MMseg1112 | 10092 |
| M | 153457200 | 153458500 | 22354781 | 22356450 | MMseg1113 | 10093 |
| M | 153851750 | 153853150 | 22050675 | 22052078 | MMseg1114 | 10094 |
| M | 154266400 | 154267500 | 21664266 | 21665295 | MMseg1115 | 10095 |
| M | 154354450 | 154356600 | 21536146 | 21538465 | MMseg1116 | 10096 |
| M | 154359850 | 154360950 | 21531795 | 21532662 | MMseg1117 | 10097 |
| M | 154478850 | 154482050 | 21391694 | 21395006 | MMseg1118 | 10098 |
| M | 154979800 | 154981450 | 20881821 | 20883114 | MMseg1120 | 10099 |
| M | 155175600 | 155177250 | 20686110 | 20687356 | MMseg1121 | 10100 |
| M | 155592950 | 155594500 | 20380196 | 20381928 | MMseg1123 | 10101 |
| M | 155850850 | 155855650 | 20133359 | 20135681 | MMseg1125 | 10102 |
| M | 155914900 | 155916100 | 20047728 | 20050675 | MMseg1127 | 10103 |
| M | 155947200 | 155948500 | 20014121 | 20014391 | MMseg1128 | 10104 |
| M | 156050800 | 156052150 | 19916475 | 19916777 | MMseg1129 | 10105 |
| M | 156173800 | 156175150 | 19790322 | 19791596 | MMseg1130 | 10106 |
| M | 156332900 | 156334600 | 19632378 | 19633538 | MMseg1131 | 10107 |
| M | 156575900 | 156577400 | 19361539 | 19362523 | MMseg1132 | 10108 |
| M | 156615300 | 156616950 | 19336717 | 19337267 | MMseg1133 | 10109 |
| M | 156915950 | 156917400 | 19028709 | 19030593 | MMseg1134 | 10110 |
| M | 156939550 | 156941000 | 19001813 | 19003365 | MMseg1135 | 10111 |
| M | 157075450 | 157077200 | 18806997 | 18818223 | MMseg1136 | 10112 |
| M | 157082600 | 157084300 | 18797567 | 18799687 | MMseg1137 | 10113 |
| M | 157252000 | 157253500 | 18639528 | 18641140 | MMseg1138 | 10114 |
| M | 157291850 | 157293050 | 18603679 | 18604531 | MMseg1139 | 10115 |
| M | 157732500 | 157734300 | 18240144 | 18240870 | MMseg1142 | 10116 |

TABLE IVB-continued

Mouse Binding Sites with Human Liftovers

| Cell/Day | Mouse Start | Mouse end | Human start | Human end | Segment name | SEQ ID NO: |
|---|---|---|---|---|---|---|
| M | 157974800 | 157976550 | 18021746 | 18023162 | MMseg1143 | 10117 |
| M | 158154450 | 158157550 | 17876984 | 17879845 | MMseg1144 | 10118 |
| M | 158259100 | 158260650 | 17766275 | 17767756 | MMseg1145 | 10119 |
| M | 158345350 | 158347650 | 17672974 | 17675261 | MMseg1146 | 10120 |
| M | 158379950 | 158381000 | 17632722 | 17634330 | MMseg1147 | 10121 |
| M | 158599200 | 158600700 | 17390657 | 17392078 | MMseg1148 | 10122 |
| M | 158720550 | 158721550 | 17257216 | 17257769 | MMseg1150 | 10123 |
| M | 158851550 | 158852850 | 17168374 | 17169701 | MMseg1151 | 10124 |
| M | 158949900 | 158951400 | 17087437 | 17088674 | MMseg1153 | 10125 |
| M | 158959950 | 158961350 | 17070128 | 17071066 | MMseg1154 | 10126 |
| M | 159080250 | 159082650 | 16963853 | 16966209 | MMseg1156 | 10127 |
| M | 159203550 | 159205400 | 16883371 | 16884266 | MMseg1157 | 10128 |
| M | 159235100 | 159236450 | 16846153 | 16846456 | MMseg1158 | 10129 |
| M | 159319550 | 159321300 | 16753321 | 16754454 | MMseg1159 | 10130 |
| M | 159776150 | 159777650 | 16314342 | 16314768 | MMseg1161 | 10131 |
| M | 160001250 | 160002400 | 16130429 | 16131585 | MMseg1162 | 10132 |
| M | 160115400 | 160116950 | 16030242 | 16031393 | MMseg1163 | 10133 |
| M | 160365250 | 160367100 | 15848626 | 15850676 | MMseg1167 | 10134 |
| M | 160861100 | 160862850 | 15347026 | 15349529 | MMseg1169 | 10135 |
| M | 161072900 | 161074050 | 15189814 | 15190425 | MMseg1170 | 10136 |
| M | 161227600 | 161229100 | 15093224 | 15094638 | MMseg1171 | 10137 |
| M | 161323850 | 161324950 | 14993608 | 14994082 | MMseg1172 | 10138 |
| M | 161357200 | 161358200 | 14950467 | 14951475 | MMseg1173 | 10139 |
| M | 161419650 | 161421200 | 14882869 | 14883777 | MMseg1174 | 10140 |
| M | 161572150 | 161573150 | 14745213 | 14745814 | MMseg1176 | 10141 |
| M | 161921600 | 161922900 | 14448856 | 14449148 | MMseg1178 | 10142 |
| M | 162336100 | 162337150 | 14235632 | 14237829 | MMseg1179 | 10143 |
| M | 162434450 | 162435850 | 14163737 | 14164131 | MMseg1180 | 10144 |
| M | 162676200 | 162678100 | 13955587 | 13957519 | MMseg1181 | 10145 |
| M | 162717750 | 162718800 | 13915314 | 13916110 | MMseg1182 | 10146 |
| M | 163433400 | 163434550 | 13221669 | 13222560 | MMseg1184 | 10147 |
| M | 163630900 | 163632050 | 13007637 | 13008082 | MMseg1185 | 10148 |
| M | 163647200 | 163648550 | 12991689 | 12993122 | MMseg1186 | 10149 |
| M | 163730600 | 163731650 | 12909774 | 12910724 | MMseg1187 | 10150 |
| M | 163748650 | 163750400 | 12902034 | 12902693 | MMseg1188 | 10151 |
| M | 163819450 | 163820450 | 12809689 | 12810746 | MMseg1189 | 10152 |
| M | 163923300 | 163924500 | 12729068 | 12729246 | MMseg1190 | 10153 |
| M | 164201450 | 164202450 | 12484206 | 12484349 | MMseg1192 | 10154 |
| M | 164366800 | 164368400 | 12329590 | 12331008 | MMseg1193 | 10155 |
| M | 164471750 | 164472800 | 12238770 | 12240904 | MMseg1195 | 10156 |
| M | 164583450 | 164585100 | 12138301 | 12139476 | MMseg1197 | 10157 |
| M | 164589550 | 164590900 | 12134109 | 12134814 | MMseg1198 | 10158 |
| M | 164746300 | 164747750 | 12011972 | 12013034 | MMseg1199 | 10159 |
| M | 164964150 | 164965600 | 11881888 | 11882967 | MMseg1200 | 10160 |
| M | 165094850 | 165096750 | 11790174 | 11790869 | MMseg1201 | 10161 |
| M | 165232550 | 165235100 | 11681898 | 11684654 | MMseg1202 | 10162 |
| M | 165245650 | 165247050 | 11670574 | 11671232 | MMseg1203 | 10163 |
| M | 165283100 | 165284700 | 11636638 | 11638291 | MMseg1204 | 10164 |
| M | 165377800 | 165379300 | 11544817 | 11547072 | MMseg1205 | 10165 |
| M | 165445000 | 165446600 | 11469150 | 11471127 | MMseg1207 | 10166 |
| M | 165690100 | 165691550 | 11200197 | 11202213 | MMseg1210 | 10167 |
| M | 166306750 | 166308500 | 10599802 | 10602471 | MMseg1211 | 10168 |

For Table JVC: c/d: cell/day; 0, day 0 ES cells; 7, day 7 ES cells; M, MEF cells. These sites did not have human liftovers sequences corresponding to the empirically identified mouse binding sites.

TABLE IVC

Mouse Moderate Sites

| c/d | start | end | segment |
|---|---|---|---|
| 0 | 3013250 | 3014900 | d0Mseg1 |
| 0 | 3040500 | 3042200 | d0Mseg2 |
| 0 | 3199600 | 3201300 | d0Mseg3 |
| 0 | 3888800 | 3890200 | d0Mseg4 |
| 0 | 4299550 | 4301150 | d0Mseg5 |
| 0 | 4864500 | 4865900 | d0Mseg6 |
| 0 | 5043950 | 5046250 | d0Mseg7 |
| 0 | 5156500 | 5158150 | d0Mseg8 |
| 0 | 5243750 | 5245500 | d0Mseg9 |
| 0 | 5280750 | 5282600 | d0Mseg10 |
| 0 | 5365800 | 5367250 | d0Mseg11 |
| 0 | 5548600 | 5550350 | d0Mseg13 |
| 0 | 5557950 | 5559800 | d0Mseg14 |
| 0 | 6129350 | 6130550 | d0Mseg19 |
| 0 | 6189300 | 6190350 | d0Mseg20 |
| 0 | 7598600 | 7600450 | d0Mseg35 |
| 0 | 7656650 | 7658100 | d0Mseg36 |
| 0 | 7892450 | 7894150 | d0Mseg37 |

TABLE IVC-continued

Mouse Moderate Sites

| c/d | start | end | segment |
|---|---|---|---|
| 0 | 8153500 | 8154650 | d0Mseg38 |
| 0 | 8274000 | 8275850 | d0Mseg39 |
| 0 | 8468900 | 8470750 | d0Mseg40 |
| 0 | 8514150 | 8516000 | d0Mseg41 |
| 0 | 8572300 | 8573950 | d0Mseg42 |
| 0 | 8665550 | 8667200 | d0Mseg43 |
| 0 | 9129150 | 9130900 | d0Mseg47 |
| 0 | 9169600 | 9171000 | d0Mseg48 |
| 0 | 9600200 | 9602000 | d0Mseg49 |
| 0 | 9654550 | 9656200 | d0Mseg52 |
| 0 | 10265600 | 10267300 | d0Mseg61 |
| 0 | 11349600 | 11351300 | d0Mseg72 |
| 0 | 12219450 | 12220600 | d0Mseg90 |
| 0 | 12441150 | 12442800 | d0Mseg91 |
| 0 | 12966750 | 12968350 | d0Mseg92 |
| 0 | 13991600 | 13993200 | d0Mseg102 |
| 0 | 14101700 | 14103350 | d0Mseg103 |
| 0 | 14494250 | 14496000 | d0Mseg106 |
| 0 | 14735800 | 14737450 | d0Mseg108 |
| 0 | 14938450 | 14939950 | d0Mseg112 |
| 0 | 15005250 | 15006800 | d0Mseg113 |
| 0 | 15180550 | 15182200 | d0Mseg114 |
| 0 | 15539300 | 15541050 | d0Mseg117 |
| 0 | 16907700 | 16909450 | d0Mseg123 |
| 0 | 16933400 | 16935050 | d0Mseg124 |
| 0 | 18051250 | 18052650 | d0Mseg128 |
| 0 | 18099850 | 18101600 | d0Mseg129 |
| 0 | 18127350 | 18128500 | d0Mseg130 |
| 0 | 18326150 | 18327150 | d0Mseg131 |
| 0 | 18349150 | 18350600 | d0Mseg132 |
| 0 | 18380000 | 18381700 | d0Mseg133 |
| 0 | 18525150 | 18526200 | d0Mseg134 |
| 0 | 18588750 | 18590450 | d0Mseg135 |
| 0 | 18698450 | 18700250 | d0Mseg136 |
| 0 | 18705600 | 18706950 | d0Mseg137 |
| 0 | 18946750 | 18948350 | d0Mseg139 |
| 0 | 19045350 | 19047000 | d0Mseg141 |
| 0 | 19180550 | 19182250 | d0Mseg142 |
| 0 | 19225150 | 19226900 | d0Mseg143 |
| 0 | 19584700 | 19586600 | d0Mseg145 |
| 0 | 19612750 | 19614150 | d0Mseg146 |
| 0 | 19729650 | 19731250 | d0Mseg148 |
| 0 | 19896650 | 19898550 | d0Mseg150 |
| 0 | 20768800 | 20769850 | d0Mseg153 |
| 0 | 20937650 | 20940750 | d0Mseg154 |
| 0 | 21048500 | 21050250 | d0Mseg155 |
| 0 | 21388750 | 21390350 | d0Mseg159 |
| 0 | 21695650 | 21697500 | d0Mseg160 |
| 0 | 21731400 | 21733200 | d0Mseg161 |
| 0 | 21795550 | 21797450 | d0Mseg162 |
| 0 | 21915400 | 21917000 | d0Mseg164 |
| 0 | 21966550 | 21968200 | d0Mseg165 |
| 0 | 22058700 | 22060400 | d0Mseg166 |
| 0 | 22102100 | 22103850 | d0Mseg167 |
| 0 | 22222300 | 22223750 | d0Mseg172 |
| 0 | 23200050 | 23201850 | d0Mseg181 |
| 0 | 23833750 | 23835150 | d0Mseg184 |
| 0 | 23920150 | 23921750 | d0Mseg185 |
| 0 | 24065850 | 24067450 | d0Mseg186 |
| 0 | 24196000 | 24197650 | d0Mseg187 |
| 0 | 25178800 | 25179900 | d0Mseg188 |
| 0 | 25182350 | 25184100 | d0Mseg189 |
| 0 | 25237450 | 25239050 | d0Mseg190 |
| 0 | 25965050 | 25966450 | d0Mseg191 |
| 0 | 25997800 | 25999650 | d0Mseg192 |
| 0 | 26155850 | 26157700 | d0Mseg193 |
| 0 | 27398150 | 27399800 | d0Mseg194 |
| 0 | 30557050 | 30558950 | d0Mseg195 |
| 0 | 30626550 | 30628300 | d0Mseg196 |
| 0 | 32060900 | 32062500 | d0Mseg197 |
| 0 | 33110450 | 33111650 | d0Mseg198 |
| 0 | 33635000 | 33636550 | d0Mseg199 |
| 0 | 33945750 | 33947550 | d0Mseg202 |
| 0 | 34161650 | 34163250 | d0Mseg203 |
| 0 | 34449850 | 34451650 | d0Mseg205 |
| 0 | 34547150 | 34549000 | d0Mseg207 |
| 0 | 34703150 | 34704450 | d0Mseg210 |
| 0 | 34754750 | 34758750 | d0Mseg211 |
| 0 | 34840000 | 34841700 | d0Mseg212 |
| 0 | 34927800 | 34929000 | d0Mseg213 |
| 0 | 34999550 | 35001250 | d0Mseg214 |
| 0 | 35011550 | 35013300 | d0Mseg215 |
| 0 | 35074650 | 35076350 | d0Mseg216 |
| 0 | 35167550 | 35169200 | d0Mseg217 |
| 0 | 35253900 | 35255850 | d0Mseg218 |
| 0 | 35273000 | 35274700 | d0Mseg219 |
| 0 | 35533100 | 35535000 | d0Mseg220 |
| 0 | 36097300 | 36098550 | d0Mseg229 |
| 0 | 36243100 | 36244800 | d0Mseg231 |
| 0 | 36272000 | 36273000 | d0Mseg232 |
| 0 | 36331400 | 36332450 | d0Mseg233 |
| 0 | 36363600 | 36365350 | d0Mseg234 |
| 0 | 36428650 | 36430300 | d0Mseg235 |
| 0 | 36697800 | 36699550 | d0Mseg237 |
| 0 | 37126800 | 37128500 | d0Mseg239 |
| 0 | 37220600 | 37222150 | d0Mseg240 |
| 0 | 37754100 | 37756000 | d0Mseg241 |
| 0 | 37808500 | 37810100 | d0Mseg243 |
| 0 | 37893300 | 37894950 | d0Mseg245 |
| 0 | 38033100 | 38034650 | d0Mseg246 |
| 0 | 38153950 | 38155650 | d0Mseg247 |
| 0 | 38268000 | 38269650 | d0Mseg248 |
| 0 | 38427700 | 38429500 | d0Mseg249 |
| 0 | 38451300 | 38453000 | d0Mseg250 |
| 0 | 38549550 | 38551200 | d0Mseg252 |
| 0 | 39290250 | 39291450 | d0Mseg258 |
| 0 | 39392900 | 39394600 | d0Mseg260 |
| 0 | 39490350 | 39492000 | d0Mseg261 |
| 0 | 39682450 | 39684100 | d0Mseg264 |
| 0 | 40276600 | 40278350 | d0Mseg273 |
| 0 | 40562500 | 40564300 | d0Mseg277 |
| 0 | 40765100 | 40766850 | d0Mseg278 |
| 0 | 41442300 | 41444150 | d0Mseg286 |
| 0 | 41556450 | 41558050 | d0Mseg288 |
| 0 | 41780950 | 41782300 | d0Mseg290 |
| 0 | 41889350 | 41891000 | d0Mseg291 |
| 0 | 41971850 | 41973650 | d0Mseg292 |
| 0 | 41976150 | 41977200 | d0Mseg293 |
| 0 | 42412450 | 42414150 | d0Mseg294 |
| 0 | 42839400 | 42841100 | d0Mseg295 |
| 0 | 42886550 | 42888200 | d0Mseg296 |
| 0 | 42916700 | 42918400 | d0Mseg297 |
| 0 | 43051500 | 43052900 | d0Mseg298 |
| 0 | 43144850 | 43146550 | d0Mseg299 |
| 0 | 43152750 | 43154600 | d0Mseg300 |
| 0 | 43214150 | 43215250 | d0Mseg301 |
| 0 | 43569750 | 43571350 | d0Mseg302 |
| 0 | 43666950 | 43668750 | d0Mseg303 |
| 0 | 43689450 | 43691150 | d0Mseg304 |
| 0 | 43784050 | 43785800 | d0Mseg305 |
| 0 | 43971000 | 43972900 | d0Mseg307 |
| 0 | 43980600 | 43982400 | d0Mseg308 |
| 0 | 44065700 | 44067250 | d0Mseg309 |
| 0 | 44279100 | 44280750 | d0Mseg310 |
| 0 | 44987050 | 44988900 | d0Mseg317 |
| 0 | 45953400 | 45955000 | d0Mseg326 |
| 0 | 46107500 | 46109150 | d0Mseg327 |
| 0 | 46152600 | 46154350 | d0Mseg329 |
| 0 | 46451250 | 46453300 | d0Mseg333 |
| 0 | 46468750 | 46470500 | d0Mseg334 |
| 0 | 46499600 | 46501300 | d0Mseg335 |
| 0 | 46683350 | 46684350 | d0Mseg336 |
| 0 | 46774000 | 46775700 | d0Mseg337 |
| 0 | 46911200 | 46912900 | d0Mseg344 |
| 0 | 47334200 | 47335900 | d0Mseg351 |
| 0 | 47348150 | 47349900 | d0Mseg352 |
| 0 | 47725700 | 47728350 | d0Mseg354 |
| 0 | 47894500 | 47896200 | d0Mseg355 |
| 0 | 47991050 | 47992300 | d0Mseg356 |
| 0 | 48382050 | 48383500 | d0Mseg360 |
| 0 | 49215000 | 49216800 | d0Mseg371 |
| 0 | 49325650 | 49327300 | d0Mseg372 |

TABLE IVC-continued

Mouse Moderate Sites

| c/d | start | end | segment |
|---|---|---|---|
| 0 | 50042400 | 50043500 | d0Mseg379 |
| 0 | 50203300 | 50206100 | d0Mseg382 |
| 0 | 50250650 | 50252450 | d0Mseg383 |
| 0 | 50623900 | 50625700 | d0Mseg388 |
| 0 | 50727600 | 50729500 | d0Mseg390 |
| 0 | 50782000 | 50783700 | d0Mseg391 |
| 0 | 50809750 | 50810950 | d0Mseg392 |
| 0 | 50926250 | 50928200 | d0Mseg393 |
| 0 | 50937400 | 50939200 | d0Mseg394 |
| 0 | 51007100 | 51008750 | d0Mseg395 |
| 0 | 51075300 | 51080100 | d0Mseg397 |
| 0 | 51094900 | 51096750 | d0Mseg398 |
| 0 | 51124650 | 51126300 | d0Mseg399 |
| 0 | 51185500 | 51187350 | d0Mseg400 |
| 0 | 51276800 | 51281250 | d0Mseg401 |
| 0 | 51291900 | 51293600 | d0Mseg402 |
| 0 | 51408950 | 51410550 | d0Mseg403 |
| 0 | 51546600 | 51548350 | d0Mseg404 |
| 0 | 52539900 | 52541600 | d0Mseg405 |
| 0 | 52681550 | 52683150 | d0Mseg406 |
| 0 | 52756550 | 52758300 | d0Mseg407 |
| 0 | 52760800 | 52762650 | d0Mseg408 |
| 0 | 52825900 | 52827150 | d0Mseg409 |
| 0 | 52951300 | 52953000 | d0Mseg410 |
| 0 | 53077650 | 53079250 | d0Mseg411 |
| 0 | 53181550 | 53182550 | d0Mseg412 |
| 0 | 53201550 | 53203300 | d0Mseg413 |
| 0 | 53355200 | 53357250 | d0Mseg414 |
| 0 | 53783450 | 53785150 | d0Mseg416 |
| 0 | 55102050 | 55103050 | d0Mseg427 |
| 0 | 55258100 | 55259800 | d0Mseg429 |
| 0 | 55322800 | 55324500 | d0Mseg431 |
| 0 | 55453850 | 55455650 | d0Mseg432 |
| 0 | 56609400 | 56610950 | d0Mseg444 |
| 0 | 57133200 | 57136250 | d0Mseg450 |
| 0 | 57670200 | 57671950 | d0Mseg456 |
| 0 | 58108800 | 58110500 | d0Mseg462 |
| 0 | 58437300 | 58439000 | d0Mseg466 |
| 0 | 58580850 | 58582300 | d0Mseg467 |
| 0 | 58951850 | 58952950 | d0Mseg470 |
| 0 | 59288200 | 59289850 | d0Mseg473 |
| 0 | 59516900 | 59518800 | d0Mseg476 |
| 0 | 59522850 | 59524500 | d0Mseg477 |
| 0 | 59602250 | 59603600 | d0Mseg478 |
| 0 | 59640650 | 59642600 | d0Mseg479 |
| 0 | 59840600 | 59842450 | d0Mseg480 |
| 0 | 59877800 | 59879600 | d0Mseg481 |
| 0 | 59949400 | 59951400 | d0Mseg482 |
| 0 | 59992700 | 59994400 | d0Mseg483 |
| 0 | 60058250 | 60060100 | d0Mseg484 |
| 0 | 60265700 | 60267300 | d0Mseg486 |
| 0 | 60360500 | 60362250 | d0Mseg487 |
| 0 | 60389700 | 60391350 | d0Mseg488 |
| 0 | 60425250 | 60426950 | d0Mseg489 |
| 0 | 60531700 | 60533350 | d0Mseg490 |
| 0 | 60613450 | 60615300 | d0Mseg491 |
| 0 | 60756100 | 60757800 | d0Mseg493 |
| 0 | 60776250 | 60777950 | d0Mseg494 |
| 0 | 60900650 | 60902100 | d0Mseg495 |
| 0 | 60921800 | 60923550 | d0Mseg496 |
| 0 | 61005150 | 61006750 | d0Mseg497 |
| 0 | 61024750 | 61026500 | d0Mseg499 |
| 0 | 61144100 | 61145650 | d0Mseg500 |
| 0 | 61305700 | 61307400 | d0Mseg502 |
| 0 | 61787100 | 61788700 | d0Mseg504 |
| 0 | 62017400 | 62018450 | d0Mseg506 |
| 0 | 62119600 | 62121100 | d0Mseg507 |
| 0 | 62229900 | 62231500 | d0Mseg508 |
| 0 | 62272100 | 62273300 | d0Mseg509 |
| 0 | 62310850 | 62312200 | d0Mseg510 |
| 0 | 62346700 | 62348300 | d0Mseg512 |
| 0 | 62443800 | 62445600 | d0Mseg513 |
| 0 | 62626900 | 62628700 | d0Mseg514 |
| 0 | 63125250 | 63126400 | d0Mseg518 |
| 0 | 63147950 | 63149600 | d0Mseg519 |
| 0 | 63180600 | 63182250 | d0Mseg520 |
| 0 | 63305150 | 63306900 | d0Mseg521 |
| 0 | 63313750 | 63315550 | d0Mseg522 |
| 0 | 63465550 | 63467300 | d0Mseg524 |
| 0 | 63480800 | 63482350 | d0Mseg525 |
| 0 | 63500200 | 63501950 | d0Mseg526 |
| 0 | 63788250 | 63789850 | d0Mseg529 |
| 0 | 64122350 | 64123950 | d0Mseg532 |
| 0 | 64222650 | 64224400 | d0Mseg535 |
| 0 | 64545950 | 64547100 | d0Mseg536 |
| 0 | 64758250 | 64759950 | d0Mseg537 |
| 0 | 64815850 | 64817600 | d0Mseg538 |
| 0 | 64947250 | 64948850 | d0Mseg540 |
| 0 | 65108800 | 65110550 | d0Mseg542 |
| 0 | 65195350 | 65196400 | d0Mseg544 |
| 0 | 65306400 | 65308150 | d0Mseg545 |
| 0 | 65420550 | 65422200 | d0Mseg547 |
| 0 | 65457400 | 65459200 | d0Mseg548 |
| 0 | 65636550 | 65638450 | d0Mseg550 |
| 0 | 66062150 | 66063950 | d0Mseg552 |
| 0 | 66329550 | 66331500 | d0Mseg556 |
| 0 | 66502450 | 66504500 | d0Mseg557 |
| 0 | 67191500 | 67193150 | d0Mseg567 |
| 0 | 67382350 | 67384050 | d0Mseg569 |
| 0 | 67761400 | 67763200 | d0Mseg571 |
| 0 | 68225650 | 68227450 | d0Mseg574 |
| 0 | 68443350 | 68444800 | d0Mseg578 |
| 0 | 68581500 | 68583200 | d0Mseg579 |
| 0 | 68715750 | 68717450 | d0Mseg580 |
| 0 | 68892300 | 68893500 | d0Mseg581 |
| 0 | 68924800 | 68926650 | d0Mseg583 |
| 0 | 68933900 | 68935650 | d0Mseg584 |
| 0 | 69636950 | 69638700 | d0Mseg590 |
| 0 | 69769550 | 69771250 | d0Mseg591 |
| 0 | 70302000 | 70303900 | d0Mseg593 |
| 0 | 70340800 | 70342250 | d0Mseg594 |
| 0 | 70406500 | 70408450 | d0Mseg595 |
| 0 | 70456600 | 70457800 | d0Mseg596 |
| 0 | 70617550 | 70619400 | d0Mseg597 |
| 0 | 71416350 | 71418100 | d0Mseg606 |
| 0 | 71439900 | 71441500 | d0Mseg607 |
| 0 | 71717150 | 71718900 | d0Mseg610 |
| 0 | 71732200 | 71733900 | d0Mseg611 |
| 0 | 71766550 | 71768550 | d0Mseg612 |
| 0 | 71772050 | 71773900 | d0Mseg613 |
| 0 | 72261750 | 72263350 | d0Mseg614 |
| 0 | 72319900 | 72321600 | d0Mseg615 |
| 0 | 72719800 | 72721500 | d0Mseg617 |
| 0 | 72791900 | 72793650 | d0Mseg618 |
| 0 | 72979050 | 72980550 | d0Mseg619 |
| 0 | 73026250 | 73027900 | d0Mseg620 |
| 0 | 73168900 | 73170500 | d0Mseg621 |
| 0 | 73205500 | 73207200 | d0Mseg622 |
| 0 | 73209450 | 73210700 | d0Mseg623 |
| 0 | 73214300 | 73216200 | d0Mseg624 |
| 0 | 73395450 | 73396850 | d0Mseg626 |
| 0 | 73814500 | 73816250 | d0Mseg628 |
| 0 | 73985200 | 73986950 | d0Mseg630 |
| 0 | 74090600 | 74092300 | d0Mseg631 |
| 0 | 74099000 | 74100650 | d0Mseg632 |
| 0 | 74254350 | 74255850 | d0Mseg634 |
| 0 | 74383200 | 74384900 | d0Mseg636 |
| 0 | 74388350 | 74390050 | d0Mseg637 |
| 0 | 74422450 | 74424050 | d0Mseg638 |
| 0 | 74950550 | 74952500 | d0Mseg642 |
| 0 | 74989200 | 74991000 | d0Mseg643 |
| 0 | 75264800 | 75266500 | d0Mseg644 |
| 0 | 75302750 | 75304800 | d0Mseg645 |
| 0 | 75343350 | 75345300 | d0Mseg646 |
| 0 | 75503350 | 75505000 | d0Mseg647 |
| 0 | 75876500 | 75878100 | d0Mseg649 |
| 0 | 76059750 | 76061450 | d0Mseg650 |
| 0 | 76099950 | 76102350 | d0Mseg651 |
| 0 | 76774750 | 76776700 | d0Mseg657 |
| 0 | 76972550 | 76973900 | d0Mseg659 |
| 0 | 77056000 | 77057750 | d0Mseg660 |
| 0 | 77238250 | 77239850 | d0Mseg661 |

TABLE IVC-continued

Mouse Moderate Sites

| c/d | start | end | segment |
|---|---|---|---|
| 0 | 77280800 | 77282500 | d0Mseg662 |
| 0 | 77413950 | 77415650 | d0Mseg663 |
| 0 | 77477200 | 77479100 | d0Mseg664 |
| 0 | 77630850 | 77632150 | d0Mseg666 |
| 0 | 77648800 | 77650550 | d0Mseg667 |
| 0 | 77713150 | 77714800 | d0Mseg669 |
| 0 | 77795650 | 77797250 | d0Mseg670 |
| 0 | 77836600 | 77838250 | d0Mseg671 |
| 0 | 78041500 | 78042800 | d0Mseg672 |
| 0 | 78410650 | 78412350 | d0Mseg673 |
| 0 | 78415050 | 78416650 | d0Mseg674 |
| 0 | 78677450 | 78679000 | d0Mseg675 |
| 0 | 78723050 | 78724800 | d0Mseg676 |
| 0 | 78727050 | 78728050 | d0Mseg677 |
| 0 | 78814000 | 78815700 | d0Mseg679 |
| 0 | 78817450 | 78819400 | d0Mseg680 |
| 0 | 78826850 | 78828450 | d0Mseg681 |
| 0 | 79118850 | 79120500 | d0Mseg683 |
| 0 | 79307350 | 79309100 | d0Mseg685 |
| 0 | 79320650 | 79322350 | d0Mseg686 |
| 0 | 79333950 | 79335550 | d0Mseg687 |
| 0 | 79367850 | 79369450 | d0Mseg688 |
| 0 | 79413200 | 79414800 | d0Mseg689 |
| 0 | 79439900 | 79441550 | d0Mseg690 |
| 0 | 79505600 | 79507350 | d0Mseg691 |
| 0 | 79537450 | 79539250 | d0Mseg692 |
| 0 | 79682500 | 79684150 | d0Mseg694 |
| 0 | 79810850 | 79812850 | d0Mseg695 |
| 0 | 79876400 | 79878050 | d0Mseg697 |
| 0 | 80343250 | 80344500 | d0Mseg700 |
| 0 | 80478750 | 80480500 | d0Mseg701 |
| 0 | 80586950 | 80588350 | d0Mseg702 |
| 0 | 80859950 | 80861650 | d0Mseg703 |
| 0 | 82754950 | 82756550 | d0Mseg716 |
| 0 | 83059750 | 83060800 | d0Mseg719 |
| 0 | 83585800 | 83587900 | d0Mseg723 |
| 0 | 83604000 | 83605800 | d0Mseg724 |
| 0 | 83659000 | 83660750 | d0Mseg725 |
| 0 | 83681100 | 83682650 | d0Mseg727 |
| 0 | 83737900 | 83739700 | d0Mseg728 |
| 0 | 83875350 | 83877050 | d0Mseg729 |
| 0 | 83906200 | 83907650 | d0Mseg730 |
| 0 | 84393250 | 84394900 | d0Mseg737 |
| 0 | 85048800 | 85050500 | d0Mseg746 |
| 0 | 85486100 | 85487750 | d0Mseg754 |
| 0 | 85591450 | 85592850 | d0Mseg755 |
| 0 | 85738950 | 85740600 | d0Mseg756 |
| 0 | 85852450 | 85853600 | d0Mseg758 |
| 0 | 85965200 | 85969050 | d0Mseg759 |
| 0 | 86021850 | 86023500 | d0Mseg760 |
| 0 | 86380450 | 86382050 | d0Mseg761 |
| 0 | 86796950 | 86798800 | d0Mseg764 |
| 0 | 86831250 | 86832900 | d0Mseg765 |
| 0 | 87010550 | 87012150 | d0Mseg768 |
| 0 | 87068300 | 87069850 | d0Mseg769 |
| 0 | 87112450 | 87114100 | d0Mseg770 |
| 0 | 87268250 | 87270000 | d0Mseg772 |
| 0 | 87454700 | 87456000 | d0Mseg773 |
| 0 | 87649100 | 87650300 | d0Mseg775 |
| 0 | 87694300 | 87696050 | d0Mseg776 |
| 0 | 87708500 | 87710300 | d0Mseg777 |
| 0 | 87783600 | 87785350 | d0Mseg779 |
| 0 | 87856000 | 87857700 | d0Mseg780 |
| 0 | 87874500 | 87876200 | d0Mseg781 |
| 0 | 87996150 | 87997750 | d0Mseg783 |
| 0 | 88041950 | 88042950 | d0Mseg784 |
| 0 | 88141300 | 88142900 | d0Mseg785 |
| 0 | 88269800 | 88272300 | d0Mseg787 |
| 0 | 88301600 | 88303450 | d0Mseg788 |
| 0 | 88322200 | 88324100 | d0Mseg789 |
| 0 | 88387200 | 88388850 | d0Mseg790 |
| 0 | 88437450 | 88439050 | d0Mseg791 |
| 0 | 88457250 | 88459100 | d0Mseg792 |
| 0 | 88538350 | 88539950 | d0Mseg793 |
| 0 | 88656750 | 88657950 | d0Mseg794 |
| 0 | 88669850 | 88670850 | d0Mseg795 |
| 0 | 88763350 | 88764550 | d0Mseg796 |
| 0 | 88986100 | 88987700 | d0Mseg797 |
| 0 | 89117600 | 89119300 | d0Mseg798 |
| 0 | 89128400 | 89130050 | d0Mseg799 |
| 0 | 89440850 | 89442550 | d0Mseg801 |
| 0 | 89487850 | 89489250 | d0Mseg803 |
| 0 | 89600550 | 89602250 | d0Mseg804 |
| 0 | 89838800 | 89840450 | d0Mseg808 |
| 0 | 90230650 | 90233850 | d0Mseg810 |
| 0 | 90336850 | 90337850 | d0Mseg813 |
| 0 | 91224550 | 91226300 | d0Mseg817 |
| 0 | 91739800 | 91740800 | d0Mseg822 |
| 0 | 91793300 | 91795350 | d0Mseg823 |
| 0 | 92015650 | 92017400 | d0Mseg825 |
| 0 | 92019050 | 92022950 | d0Mseg826 |
| 0 | 92030050 | 92031750 | d0Mseg827 |
| 0 | 92036200 | 92038050 | d0Mseg828 |
| 0 | 92531400 | 92533100 | d0Mseg829 |
| 0 | 92699450 | 92701050 | d0Mseg831 |
| 0 | 92820250 | 92821950 | d0Mseg833 |
| 0 | 92937550 | 92939400 | d0Mseg835 |
| 0 | 93183200 | 93184850 | d0Mseg837 |
| 0 | 93261400 | 93263050 | d0Mseg838 |
| 0 | 93276700 | 93278350 | d0Mseg839 |
| 0 | 93482500 | 93484200 | d0Mseg840 |
| 0 | 93841300 | 93843000 | d0Mseg842 |
| 0 | 93858250 | 93860050 | d0Mseg843 |
| 0 | 93898000 | 93899900 | d0Mseg844 |
| 0 | 93976800 | 93978600 | d0Mseg846 |
| 0 | 94103700 | 94105300 | d0Mseg847 |
| 0 | 94138750 | 94140600 | d0Mseg848 |
| 0 | 94255700 | 94257350 | d0Mseg849 |
| 0 | 94259300 | 94261000 | d0Mseg850 |
| 0 | 94462750 | 94465550 | d0Mseg851 |
| 0 | 94468300 | 94470000 | d0Mseg852 |
| 0 | 94794950 | 94796450 | d0Mseg855 |
| 0 | 94871900 | 94873450 | d0Mseg858 |
| 0 | 95011000 | 95012600 | d0Mseg859 |
| 0 | 95045450 | 95046600 | d0Mseg860 |
| 0 | 95092700 | 95094750 | d0Mseg861 |
| 0 | 95111300 | 95113000 | d0Mseg862 |
| 0 | 95237850 | 95239550 | d0Mseg863 |
| 0 | 95277100 | 95279100 | d0Mseg864 |
| 0 | 95592350 | 95594050 | d0Mseg866 |
| 0 | 95671550 | 95673300 | d0Mseg867 |
| 0 | 95742400 | 95744100 | d0Mseg868 |
| 0 | 96175600 | 96177300 | d0Mseg871 |
| 0 | 96318100 | 96320200 | d0Mseg874 |
| 0 | 96537000 | 96538650 | d0Mseg882 |
| 0 | 96884250 | 96886000 | d0Mseg892 |
| 0 | 97941450 | 97943400 | d0Mseg899 |
| 0 | 98205400 | 98207250 | d0Mseg903 |
| 0 | 98221150 | 98222900 | d0Mseg904 |
| 0 | 98253750 | 98255900 | d0Mseg905 |
| 0 | 98305100 | 98306300 | d0Mseg906 |
| 0 | 99019450 | 99021350 | d0Mseg917 |
| 0 | 99116900 | 99118450 | d0Mseg923 |
| 0 | 99331900 | 99333350 | d0Mseg927 |
| 0 | 99376000 | 99377650 | d0Mseg928 |
| 0 | 100151300 | 100153200 | d0Mseg937 |
| 0 | 100359350 | 100360850 | d0Mseg938 |
| 0 | 100466650 | 100468450 | d0Mseg940 |
| 0 | 100679700 | 100681700 | d0Mseg942 |
| 0 | 100686100 | 100689200 | d0Mseg943 |
| 0 | 100707400 | 100708650 | d0Mseg944 |
| 0 | 100721700 | 100723700 | d0Mseg945 |
| 0 | 100957950 | 100959550 | d0Mseg952 |
| 0 | 101059500 | 101061600 | d0Mseg955 |
| 0 | 101098850 | 101100650 | d0Mseg957 |
| 0 | 101221650 | 101222800 | d0Mseg958 |
| 0 | 101257400 | 101258550 | d0Mseg959 |
| 0 | 101267550 | 101269250 | d0Mseg960 |
| 0 | 101627600 | 101629250 | d0Mseg963 |
| 0 | 101795650 | 101797350 | d0Mseg965 |
| 0 | 101906600 | 101907600 | d0Mseg966 |
| 0 | 102103500 | 102105200 | d0Mseg970 |

TABLE IVC-continued

Mouse Moderate Sites

| c/d | start | end | segment |
|---|---|---|---|
| 0 | 102214950 | 102217750 | d0Mseg971 |
| 0 | 102377950 | 102379550 | d0Mseg974 |
| 0 | 102401700 | 102402700 | d0Mseg975 |
| 0 | 102729050 | 102730850 | d0Mseg977 |
| 0 | 102951750 | 102953500 | d0Mseg978 |
| 0 | 103354300 | 103355650 | d0Mseg981 |
| 0 | 103375500 | 103377250 | d0Mseg982 |
| 0 | 103461400 | 103463100 | d0Mseg984 |
| 0 | 103532250 | 103534050 | d0Mseg985 |
| 0 | 103593900 | 103595600 | d0Mseg986 |
| 0 | 103674400 | 103676100 | d0Mseg987 |
| 0 | 103679000 | 103681250 | d0Mseg988 |
| 0 | 103713350 | 103715150 | d0Mseg989 |
| 0 | 103748650 | 103750400 | d0Mseg990 |
| 0 | 103838500 | 103840200 | d0Mseg992 |
| 0 | 103911200 | 103913150 | d0Mseg994 |
| 0 | 104191150 | 104192950 | d0Mseg996 |
| 0 | 104241650 | 104243300 | d0Mseg997 |
| 0 | 104518400 | 104520050 | d0Mseg998 |
| 0 | 104550000 | 104551400 | d0Mseg999 |
| 0 | 104820600 | 104822350 | d0Mseg1002 |
| 0 | 105116250 | 105117350 | d0Mseg1005 |
| 0 | 105490300 | 105491900 | d0Mseg1006 |
| 0 | 105626050 | 105627750 | d0Mseg1007 |
| 0 | 105637200 | 105638350 | d0Mseg1008 |
| 0 | 105691250 | 105692700 | d0Mseg1009 |
| 0 | 105824300 | 105825850 | d0Mseg1010 |
| 0 | 105882100 | 105883800 | d0Mseg1011 |
| 0 | 105894150 | 105895700 | d0Mseg1012 |
| 0 | 106399950 | 106401400 | d0Mseg1018 |
| 0 | 106470600 | 106472300 | d0Mseg1019 |
| 0 | 106490300 | 106492250 | d0Mseg1020 |
| 0 | 106594300 | 106596000 | d0Mseg1021 |
| 0 | 106691400 | 106692950 | d0Mseg1023 |
| 0 | 106869750 | 106871550 | d0Mseg1024 |
| 0 | 106979750 | 106981350 | d0Mseg1025 |
| 0 | 107294250 | 107295750 | d0Mseg1027 |
| 0 | 107625750 | 107627150 | d0Mseg1030 |
| 0 | 107631800 | 107633850 | d0Mseg1031 |
| 0 | 107947200 | 107948900 | d0Mseg1034 |
| 0 | 108116700 | 108118600 | d0Mseg1036 |
| 0 | 108122550 | 108124200 | d0Mseg1037 |
| 0 | 108642600 | 108644400 | d0Mseg1040 |
| 0 | 108779750 | 108781550 | d0Mseg1043 |
| 0 | 108906450 | 108908050 | d0Mseg1045 |
| 0 | 109003300 | 109004900 | d0Mseg1046 |
| 0 | 109006700 | 109011200 | d0Mseg1047 |
| 0 | 109252300 | 109253500 | d0Mseg1048 |
| 0 | 109255150 | 109256850 | d0Mseg1049 |
| 0 | 109393450 | 109395300 | d0Mseg1051 |
| 0 | 109593350 | 109594700 | d0Mseg1053 |
| 0 | 110143600 | 110145500 | d0Mseg1058 |
| 0 | 110632150 | 110633800 | d0Mseg1060 |
| 0 | 111326800 | 111329500 | d0Mseg1063 |
| 0 | 111405500 | 111406650 | d0Mseg1064 |
| 0 | 111545400 | 111547100 | d0Mseg1065 |
| 0 | 111815600 | 111817550 | d0Mseg1067 |
| 0 | 112020750 | 112022450 | d0Mseg1068 |
| 0 | 112145800 | 112148750 | d0Mseg1069 |
| 0 | 112393200 | 112395300 | d0Mseg1070 |
| 0 | 112601800 | 112603400 | d0Mseg1072 |
| 0 | 112787800 | 112789500 | d0Mseg1073 |
| 0 | 112848650 | 112850100 | d0Mseg1074 |
| 0 | 113048050 | 113049150 | d0Mseg1075 |
| 0 | 113546950 | 113549200 | d0Mseg1077 |
| 0 | 113646200 | 113647750 | d0Mseg1078 |
| 0 | 113669100 | 113670800 | d0Mseg1079 |
| 0 | 114135100 | 114136100 | d0Mseg1082 |
| 0 | 114684700 | 114686500 | d0Mseg1084 |
| 0 | 114700450 | 114702250 | d0Mseg1085 |
| 0 | 115025200 | 115027200 | d0Mseg1086 |
| 0 | 115415450 | 115417150 | d0Mseg1087 |
| 0 | 115684300 | 115685950 | d0Mseg1088 |
| 0 | 115919850 | 115921650 | d0Mseg1090 |
| 0 | 116024300 | 116025900 | d0Mseg1092 |
| 0 | 116036500 | 116038600 | d0Mseg1093 |
| 0 | 116123200 | 116124950 | d0Mseg1094 |
| 0 | 116217400 | 116219150 | d0Mseg1095 |
| 0 | 116353750 | 116355450 | d0Mseg1098 |
| 0 | 116365000 | 116366650 | d0Mseg1099 |
| 0 | 116559650 | 116561100 | d0Mseg1101 |
| 0 | 116629100 | 116630750 | d0Mseg1102 |
| 0 | 116635550 | 116637350 | d0Mseg1103 |
| 0 | 116675600 | 116677500 | d0Mseg1104 |
| 0 | 116732650 | 116734550 | d0Mseg1105 |
| 0 | 116871000 | 116872500 | d0Mseg1106 |
| 0 | 117228750 | 117230600 | d0Mseg1109 |
| 0 | 117244400 | 117246300 | d0Mseg1110 |
| 0 | 117428900 | 117430500 | d0Mseg1114 |
| 0 | 118006150 | 118007800 | d0Mseg1117 |
| 0 | 118062150 | 118063850 | d0Mseg1118 |
| 0 | 118205250 | 118206350 | d0Mseg1119 |
| 0 | 118364400 | 118365800 | d0Mseg1120 |
| 0 | 118567950 | 118569650 | d0Mseg1121 |
| 0 | 118736900 | 118738450 | d0Mseg1122 |
| 0 | 118856550 | 118858200 | d0Mseg1123 |
| 0 | 119019200 | 119020950 | d0Mseg1124 |
| 0 | 119201550 | 119203300 | d0Mseg1127 |
| 0 | 119232700 | 119234350 | d0Mseg1128 |
| 0 | 119313800 | 119315400 | d0Mseg1131 |
| 0 | 119607150 | 119608800 | d0Mseg1133 |
| 0 | 119628850 | 119632400 | d0Mseg1135 |
| 0 | 119972800 | 119974250 | d0Mseg1138 |
| 0 | 120027300 | 120029150 | d0Mseg1139 |
| 0 | 120074950 | 120077000 | d0Mseg1140 |
| 0 | 120144650 | 120146100 | d0Mseg1141 |
| 0 | 120148600 | 120150550 | d0Mseg1142 |
| 0 | 120489400 | 120491150 | d0Mseg1143 |
| 0 | 120562850 | 120564500 | d0Mseg1144 |
| 0 | 120660150 | 120661800 | d0Mseg1145 |
| 0 | 120789550 | 120791150 | d0Mseg1146 |
| 0 | 120962150 | 120963750 | d0Mseg1147 |
| 0 | 121212800 | 121214450 | d0Mseg1148 |
| 0 | 121272450 | 121273800 | d0Mseg1149 |
| 0 | 122608950 | 122610350 | d0Mseg1150 |
| 0 | 122631150 | 122632800 | d0Mseg1151 |
| 0 | 122772950 | 122774700 | d0Mseg1152 |
| 0 | 122939250 | 122940300 | d0Mseg1153 |
| 0 | 123015600 | 123017050 | d0Mseg1154 |
| 0 | 123109250 | 123110750 | d0Mseg1155 |
| 0 | 123363600 | 123365300 | d0Mseg1157 |
| 0 | 123398700 | 123400600 | d0Mseg1158 |
| 0 | 123511600 | 123513250 | d0Mseg1159 |
| 0 | 123600850 | 123602550 | d0Mseg1160 |
| 0 | 123769100 | 123770700 | d0Mseg1161 |
| 0 | 123943500 | 123945250 | d0Mseg1162 |
| 0 | 123995300 | 123996550 | d0Mseg1163 |
| 0 | 124134200 | 124135900 | d0Mseg1164 |
| 0 | 124497800 | 124499700 | d0Mseg1165 |
| 0 | 124592100 | 124593700 | d0Mseg1166 |
| 0 | 124694500 | 124696200 | d0Mseg1167 |
| 0 | 124831400 | 124833050 | d0Mseg1168 |
| 0 | 124847250 | 124848650 | d0Mseg1169 |
| 0 | 125017850 | 125019550 | d0Mseg1171 |
| 0 | 125260200 | 125261900 | d0Mseg1172 |
| 0 | 125404050 | 125405800 | d0Mseg1174 |
| 0 | 125503900 | 125505600 | d0Mseg1175 |
| 0 | 125604400 | 125606150 | d0Mseg1176 |
| 0 | 125637050 | 125638900 | d0Mseg1177 |
| 0 | 125759350 | 125761100 | d0Mseg1178 |
| 0 | 125762750 | 125764150 | d0Mseg1179 |
| 0 | 126147050 | 126149150 | d0Mseg1180 |
| 0 | 127919250 | 127920850 | d0Mseg1188 |
| 0 | 128141600 | 128143750 | d0Mseg1190 |
| 0 | 128620550 | 128622250 | d0Mseg1195 |
| 0 | 128761600 | 128762900 | d0Mseg1196 |
| 0 | 129730850 | 129732550 | d0Mseg1200 |
| 0 | 129743700 | 129745750 | d0Mseg1201 |
| 0 | 129954000 | 129955700 | d0Mseg1202 |
| 0 | 130336000 | 130340700 | d0Mseg1208 |
| 0 | 130368350 | 130369550 | d0Mseg1209 |
| 0 | 131027100 | 131028500 | d0Mseg1216 |

TABLE IVC-continued

Mouse Moderate Sites

| c/d | start | end | segment |
|---|---|---|---|
| 0 | 131204150 | 131205800 | d0Mseg1217 |
| 0 | 131346500 | 131348200 | d0Mseg1219 |
| 0 | 131354000 | 131355700 | d0Mseg1220 |
| 0 | 131497950 | 131499600 | d0Mseg1224 |
| 0 | 131514050 | 131515700 | d0Mseg1225 |
| 0 | 131732800 | 131736150 | d0Mseg1227 |
| 0 | 131756800 | 131758450 | d0Mseg1229 |
| 0 | 131782750 | 131784350 | d0Mseg1230 |
| 0 | 131790250 | 131791900 | d0Mseg1231 |
| 0 | 131793750 | 131795650 | d0Mseg1232 |
| 0 | 131842750 | 131844550 | d0Mseg1233 |
| 0 | 132266000 | 132267400 | d0Mseg1235 |
| 0 | 132302800 | 132304350 | d0Mseg1236 |
| 0 | 132559400 | 132560600 | d0Mseg1238 |
| 0 | 132641650 | 132643300 | d0Mseg1239 |
| 0 | 132901400 | 132903200 | d0Mseg1242 |
| 0 | 132965250 | 132967250 | d0Mseg1243 |
| 0 | 133196500 | 133198500 | d0Mseg1245 |
| 0 | 133632100 | 133635600 | d0Mseg1252 |
| 0 | 133638300 | 133640900 | d0Mseg1253 |
| 0 | 133661200 | 133664050 | d0Mseg1255 |
| 0 | 133665600 | 133667550 | d0Mseg1256 |
| 0 | 133698000 | 133699850 | d0Mseg1257 |
| 0 | 133704550 | 133706550 | d0Mseg1258 |
| 0 | 134039500 | 134041150 | d0Mseg1260 |
| 0 | 134075600 | 134077550 | d0Mseg1261 |
| 0 | 134130950 | 134132550 | d0Mseg1263 |
| 0 | 134317850 | 134319350 | d0Mseg1265 |
| 0 | 134533000 | 134534600 | d0Mseg1266 |
| 0 | 134920500 | 134921500 | d0Mseg1268 |
| 0 | 134955400 | 134956800 | d0Mseg1270 |
| 0 | 135178500 | 135180300 | d0Mseg1274 |
| 0 | 135232950 | 135234650 | d0Mseg1275 |
| 0 | 135240800 | 135242500 | d0Mseg1276 |
| 0 | 135547250 | 135548650 | d0Mseg1282 |
| 0 | 135556400 | 135559550 | d0Mseg1283 |
| 0 | 135633850 | 135635250 | d0Mseg1285 |
| 0 | 135723250 | 135724900 | d0Mseg1286 |
| 0 | 135726100 | 135728000 | d0Mseg1287 |
| 0 | 135987350 | 135989000 | d0Mseg1289 |
| 0 | 135997750 | 135999050 | d0Mseg1290 |
| 0 | 136051300 | 136053100 | d0Mseg1292 |
| 0 | 136594750 | 136597450 | d0Mseg1297 |
| 0 | 137140850 | 137142900 | d0Mseg1312 |
| 0 | 137156650 | 137159900 | d0Mseg1313 |
| 0 | 137355200 | 137358750 | d0Mseg1319 |
| 0 | 137682600 | 137684200 | d0Mseg1324 |
| 0 | 137715600 | 137717500 | d0Mseg1326 |
| 0 | 137770050 | 137771050 | d0Mseg1328 |
| 0 | 138174650 | 138176350 | d0Mseg1337 |
| 0 | 138192250 | 138194250 | d0Mseg1339 |
| 0 | 138205000 | 138206800 | d0Mseg1340 |
| 0 | 138240350 | 138241550 | d0Mseg1341 |
| 0 | 138667250 | 138668250 | d0Mseg1346 |
| 0 | 138995100 | 138996850 | d0Mseg1350 |
| 0 | 139065250 | 139069750 | d0Mseg1351 |
| 0 | 139076150 | 139078000 | d0Mseg1352 |
| 0 | 139095300 | 139097200 | d0Mseg1353 |
| 0 | 139808700 | 139810050 | d0Mseg1364 |
| 0 | 140443800 | 140445600 | d0Mseg1371 |
| 0 | 140453250 | 140455150 | d0Mseg1372 |
| 0 | 140712350 | 140713900 | d0Mseg1373 |
| 0 | 141481200 | 141482600 | d0Mseg1377 |
| 0 | 141592950 | 141594250 | d0Mseg1378 |
| 0 | 141602050 | 141603700 | d0Mseg1379 |
| 0 | 141680100 | 141681850 | d0Mseg1380 |
| 0 | 141720250 | 141721950 | d0Mseg1381 |
| 0 | 142259150 | 142261000 | d0Mseg1386 |
| 0 | 142436950 | 142439550 | d0Mseg1388 |
| 0 | 142609300 | 142611000 | d0Mseg1389 |
| 0 | 142784250 | 142785950 | d0Mseg1391 |
| 0 | 142929800 | 142931650 | d0Mseg1392 |
| 0 | 143034900 | 143036700 | d0Mseg1394 |
| 0 | 143114400 | 143116150 | d0Mseg1396 |
| 0 | 143126350 | 143128050 | d0Mseg1397 |
| 0 | 143612050 | 143614850 | d0Mseg1403 |
| 0 | 143718550 | 143720200 | d0Mseg1404 |
| 0 | 143726050 | 143727650 | d0Mseg1405 |
| 0 | 143743400 | 143745250 | d0Mseg1406 |
| 0 | 143893150 | 143894900 | d0Mseg1407 |
| 0 | 144049250 | 144051350 | d0Mseg1410 |
| 0 | 144088050 | 144089650 | d0Mseg1411 |
| 0 | 144229600 | 144231450 | d0Mseg1412 |
| 0 | 145294150 | 145295800 | d0Mseg1413 |
| 0 | 145307450 | 145309100 | d0Mseg1414 |
| 0 | 145399400 | 145401000 | d0Mseg1415 |
| 0 | 145455450 | 145456750 | d0Mseg1416 |
| 0 | 146206350 | 146207900 | d0Mseg1418 |
| 0 | 146288450 | 146290250 | d0Mseg1420 |
| 0 | 146456650 | 146458400 | d0Mseg1421 |
| 0 | 146533650 | 146535250 | d0Mseg1422 |
| 0 | 146639950 | 146641550 | d0Mseg1423 |
| 0 | 146762600 | 146764250 | d0Mseg1424 |
| 0 | 146800750 | 146802450 | d0Mseg1425 |
| 0 | 146825850 | 146827450 | d0Mseg1426 |
| 0 | 146900350 | 146903250 | d0Mseg1427 |
| 0 | 146936300 | 146937350 | d0Mseg1428 |
| 0 | 147253700 | 147254950 | d0Mseg1430 |
| 0 | 147394800 | 147396400 | d0Mseg1431 |
| 0 | 147578550 | 147580300 | d0Mseg1432 |
| 0 | 148265100 | 148266650 | d0Mseg1434 |
| 0 | 148543400 | 148545350 | d0Mseg1437 |
| 0 | 149508800 | 149510550 | d0Mseg1442 |
| 0 | 149531650 | 149533500 | d0Mseg1443 |
| 0 | 149652250 | 149653700 | d0Mseg1444 |
| 0 | 149762050 | 149763600 | d0Mseg1445 |
| 0 | 149876750 | 149878500 | d0Mseg1448 |
| 0 | 150103000 | 150104700 | d0Mseg1450 |
| 0 | 150242200 | 150243950 | d0Mseg1452 |
| 0 | 150429700 | 150431400 | d0Mseg1454 |
| 0 | 150504600 | 150506350 | d0Mseg1455 |
| 0 | 150603700 | 150605450 | d0Mseg1456 |
| 0 | 150695300 | 150697000 | d0Mseg1457 |
| 0 | 150849700 | 150851350 | d0Mseg1458 |
| 0 | 150969200 | 150971100 | d0Mseg1459 |
| 0 | 151195150 | 151196600 | d0Mseg1460 |
| 0 | 151325350 | 151327100 | d0Mseg1461 |
| 0 | 151436700 | 151438350 | d0Mseg1462 |
| 0 | 151513650 | 151515300 | d0Mseg1463 |
| 0 | 151959750 | 151961500 | d0Mseg1466 |
| 0 | 152105050 | 152106150 | d0Mseg1469 |
| 0 | 152179500 | 152181100 | d0Mseg1470 |
| 0 | 152303200 | 152305050 | d0Mseg1471 |
| 0 | 152412000 | 152413450 | d0Mseg1472 |
| 0 | 153284600 | 153286300 | d0Mseg1476 |
| 0 | 153370000 | 153371400 | d0Mseg1478 |
| 0 | 153400950 | 153402700 | d0Mseg1479 |
| 0 | 153534150 | 153535900 | d0Mseg1480 |
| 0 | 153757500 | 153758700 | d0Mseg1481 |
| 0 | 154499650 | 154500800 | d0Mseg1485 |
| 0 | 154551650 | 154553600 | d0Mseg1486 |
| 0 | 154681400 | 154682450 | d0Mseg1488 |
| 0 | 154732250 | 154734050 | d0Mseg1489 |
| 0 | 155046000 | 155047650 | d0Mseg1490 |
| 0 | 155256600 | 155258350 | d0Mseg1492 |
| 0 | 155277500 | 155279200 | d0Mseg1493 |
| 0 | 155351050 | 155353600 | d0Mseg1495 |
| 0 | 155555850 | 155557700 | d0Mseg1497 |
| 0 | 155832500 | 155834400 | d0Mseg1502 |
| 0 | 155980850 | 155982300 | d0Mseg1504 |
| 0 | 157516650 | 157518650 | d0Mseg1520 |
| 0 | 157556750 | 157558400 | d0Mseg1521 |
| 0 | 157572200 | 157573950 | d0Mseg1522 |
| 0 | 157735700 | 157737750 | d0Mseg1524 |
| 0 | 157750700 | 157752500 | d0Mseg1525 |
| 0 | 158820150 | 158821850 | d0Mseg1539 |
| 0 | 159074350 | 159076150 | d0Mseg1541 |
| 0 | 160189150 | 160191000 | d0Mseg1547 |
| 0 | 160197550 | 160199650 | d0Mseg1548 |
| 0 | 160474700 | 160475700 | d0Mseg1551 |
| 0 | 161477750 | 161479400 | d0Mseg1557 |
| 0 | 161848050 | 161849700 | d0Mseg1561 |

TABLE IVC-continued

Mouse Moderate Sites

| c/d | start | end | segment |
|---|---|---|---|
| 0 | 161957500 | 161959100 | d0Mseg1562 |
| 0 | 162659200 | 162661100 | d0Mseg1567 |
| 0 | 163084400 | 163086700 | d0Mseg1573 |
| 0 | 163150050 | 163151050 | d0Mseg1574 |
| 0 | 163335200 | 163336900 | d0Mseg1577 |
| 0 | 163895400 | 163897100 | d0Mseg1579 |
| 0 | 164403750 | 164405400 | d0Mseg1583 |
| 0 | 164632400 | 164633550 | d0Mseg1587 |
| 0 | 164670400 | 164672200 | d0Mseg1588 |
| 0 | 164979450 | 164981050 | d0Mseg1592 |
| 0 | 165294750 | 165296450 | d0Mseg1597 |
| 0 | 165360200 | 165361900 | d0Mseg1600 |
| 0 | 165528050 | 165530000 | d0Mseg1603 |
| 0 | 165802400 | 165804200 | d0Mseg1609 |
| 0 | 165928600 | 165930150 | d0Mseg1610 |
| 0 | 165951550 | 165953150 | d0Mseg1611 |
| 0 | 166284650 | 166286550 | d0Mseg1614 |
| 0 | 166425400 | 166429400 | d0Mseg1618 |
| 7 | 4307600 | 4309000 | d7Mseg1 |
| 7 | 4574750 | 4575950 | d7Mseg2 |
| 7 | 4723150 | 4724150 | d7Mseg3 |
| 7 | 5044850 | 5046800 | d7Mseg5 |
| 7 | 5334700 | 5336400 | d7Mseg6 |
| 7 | 5503100 | 5504200 | d7Mseg7 |
| 7 | 5567800 | 5569200 | d7Mseg8 |
| 7 | 5575150 | 5576950 | d7Mseg9 |
| 7 | 5578300 | 5579800 | d7Mseg10 |
| 7 | 5671100 | 5672450 | d7Mseg13 |
| 7 | 5685650 | 5686650 | d7Mseg14 |
| 7 | 5697100 | 5698800 | d7Mseg15 |
| 7 | 5702100 | 5703750 | d7Mseg16 |
| 7 | 5808300 | 5810000 | d7Mseg18 |
| 7 | 5857350 | 5858650 | d7Mseg20 |
| 7 | 5867000 | 5868500 | d7Mseg21 |
| 7 | 5888700 | 5890200 | d7Mseg22 |
| 7 | 6083650 | 6085250 | d7Mseg26 |
| 7 | 6223850 | 6225500 | d7Mseg28 |
| 7 | 6270050 | 6271050 | d7Mseg29 |
| 7 | 6492100 | 6493800 | d7Mseg37 |
| 7 | 6508850 | 6509950 | d7Mseg38 |
| 7 | 6550800 | 6551900 | d7Mseg41 |
| 7 | 6593600 | 6595300 | d7Mseg43 |
| 7 | 6687600 | 6689400 | d7Mseg48 |
| 7 | 6690650 | 6692300 | d7Mseg49 |
| 7 | 6695500 | 6700150 | d7Mseg50 |
| 7 | 6724100 | 6725200 | d7Mseg51 |
| 7 | 6780450 | 6782000 | d7Mseg54 |
| 7 | 6807950 | 6809500 | d7Mseg55 |
| 7 | 6878800 | 6882850 | d7Mseg60 |
| 7 | 6911300 | 6913200 | d7Mseg63 |
| 7 | 6923650 | 6925300 | d7Mseg64 |
| 7 | 6967700 | 6968850 | d7Mseg70 |
| 7 | 7005550 | 7007450 | d7Mseg72 |
| 7 | 7074300 | 7079600 | d7Mseg76 |
| 7 | 7099550 | 7101400 | d7Mseg77 |
| 7 | 7105800 | 7107500 | d7Mseg78 |
| 7 | 7110650 | 7112600 | d7Mseg79 |
| 7 | 7120550 | 7123400 | d7Mseg80 |
| 7 | 7129950 | 7131650 | d7Mseg81 |
| 7 | 7290700 | 7292500 | d7Mseg90 |
| 7 | 7328650 | 7330300 | d7Mseg92 |
| 7 | 7355500 | 7356800 | d7Mseg94 |
| 7 | 7526550 | 7528550 | d7Mseg108 |
| 7 | 7573250 | 7575000 | d7Mseg109 |
| 7 | 7600700 | 7602200 | d7Mseg112 |
| 7 | 7609400 | 7610500 | d7Mseg113 |
| 7 | 7623400 | 7624800 | d7Mseg114 |
| 7 | 7653550 | 7655750 | d7Mseg115 |
| 7 | 7672400 | 7673550 | d7Mseg116 |
| 7 | 7681350 | 7682450 | d7Mseg117 |
| 7 | 7689450 | 7691400 | d7Mseg118 |
| 7 | 7697200 | 7699100 | d7Mseg119 |
| 7 | 7714200 | 7715850 | d7Mseg121 |
| 7 | 7807400 | 7809100 | d7Mseg127 |
| 7 | 7932900 | 7934750 | d7Mseg129 |
| 7 | 7938250 | 7940150 | d7Mseg130 |
| 7 | 7979650 | 7981300 | d7Mseg131 |
| 7 | 7986300 | 7987850 | d7Mseg132 |
| 7 | 8111900 | 8113650 | d7Mseg133 |
| 7 | 8151800 | 8153350 | d7Mseg134 |
| 7 | 8208300 | 8209800 | d7Mseg136 |
| 7 | 8466450 | 8472550 | d7Mseg138 |
| 7 | 8902450 | 8904350 | d7Mseg142 |
| 7 | 9188300 | 9190200 | d7Mseg144 |
| 7 | 9259800 | 9261550 | d7Mseg146 |
| 7 | 9385400 | 9387100 | d7Mseg149 |
| 7 | 9410500 | 9412150 | d7Mseg150 |
| 7 | 9703150 | 9704300 | d7Mseg157 |
| 7 | 9901050 | 9902900 | d7Mseg163 |
| 7 | 9948550 | 9949800 | d7Mseg166 |
| 7 | 9952900 | 9954550 | d7Mseg167 |
| 7 | 10607000 | 10608500 | d7Mseg187 |
| 7 | 10749500 | 10751000 | d7Mseg195 |
| 7 | 10794200 | 10795950 | d7Mseg198 |
| 7 | 11001250 | 11003700 | d7Mseg205 |
| 7 | 11347350 | 11349000 | d7Mseg224 |
| 7 | 11611400 | 11612500 | d7Mseg237 |
| 7 | 11678450 | 11679550 | d7Mseg241 |
| 7 | 11743000 | 11746400 | d7Mseg246 |
| 7 | 11910800 | 11912450 | d7Mseg254 |
| 7 | 11971200 | 11972900 | d7Mseg257 |
| 7 | 12026000 | 12027700 | d7Mseg261 |
| 7 | 12235550 | 12237250 | d7Mseg268 |
| 7 | 12440350 | 12441500 | d7Mseg275 |
| 7 | 12457900 | 12459600 | d7Mseg276 |
| 7 | 12497350 | 12498850 | d7Mseg277 |
| 7 | 12501600 | 12503150 | d7Mseg278 |
| 7 | 12512850 | 12514750 | d7Mseg279 |
| 7 | 12592100 | 12593300 | d7Mseg283 |
| 7 | 12636400 | 12638050 | d7Mseg285 |
| 7 | 12782250 | 12784050 | d7Mseg288 |
| 7 | 12799150 | 12801200 | d7Mseg289 |
| 7 | 12816750 | 12819800 | d7Mseg291 |
| 7 | 12884800 | 12886500 | d7Mseg292 |
| 7 | 12891300 | 12893100 | d7Mseg293 |
| 7 | 12913800 | 12915100 | d7Mseg294 |
| 7 | 13010550 | 13011600 | d7Mseg296 |
| 7 | 13036750 | 13038100 | d7Mseg297 |
| 7 | 13446450 | 13448050 | d7Mseg314 |
| 7 | 13739350 | 13740450 | d7Mseg319 |
| 7 | 14100400 | 14101400 | d7Mseg324 |
| 7 | 14353050 | 14354550 | d7Mseg325 |
| 7 | 14648500 | 14650350 | d7Mseg326 |
| 7 | 14982850 | 14984400 | d7Mseg328 |
| 7 | 15419100 | 15420400 | d7Mseg329 |
| 7 | 15629000 | 15630000 | d7Mseg330 |
| 7 | 15723100 | 15725050 | d7Mseg331 |
| 7 | 15958500 | 15959950 | d7Mseg333 |
| 7 | 16001800 | 16003650 | d7Mseg334 |
| 7 | 16037250 | 16038550 | d7Mseg335 |
| 7 | 16566600 | 16568200 | d7Mseg343 |
| 7 | 16936050 | 16937650 | d7Mseg349 |
| 7 | 16949800 | 16951350 | d7Mseg350 |
| 7 | 17122450 | 17123500 | d7Mseg353 |
| 7 | 17162750 | 17164400 | d7Mseg356 |
| 7 | 17614200 | 17615400 | d7Mseg360 |
| 7 | 17903000 | 17904500 | d7Mseg361 |
| 7 | 18247500 | 18249100 | d7Mseg363 |
| 7 | 18409500 | 18411100 | d7Mseg364 |
| 7 | 19298050 | 19299850 | d7Mseg369 |
| 7 | 19329200 | 19331150 | d7Mseg370 |
| 7 | 19623550 | 19624950 | d7Mseg372 |
| 7 | 19627200 | 19628500 | d7Mseg373 |
| 7 | 19651650 | 19653350 | d7Mseg375 |
| 7 | 19661150 | 19663150 | d7Mseg376 |
| 7 | 19721450 | 19722500 | d7Mseg378 |
| 7 | 19875800 | 19876850 | d7Mseg380 |
| 7 | 20021900 | 20023350 | d7Mseg383 |
| 7 | 20049300 | 20050900 | d7Mseg384 |
| 7 | 20058500 | 20059900 | d7Mseg385 |
| 7 | 20116250 | 20118000 | d7Mseg386 |
| 7 | 20146100 | 20147850 | d7Mseg389 |

TABLE IVC-continued

Mouse Moderate Sites

| c/d | start | end | segment |
|---|---|---|---|
| 7 | 20155950 | 20157050 | d7Mseg390 |
| 7 | 20321200 | 20323000 | d7Mseg395 |
| 7 | 20324750 | 20325950 | d7Mseg396 |
| 7 | 20559800 | 20560800 | d7Mseg402 |
| 7 | 20573600 | 20575600 | d7Mseg403 |
| 7 | 20675950 | 20677300 | d7Mseg404 |
| 7 | 20727750 | 20729200 | d7Mseg407 |
| 7 | 20786900 | 20788250 | d7Mseg408 |
| 7 | 20802200 | 20803950 | d7Mseg409 |
| 7 | 20849300 | 20851000 | d7Mseg410 |
| 7 | 20856850 | 20858800 | d7Mseg411 |
| 7 | 20937100 | 20940950 | d7Mseg413 |
| 7 | 20947200 | 20949100 | d7Mseg414 |
| 7 | 21006200 | 21007650 | d7Mseg415 |
| 7 | 21023050 | 21024550 | d7Mseg416 |
| 7 | 21146750 | 21148150 | d7Mseg419 |
| 7 | 21247000 | 21248700 | d7Mseg422 |
| 7 | 21258400 | 21259700 | d7Mseg423 |
| 7 | 21283950 | 21285650 | d7Mseg424 |
| 7 | 21353150 | 21354300 | d7Mseg426 |
| 7 | 21430900 | 21432600 | d7Mseg427 |
| 7 | 21459950 | 21461500 | d7Mseg429 |
| 7 | 21529550 | 21531500 | d7Mseg430 |
| 7 | 21644650 | 21646150 | d7Mseg431 |
| 7 | 21806400 | 21807450 | d7Mseg432 |
| 7 | 21830050 | 21831250 | d7Mseg433 |
| 7 | 21862900 | 21863950 | d7Mseg434 |
| 7 | 22045600 | 22047350 | d7Mseg435 |
| 7 | 22055500 | 22057100 | d7Mseg436 |
| 7 | 22506550 | 22508200 | d7Mseg438 |
| 7 | 23168550 | 23169650 | d7Mseg443 |
| 7 | 23178400 | 23179800 | d7Mseg444 |
| 7 | 23215200 | 23216650 | d7Mseg445 |
| 7 | 23913100 | 23914300 | d7Mseg448 |
| 7 | 24378050 | 24379600 | d7Mseg449 |
| 7 | 25313250 | 25314650 | d7Mseg450 |
| 7 | 25496900 | 25498450 | d7Mseg451 |
| 7 | 25604450 | 25605850 | d7Mseg452 |
| 7 | 31083550 | 31085050 | d7Mseg453 |
| 7 | 32128850 | 32130300 | d7Mseg454 |
| 7 | 33094450 | 33096050 | d7Mseg455 |
| 7 | 33119700 | 33120700 | d7Mseg456 |
| 7 | 33346100 | 33347900 | d7Mseg457 |
| 7 | 33379550 | 33381050 | d7Mseg458 |
| 7 | 33409500 | 33411250 | d7Mseg460 |
| 7 | 33698550 | 33700100 | d7Mseg467 |
| 7 | 33754150 | 33756150 | d7Mseg471 |
| 7 | 33837600 | 33839450 | d7Mseg475 |
| 7 | 33841200 | 33842400 | d7Mseg476 |
| 7 | 33912350 | 33914300 | d7Mseg481 |
| 7 | 33959650 | 33961100 | d7Mseg483 |
| 7 | 34207150 | 34209200 | d7Mseg493 |
| 7 | 34448300 | 34449800 | d7Mseg501 |
| 7 | 34544000 | 34545700 | d7Mseg506 |
| 7 | 34570100 | 34573550 | d7Mseg509 |
| 7 | 34576350 | 34578100 | d7Mseg510 |
| 7 | 34595250 | 34597100 | d7Mseg512 |
| 7 | 34601050 | 34602600 | d7Mseg513 |
| 7 | 34654600 | 34657700 | d7Mseg516 |
| 7 | 34894000 | 34895650 | d7Mseg521 |
| 7 | 34911900 | 34912950 | d7Mseg522 |
| 7 | 35017350 | 35018500 | d7Mseg523 |
| 7 | 35044500 | 35046000 | d7Mseg524 |
| 7 | 35057150 | 35058850 | d7Mseg525 |
| 7 | 35065400 | 35067100 | d7Mseg526 |
| 7 | 35084450 | 35086050 | d7Mseg527 |
| 7 | 35096250 | 35097800 | d7Mseg528 |
| 7 | 35105250 | 35106450 | d7Mseg529 |
| 7 | 35111400 | 35112500 | d7Mseg530 |
| 7 | 35173650 | 35175350 | d7Mseg531 |
| 7 | 35178900 | 35181600 | d7Mseg532 |
| 7 | 35182900 | 35184500 | d7Mseg533 |
| 7 | 35220700 | 35222450 | d7Mseg535 |
| 7 | 35255600 | 35256800 | d7Mseg537 |
| 7 | 35285700 | 35287000 | d7Mseg538 |
| 7 | 35292450 | 35294250 | d7Mseg539 |
| 7 | 35334750 | 35336450 | d7Mseg540 |
| 7 | 35372350 | 35376050 | d7Mseg541 |
| 7 | 35378300 | 35379550 | d7Mseg542 |
| 7 | 35436950 | 35438350 | d7Mseg543 |
| 7 | 35443650 | 35444650 | d7Mseg544 |
| 7 | 35451450 | 35452850 | d7Mseg545 |
| 7 | 35473950 | 35476050 | d7Mseg548 |
| 7 | 35527100 | 35528350 | d7Mseg550 |
| 7 | 35532850 | 35535100 | d7Mseg551 |
| 7 | 35617400 | 35619250 | d7Mseg557 |
| 7 | 35653050 | 35654950 | d7Mseg558 |
| 7 | 35725400 | 35728650 | d7Mseg559 |
| 7 | 35746700 | 35748050 | d7Mseg561 |
| 7 | 35838750 | 35840450 | d7Mseg563 |
| 7 | 35862050 | 35863450 | d7Mseg564 |
| 7 | 35932250 | 35933900 | d7Mseg567 |
| 7 | 35989100 | 35992350 | d7Mseg572 |
| 7 | 36096400 | 36098050 | d7Mseg575 |
| 7 | 36249950 | 36251450 | d7Mseg576 |
| 7 | 36334250 | 36336200 | d7Mseg577 |
| 7 | 36548250 | 36550000 | d7Mseg578 |
| 7 | 36643200 | 36644750 | d7Mseg579 |
| 7 | 36725250 | 36726550 | d7Mseg581 |
| 7 | 36816250 | 36817900 | d7Mseg582 |
| 7 | 36935000 | 36936200 | d7Mseg585 |
| 7 | 37049500 | 37051050 | d7Mseg587 |
| 7 | 37115850 | 37117150 | d7Mseg588 |
| 7 | 37231500 | 37232950 | d7Mseg589 |
| 7 | 37318500 | 37320100 | d7Mseg593 |
| 7 | 37456700 | 37457900 | d7Mseg595 |
| 7 | 37497900 | 37499050 | d7Mseg596 |
| 7 | 37562700 | 37563750 | d7Mseg597 |
| 7 | 37579450 | 37581000 | d7Mseg598 |
| 7 | 37650950 | 37652750 | d7Mseg599 |
| 7 | 37753350 | 37755150 | d7Mseg600 |
| 7 | 37780800 | 37781800 | d7Mseg601 |
| 7 | 37925400 | 37926650 | d7Mseg604 |
| 7 | 38047200 | 38048900 | d7Mseg606 |
| 7 | 38113450 | 38115100 | d7Mseg607 |
| 7 | 38137250 | 38138850 | d7Mseg608 |
| 7 | 38269350 | 38270850 | d7Mseg610 |
| 7 | 38377250 | 38378800 | d7Mseg612 |
| 7 | 38409200 | 38411000 | d7Mseg613 |
| 7 | 38442150 | 38443550 | d7Mseg614 |
| 7 | 38534300 | 38536050 | d7Mseg615 |
| 7 | 38725750 | 38727250 | d7Mseg618 |
| 7 | 39119550 | 39122300 | d7Mseg633 |
| 7 | 39204900 | 39206450 | d7Mseg636 |
| 7 | 39294900 | 39296850 | d7Mseg639 |
| 7 | 39336050 | 39337800 | d7Mseg641 |
| 7 | 39364300 | 39365450 | d7Mseg642 |
| 7 | 39410450 | 39412000 | d7Mseg643 |
| 7 | 39416200 | 39418000 | d7Mseg644 |
| 7 | 39648400 | 39649800 | d7Mseg650 |
| 7 | 39680400 | 39682500 | d7Mseg651 |
| 7 | 39744700 | 39746250 | d7Mseg653 |
| 7 | 39813750 | 39815550 | d7Mseg656 |
| 7 | 40033700 | 40034900 | d7Mseg666 |
| 7 | 40343700 | 40345550 | d7Mseg672 |
| 7 | 40388250 | 40389250 | d7Mseg673 |
| 7 | 40899050 | 40900600 | d7Mseg681 |
| 7 | 41158650 | 41160000 | d7Mseg682 |
| 7 | 41539150 | 41540700 | d7Mseg683 |
| 7 | 41562500 | 41564200 | d7Mseg684 |
| 7 | 41579700 | 41581550 | d7Mseg685 |
| 7 | 41706000 | 41707200 | d7Mseg687 |
| 7 | 41736550 | 41738050 | d7Mseg690 |
| 7 | 41798400 | 41799700 | d7Mseg693 |
| 7 | 41941200 | 41942850 | d7Mseg694 |
| 7 | 41983450 | 41985050 | d7Mseg696 |
| 7 | 41999850 | 42001250 | d7Mseg697 |
| 7 | 42417350 | 42419400 | d7Mseg699 |
| 7 | 42493200 | 42495050 | d7Mseg700 |
| 7 | 42525000 | 42527050 | d7Mseg701 |
| 7 | 42688200 | 42690150 | d7Mseg703 |
| 7 | 42774550 | 42775600 | d7Mseg705 |

TABLE IVC-continued

Mouse Moderate Sites

| c/d | start | end | segment |
|---|---|---|---|
| 7 | 42916750 | 42918000 | d7Mseg706 |
| 7 | 43065350 | 43066850 | d7Mseg707 |
| 7 | 43123400 | 43124600 | d7Mseg708 |
| 7 | 43184400 | 43186300 | d7Mseg709 |
| 7 | 43255950 | 43257900 | d7Mseg710 |
| 7 | 43281250 | 43282450 | d7Mseg711 |
| 7 | 43338900 | 43340750 | d7Mseg712 |
| 7 | 43397050 | 43399050 | d7Mseg713 |
| 7 | 43402700 | 43404350 | d7Mseg714 |
| 7 | 43441500 | 43442600 | d7Mseg715 |
| 7 | 43456450 | 43457800 | d7Mseg716 |
| 7 | 43507300 | 43508800 | d7Mseg717 |
| 7 | 43584300 | 43586800 | d7Mseg718 |
| 7 | 43777350 | 43779350 | d7Mseg721 |
| 7 | 43836900 | 43838600 | d7Mseg723 |
| 7 | 43862600 | 43864200 | d7Mseg724 |
| 7 | 43872050 | 43873600 | d7Mseg725 |
| 7 | 43993650 | 43995250 | d7Mseg729 |
| 7 | 44215200 | 44216300 | d7Mseg734 |
| 7 | 44329900 | 44331400 | d7Mseg739 |
| 7 | 44409350 | 44410350 | d7Mseg742 |
| 7 | 44628400 | 44629950 | d7Mseg748 |
| 7 | 44765550 | 44767100 | d7Mseg755 |
| 7 | 44799800 | 44801200 | d7Mseg756 |
| 7 | 44855950 | 44857850 | d7Mseg758 |
| 7 | 45045300 | 45046800 | d7Mseg761 |
| 7 | 45052500 | 45053600 | d7Mseg762 |
| 7 | 45301150 | 45302900 | d7Mseg769 |
| 7 | 45324450 | 45326400 | d7Mseg770 |
| 7 | 45339250 | 45341850 | d7Mseg771 |
| 7 | 45362150 | 45363400 | d7Mseg774 |
| 7 | 45402450 | 45403800 | d7Mseg778 |
| 7 | 45572050 | 45573550 | d7Mseg786 |
| 7 | 45594500 | 45596100 | d7Mseg787 |
| 7 | 45652400 | 45653900 | d7Mseg789 |
| 7 | 45889850 | 45891100 | d7Mseg804 |
| 7 | 46078850 | 46081100 | d7Mseg810 |
| 7 | 46105000 | 46106000 | d7Mseg811 |
| 7 | 46141350 | 46143250 | d7Mseg813 |
| 7 | 46164200 | 46165950 | d7Mseg814 |
| 7 | 46198850 | 46200050 | d7Mseg815 |
| 7 | 46210100 | 46211150 | d7Mseg816 |
| 7 | 46865500 | 46866600 | d7Mseg838 |
| 7 | 46891550 | 46892600 | d7Mseg839 |
| 7 | 46933200 | 46934900 | d7Mseg840 |
| 7 | 46953400 | 46954450 | d7Mseg841 |
| 7 | 47004350 | 47006100 | d7Mseg842 |
| 7 | 47079200 | 47080750 | d7Mseg843 |
| 7 | 47191950 | 47193850 | d7Mseg846 |
| 7 | 47198800 | 47200450 | d7Mseg847 |
| 7 | 47208500 | 47209650 | d7Mseg848 |
| 7 | 47223250 | 47224550 | d7Mseg849 |
| 7 | 47260550 | 47261750 | d7Mseg850 |
| 7 | 47285500 | 47287100 | d7Mseg852 |
| 7 | 47329200 | 47330300 | d7Mseg854 |
| 7 | 47395200 | 47396850 | d7Mseg856 |
| 7 | 47499200 | 47500350 | d7Mseg860 |
| 7 | 47551250 | 47552550 | d7Mseg861 |
| 7 | 47579250 | 47580650 | d7Mseg863 |
| 7 | 47590200 | 47591600 | d7Mseg864 |
| 7 | 47609950 | 47611350 | d7Mseg865 |
| 7 | 47661300 | 47663050 | d7Mseg866 |
| 7 | 47669950 | 47671350 | d7Mseg867 |
| 7 | 47715900 | 47717100 | d7Mseg868 |
| 7 | 47726600 | 47729450 | d7Mseg869 |
| 7 | 47743200 | 47744400 | d7Mseg870 |
| 7 | 47772400 | 47774150 | d7Mseg871 |
| 7 | 47833700 | 47835600 | d7Mseg873 |
| 7 | 47941850 | 47943200 | d7Mseg876 |
| 7 | 47987350 | 47989500 | d7Mseg877 |
| 7 | 47991050 | 47992200 | d7Mseg878 |
| 7 | 48001850 | 48004550 | d7Mseg879 |
| 7 | 48008250 | 48010000 | d7Mseg880 |
| 7 | 48015600 | 48017250 | d7Mseg881 |
| 7 | 48025850 | 48026950 | d7Mseg882 |
| 7 | 48048700 | 48050400 | d7Mseg884 |
| 7 | 48297650 | 48299400 | d7Mseg895 |
| 7 | 48382400 | 48384400 | d7Mseg902 |
| 7 | 48595000 | 48596450 | d7Mseg909 |
| 7 | 48647300 | 48649400 | d7Mseg911 |
| 7 | 48653550 | 48655150 | d7Mseg912 |
| 7 | 48665150 | 48666800 | d7Mseg913 |
| 7 | 48682650 | 48684150 | d7Mseg914 |
| 7 | 48762150 | 48763750 | d7Mseg920 |
| 7 | 49007400 | 49008850 | d7Mseg933 |
| 7 | 49043550 | 49044600 | d7Mseg936 |
| 7 | 49158750 | 49160400 | d7Mseg944 |
| 7 | 49168750 | 49170400 | d7Mseg945 |
| 7 | 49187600 | 49188950 | d7Mseg946 |
| 7 | 49294700 | 49296100 | d7Mseg950 |
| 7 | 49315900 | 49317700 | d7Mseg952 |
| 7 | 49324900 | 49326500 | d7Mseg953 |
| 7 | 49658250 | 49660050 | d7Mseg968 |
| 7 | 49818400 | 49819550 | d7Mseg979 |
| 7 | 50078400 | 50080200 | d7Mseg989 |
| 7 | 50197700 | 50198950 | d7Mseg996 |
| 7 | 50235750 | 50237450 | d7Mseg998 |
| 7 | 50249250 | 50250700 | d7Mseg1000 |
| 7 | 50323700 | 50325300 | d7Mseg1002 |
| 7 | 50753750 | 50755600 | d7Mseg1021 |
| 7 | 50764300 | 50766200 | d7Mseg1022 |
| 7 | 50792600 | 50793700 | d7Mseg1023 |
| 7 | 50819900 | 50821550 | d7Mseg1024 |
| 7 | 50826400 | 50828500 | d7Mseg1025 |
| 7 | 50921700 | 50923050 | d7Mseg1026 |
| 7 | 50939150 | 50940450 | d7Mseg1027 |
| 7 | 50944050 | 50945250 | d7Mseg1028 |
| 7 | 50996200 | 50997800 | d7Mseg1030 |
| 7 | 51029050 | 51030800 | d7Mseg1031 |
| 7 | 51048600 | 51050200 | d7Mseg1033 |
| 7 | 51059000 | 51062650 | d7Mseg1034 |
| 7 | 51076300 | 51080000 | d7Mseg1035 |
| 7 | 51081700 | 51083600 | d7Mseg1036 |
| 7 | 51177650 | 51179400 | d7Mseg1037 |
| 7 | 51276550 | 51281350 | d7Mseg1038 |
| 7 | 52594000 | 52595200 | d7Mseg1039 |
| 7 | 52840650 | 52841850 | d7Mseg1040 |
| 7 | 52891650 | 52893250 | d7Mseg1041 |
| 7 | 53184100 | 53185150 | d7Mseg1042 |
| 7 | 53388350 | 53390300 | d7Mseg1043 |
| 7 | 53394400 | 53395650 | d7Mseg1044 |
| 7 | 53452500 | 53454200 | d7Mseg1045 |
| 7 | 53502100 | 53503350 | d7Mseg1047 |
| 7 | 53545000 | 53546650 | d7Mseg1049 |
| 7 | 53634950 | 53636550 | d7Mseg1051 |
| 7 | 53646300 | 53648150 | d7Mseg1052 |
| 7 | 53649500 | 53651000 | d7Mseg1053 |
| 7 | 53679050 | 53680450 | d7Mseg1054 |
| 7 | 53683700 | 53685500 | d7Mseg1055 |
| 7 | 53805400 | 53807850 | d7Mseg1058 |
| 7 | 53810550 | 53812150 | d7Mseg1059 |
| 7 | 53854350 | 53855550 | d7Mseg1061 |
| 7 | 54118100 | 54119900 | d7Mseg1080 |
| 7 | 54544250 | 54545800 | d7Mseg1093 |
| 7 | 54733150 | 54734200 | d7Mseg1100 |
| 7 | 54843050 | 54844750 | d7Mseg1106 |
| 7 | 54935400 | 54937250 | d7Mseg1109 |
| 7 | 54988950 | 54990200 | d7Mseg1113 |
| 7 | 55242800 | 55243850 | d7Mseg1126 |
| 7 | 55586150 | 55587950 | d7Mseg1140 |
| 7 | 55598800 | 55600650 | d7Mseg1141 |
| 7 | 55650700 | 55652650 | d7Mseg1142 |
| 7 | 55797200 | 55799000 | d7Mseg1144 |
| 7 | 55851300 | 55853150 | d7Mseg1148 |
| 7 | 55958950 | 55960250 | d7Mseg1150 |
| 7 | 55979700 | 55981450 | d7Mseg1151 |
| 7 | 55985600 | 55987750 | d7Mseg1152 |
| 7 | 56059200 | 56060450 | d7Mseg1153 |
| 7 | 56071000 | 56072200 | d7Mseg1154 |
| 7 | 56104400 | 56106000 | d7Mseg1156 |
| 7 | 56231350 | 56232400 | d7Mseg1158 |
| 7 | 56262150 | 56263750 | d7Mseg1159 |

TABLE IVC-continued

Mouse Moderate Sites

| c/d | start | end | segment |
|---|---|---|---|
| 7 | 56676950 | 56678600 | d7Mseg1173 |
| 7 | 56916200 | 56917900 | d7Mseg1182 |
| 7 | 57018350 | 57020050 | d7Mseg1185 |
| 7 | 57091550 | 57093000 | d7Mseg1188 |
| 7 | 57094750 | 57096150 | d7Mseg1189 |
| 7 | 57111600 | 57113100 | d7Mseg1190 |
| 7 | 57126550 | 57128200 | d7Mseg1191 |
| 7 | 57137000 | 57138300 | d7Mseg1192 |
| 7 | 57669650 | 57670700 | d7Mseg1207 |
| 7 | 57736800 | 57738100 | d7Mseg1209 |
| 7 | 57761900 | 57763800 | d7Mseg1210 |
| 7 | 57787600 | 57789100 | d7Mseg1211 |
| 7 | 57966500 | 57968200 | d7Mseg1218 |
| 7 | 58298700 | 58299750 | d7Mseg1229 |
| 7 | 58346850 | 58348050 | d7Mseg1230 |
| 7 | 58456700 | 58458100 | d7Mseg1232 |
| 7 | 58540250 | 58542650 | d7Mseg1235 |
| 7 | 58650750 | 58652350 | d7Mseg1236 |
| 7 | 58750450 | 58752000 | d7Mseg1240 |
| 7 | 58789900 | 58791200 | d7Mseg1241 |
| 7 | 58809900 | 58813500 | d7Mseg1242 |
| 7 | 58918900 | 58919950 | d7Mseg1244 |
| 7 | 58926800 | 58928500 | d7Mseg1245 |
| 7 | 58938550 | 58940150 | d7Mseg1247 |
| 7 | 59099800 | 59101400 | d7Mseg1251 |
| 7 | 59634550 | 59636150 | d7Mseg1253 |
| 7 | 59760600 | 59762100 | d7Mseg1256 |
| 7 | 59780850 | 59782300 | d7Mseg1257 |
| 7 | 59824750 | 59826300 | d7Mseg1258 |
| 7 | 60135900 | 60137350 | d7Mseg1259 |
| 7 | 61078300 | 61079950 | d7Mseg1267 |
| 7 | 61137050 | 61138250 | d7Mseg1268 |
| 7 | 61364300 | 61365650 | d7Mseg1270 |
| 7 | 61823450 | 61825100 | d7Mseg1272 |
| 7 | 61861500 | 61863300 | d7Mseg1273 |
| 7 | 62268650 | 62270400 | d7Mseg1274 |
| 7 | 62518100 | 62519850 | d7Mseg1275 |
| 7 | 62756250 | 62757800 | d7Mseg1276 |
| 7 | 63237600 | 63239350 | d7Mseg1277 |
| 7 | 63309300 | 63310750 | d7Mseg1278 |
| 7 | 63375900 | 63377500 | d7Mseg1280 |
| 7 | 63524800 | 63526350 | d7Mseg1281 |
| 7 | 63938750 | 63940350 | d7Mseg1287 |
| 7 | 64017900 | 64019750 | d7Mseg1288 |
| 7 | 64357750 | 64359350 | d7Mseg1290 |
| 7 | 64575700 | 64576950 | d7Mseg1293 |
| 7 | 64721600 | 64723150 | d7Mseg1294 |
| 7 | 65151000 | 65152300 | d7Mseg1295 |
| 7 | 65334400 | 65336050 | d7Mseg1296 |
| 7 | 65467000 | 65468300 | d7Mseg1297 |
| 7 | 65506700 | 65507950 | d7Mseg1299 |
| 7 | 65657250 | 65658300 | d7Mseg1300 |
| 7 | 65767700 | 65769250 | d7Mseg1301 |
| 7 | 65819650 | 65821250 | d7Mseg1302 |
| 7 | 65842700 | 65844650 | d7Mseg1303 |
| 7 | 65866300 | 65867300 | d7Mseg1304 |
| 7 | 65873650 | 65875050 | d7Mseg1305 |
| 7 | 65972100 | 65973500 | d7Mseg1310 |
| 7 | 65976250 | 65977850 | d7Mseg1311 |
| 7 | 66003950 | 66005550 | d7Mseg1312 |
| 7 | 66061950 | 66063850 | d7Mseg1313 |
| 7 | 66073900 | 66075450 | d7Mseg1314 |
| 7 | 66139500 | 66140600 | d7Mseg1315 |
| 7 | 66173400 | 66175550 | d7Mseg1316 |
| 7 | 66194200 | 66195650 | d7Mseg1317 |
| 7 | 66239000 | 66240200 | d7Mseg1318 |
| 7 | 66287100 | 66288350 | d7Mseg1319 |
| 7 | 66439450 | 66441100 | d7Mseg1325 |
| 7 | 66459200 | 66460800 | d7Mseg1326 |
| 7 | 66489000 | 66490500 | d7Mseg1327 |
| 7 | 66525200 | 66526450 | d7Mseg1328 |
| 7 | 66788950 | 66790450 | d7Mseg1333 |
| 7 | 66859150 | 66860650 | d7Mseg1334 |
| 7 | 66922000 | 66923200 | d7Mseg1338 |
| 7 | 66924400 | 66926150 | d7Mseg1339 |
| 7 | 67156950 | 67158700 | d7Mseg1345 |
| 7 | 67192450 | 67193950 | d7Mseg1346 |
| 7 | 67223050 | 67224800 | d7Mseg1350 |
| 7 | 67284600 | 67286400 | d7Mseg1352 |
| 7 | 67295150 | 67296850 | d7Mseg1353 |
| 7 | 67527900 | 67529600 | d7Mseg1355 |
| 7 | 68030850 | 68032150 | d7Mseg1366 |
| 7 | 68052750 | 68054250 | d7Mseg1367 |
| 7 | 68214100 | 68215950 | d7Mseg1377 |
| 7 | 68317400 | 68318700 | d7Mseg1384 |
| 7 | 68319800 | 68321000 | d7Mseg1385 |
| 7 | 68451400 | 68453050 | d7Mseg1389 |
| 7 | 68571150 | 68572450 | d7Mseg1392 |
| 7 | 68574150 | 68575800 | d7Mseg1393 |
| 7 | 68593000 | 68594250 | d7Mseg1394 |
| 7 | 68719250 | 68720500 | d7Mseg1399 |
| 7 | 68778500 | 68779500 | d7Mseg1401 |
| 7 | 68861200 | 68864600 | d7Mseg1406 |
| 7 | 68892850 | 68894150 | d7Mseg1408 |
| 7 | 68897950 | 68899800 | d7Mseg1409 |
| 7 | 68943950 | 68945850 | d7Mseg1412 |
| 7 | 68971950 | 68973700 | d7Mseg1414 |
| 7 | 69100650 | 69102300 | d7Mseg1418 |
| 7 | 69139550 | 69140600 | d7Mseg1419 |
| 7 | 69193700 | 69195200 | d7Mseg1422 |
| 7 | 69197200 | 69198250 | d7Mseg1423 |
| 7 | 69265650 | 69267050 | d7Mseg1427 |
| 7 | 69313750 | 69314950 | d7Mseg1429 |
| 7 | 69316400 | 69317850 | d7Mseg1430 |
| 7 | 69354100 | 69355850 | d7Mseg1432 |
| 7 | 69409350 | 69411150 | d7Mseg1434 |
| 7 | 69538900 | 69540600 | d7Mseg1437 |
| 7 | 69546550 | 69548450 | d7Mseg1438 |
| 7 | 69558300 | 69560100 | d7Mseg1439 |
| 7 | 69568050 | 69569250 | d7Mseg1440 |
| 7 | 69588100 | 69589850 | d7Mseg1441 |
| 7 | 69637550 | 69639400 | d7Mseg1442 |
| 7 | 69676250 | 69677650 | d7Mseg1444 |
| 7 | 69709300 | 69710950 | d7Mseg1447 |
| 7 | 69809050 | 69810700 | d7Mseg1450 |
| 7 | 69848600 | 69850300 | d7Mseg1452 |
| 7 | 69945350 | 69947100 | d7Mseg1454 |
| 7 | 69996600 | 69998450 | d7Mseg1455 |
| 7 | 70033000 | 70034650 | d7Mseg1456 |
| 7 | 70094650 | 70096200 | d7Mseg1459 |
| 7 | 70099900 | 70101300 | d7Mseg1460 |
| 7 | 70268100 | 70269400 | d7Mseg1467 |
| 7 | 70270650 | 70272000 | d7Mseg1468 |
| 7 | 70291500 | 70293000 | d7Mseg1470 |
| 7 | 70335350 | 70336750 | d7Mseg1472 |
| 7 | 70348050 | 70349250 | d7Mseg1473 |
| 7 | 70469400 | 70470700 | d7Mseg1474 |
| 7 | 70506150 | 70507700 | d7Mseg1477 |
| 7 | 70585400 | 70587050 | d7Mseg1480 |
| 7 | 70615600 | 70616650 | d7Mseg1482 |
| 7 | 70619800 | 70621550 | d7Mseg1483 |
| 7 | 70625150 | 70626250 | d7Mseg1484 |
| 7 | 70833800 | 70835450 | d7Mseg1499 |
| 7 | 70837300 | 70838700 | d7Mseg1500 |
| 7 | 70849300 | 70851050 | d7Mseg1501 |
| 7 | 70895500 | 70897350 | d7Mseg1505 |
| 7 | 70990450 | 70993350 | d7Mseg1511 |
| 7 | 70996100 | 70998000 | d7Mseg1512 |
| 7 | 71064950 | 71066550 | d7Mseg1514 |
| 7 | 71132100 | 71133350 | d7Mseg1519 |
| 7 | 71251100 | 71253700 | d7Mseg1528 |
| 7 | 71303750 | 71305250 | d7Mseg1531 |
| 7 | 71604250 | 71606100 | d7Mseg1544 |
| 7 | 71625450 | 71626850 | d7Mseg1545 |
| 7 | 71646950 | 71648400 | d7Mseg1546 |
| 7 | 71706750 | 71708300 | d7Mseg1549 |
| 7 | 71751500 | 71753050 | d7Mseg1550 |
| 7 | 71823600 | 71825250 | d7Mseg1551 |
| 7 | 71855400 | 71857200 | d7Mseg1552 |
| 7 | 71872250 | 71873500 | d7Mseg1553 |
| 7 | 72002400 | 72004050 | d7Mseg1555 |
| 7 | 72107200 | 72108850 | d7Mseg1556 |

TABLE IVC-continued

Mouse Moderate Sites

| c/d | start | end | segment |
|---|---|---|---|
| 7 | 72198400 | 72200050 | d7Mseg1557 |
| 7 | 72226450 | 72228150 | d7Mseg1559 |
| 7 | 72257350 | 72258400 | d7Mseg1560 |
| 7 | 72385650 | 72389350 | d7Mseg1564 |
| 7 | 72521600 | 72523200 | d7Mseg1567 |
| 7 | 72573300 | 72575000 | d7Mseg1569 |
| 7 | 72708100 | 72711150 | d7Mseg1571 |
| 7 | 72712300 | 72714200 | d7Mseg1572 |
| 7 | 72772100 | 72773300 | d7Mseg1575 |
| 7 | 72869150 | 72870500 | d7Mseg1578 |
| 7 | 73209650 | 73212600 | d7Mseg1584 |
| 7 | 73549600 | 73550650 | d7Mseg1587 |
| 7 | 73739700 | 73741450 | d7Mseg1588 |
| 7 | 73875550 | 73876550 | d7Mseg1589 |
| 7 | 73902100 | 73903350 | d7Mseg1590 |
| 7 | 73920800 | 73922400 | d7Mseg1591 |
| 7 | 74085350 | 74087200 | d7Mseg1593 |
| 7 | 74282300 | 74283350 | d7Mseg1594 |
| 7 | 74372100 | 74373900 | d7Mseg1595 |
| 7 | 74549300 | 74550700 | d7Mseg1596 |
| 7 | 74583900 | 74585500 | d7Mseg1597 |
| 7 | 74630000 | 74631600 | d7Mseg1598 |
| 7 | 74785250 | 74786600 | d7Mseg1603 |
| 7 | 74867250 | 74869250 | d7Mseg1604 |
| 7 | 74971350 | 74972400 | d7Mseg1606 |
| 7 | 75019350 | 75020850 | d7Mseg1607 |
| 7 | 75041950 | 75043150 | d7Mseg1608 |
| 7 | 75150900 | 75151950 | d7Mseg1609 |
| 7 | 75259000 | 75260900 | d7Mseg1610 |
| 7 | 75400300 | 75401750 | d7Mseg1611 |
| 7 | 76101300 | 76103050 | d7Mseg1614 |
| 7 | 76463300 | 76464950 | d7Mseg1615 |
| 7 | 76829900 | 76831550 | d7Mseg1617 |
| 7 | 77160900 | 77162600 | d7Mseg1618 |
| 7 | 77486000 | 77487400 | d7Mseg1620 |
| 7 | 77576950 | 77578850 | d7Mseg1621 |
| 7 | 77621200 | 77622850 | d7Mseg1622 |
| 7 | 77679000 | 77680550 | d7Mseg1623 |
| 7 | 78026800 | 78028300 | d7Mseg1624 |
| 7 | 78277700 | 78278800 | d7Mseg1625 |
| 7 | 78425900 | 78427400 | d7Mseg1630 |
| 7 | 79127150 | 79128700 | d7Mseg1631 |
| 7 | 79314800 | 79316200 | d7Mseg1632 |
| 7 | 79604200 | 79605850 | d7Mseg1633 |
| 7 | 79685550 | 79687300 | d7Mseg1635 |
| 7 | 79772650 | 79773850 | d7Mseg1636 |
| 7 | 80044500 | 80045800 | d7Mseg1637 |
| 7 | 80112650 | 80114450 | d7Mseg1638 |
| 7 | 80224900 | 80226500 | d7Mseg1640 |
| 7 | 80559250 | 80560450 | d7Mseg1645 |
| 7 | 80563150 | 80564300 | d7Mseg1646 |
| 7 | 80644850 | 80646000 | d7Mseg1648 |
| 7 | 80653800 | 80655500 | d7Mseg1649 |
| 7 | 80660600 | 80661700 | d7Mseg1650 |
| 7 | 80667950 | 80669650 | d7Mseg1651 |
| 7 | 80686750 | 80688600 | d7Mseg1652 |
| 7 | 80726050 | 80728050 | d7Mseg1653 |
| 7 | 80731550 | 80733750 | d7Mseg1654 |
| 7 | 80997600 | 80999450 | d7Mseg1658 |
| 7 | 81006200 | 81007600 | d7Mseg1659 |
| 7 | 81042250 | 81044100 | d7Mseg1661 |
| 7 | 81117750 | 81119450 | d7Mseg1662 |
| 7 | 81261850 | 81263600 | d7Mseg1665 |
| 7 | 81382100 | 81383450 | d7Mseg1667 |
| 7 | 81649050 | 81650850 | d7Mseg1673 |
| 7 | 81743200 | 81744850 | d7Mseg1675 |
| 7 | 82108450 | 82109950 | d7Mseg1687 |
| 7 | 82140650 | 82142150 | d7Mseg1691 |
| 7 | 82273850 | 82275550 | d7Mseg1699 |
| 7 | 82376300 | 82378100 | d7Mseg1705 |
| 7 | 82462000 | 82463550 | d7Mseg1708 |
| 7 | 82551950 | 82553050 | d7Mseg1711 |
| 7 | 82583900 | 82584900 | d7Mseg1712 |
| 7 | 82764350 | 82765600 | d7Mseg1716 |
| 7 | 82930750 | 82932500 | d7Mseg1722 |
| 7 | 82962000 | 82963000 | d7Mseg1723 |
| 7 | 82968650 | 82970550 | d7Mseg1724 |
| 7 | 83032600 | 83034300 | d7Mseg1726 |
| 7 | 83067200 | 83068650 | d7Mseg1727 |
| 7 | 83250450 | 83253200 | d7Mseg1733 |
| 7 | 83262400 | 83263550 | d7Mseg1734 |
| 7 | 83317050 | 83318600 | d7Mseg1735 |
| 7 | 83365600 | 83367250 | d7Mseg1737 |
| 7 | 83450200 | 83451800 | d7Mseg1740 |
| 7 | 83560850 | 83562500 | d7Mseg1743 |
| 7 | 83579100 | 83580900 | d7Mseg1744 |
| 7 | 83598400 | 83600300 | d7Mseg1746 |
| 7 | 83666200 | 83670050 | d7Mseg1749 |
| 7 | 83712000 | 83713750 | d7Mseg1751 |
| 7 | 83832800 | 83834350 | d7Mseg1753 |
| 7 | 83860050 | 83861050 | d7Mseg1754 |
| 7 | 84083800 | 84085250 | d7Mseg1761 |
| 7 | 84380200 | 84381550 | d7Mseg1768 |
| 7 | 84622300 | 84623600 | d7Mseg1772 |
| 7 | 84631300 | 84632550 | d7Mseg1773 |
| 7 | 84770700 | 84772450 | d7Mseg1777 |
| 7 | 84875650 | 84876700 | d7Mseg1778 |
| 7 | 85029300 | 85030300 | d7Mseg1783 |
| 7 | 85039400 | 85041050 | d7Mseg1784 |
| 7 | 85544550 | 85546200 | d7Mseg1794 |
| 7 | 85672050 | 85673500 | d7Mseg1795 |
| 7 | 86047150 | 86048700 | d7Mseg1799 |
| 7 | 86161550 | 86162650 | d7Mseg1800 |
| 7 | 86637350 | 86639350 | d7Mseg1801 |
| 7 | 86664300 | 86665550 | d7Mseg1802 |
| 7 | 86834100 | 86835300 | d7Mseg1803 |
| 7 | 86913350 | 86914850 | d7Mseg1804 |
| 7 | 86977100 | 86978300 | d7Mseg1805 |
| 7 | 87009300 | 87010850 | d7Mseg1806 |
| 7 | 87040700 | 87042300 | d7Mseg1807 |
| 7 | 88123050 | 88124550 | d7Mseg1809 |
| 7 | 88143100 | 88144750 | d7Mseg1810 |
| 7 | 88426250 | 88427900 | d7Mseg1812 |
| 7 | 88631350 | 88633150 | d7Mseg1814 |
| 7 | 88656050 | 88657250 | d7Mseg1815 |
| 7 | 88788950 | 88790700 | d7Mseg1816 |
| 7 | 89851450 | 89852900 | d7Mseg1826 |
| 7 | 89975900 | 89977050 | d7Mseg1830 |
| 7 | 90105400 | 90106750 | d7Mseg1834 |
| 7 | 90138500 | 90140200 | d7Mseg1835 |
| 7 | 90222300 | 90223400 | d7Mseg1837 |
| 7 | 90233300 | 90235150 | d7Mseg1838 |
| 7 | 90242900 | 90244450 | d7Mseg1839 |
| 7 | 90384750 | 90386550 | d7Mseg1843 |
| 7 | 90412350 | 90413850 | d7Mseg1845 |
| 7 | 90442800 | 90444250 | d7Mseg1846 |
| 7 | 90595700 | 90597450 | d7Mseg1851 |
| 7 | 90641400 | 90642800 | d7Mseg1852 |
| 7 | 90856400 | 90857900 | d7Mseg1858 |
| 7 | 90888300 | 90889850 | d7Mseg1859 |
| 7 | 91128750 | 91132950 | d7Mseg1872 |
| 7 | 91167350 | 91168700 | d7Mseg1876 |
| 7 | 91187150 | 91189200 | d7Mseg1877 |
| 7 | 91233600 | 91237800 | d7Mseg1880 |
| 7 | 91284700 | 91288400 | d7Mseg1883 |
| 7 | 91289450 | 91291250 | d7Mseg1884 |
| 7 | 91405250 | 91406650 | d7Mseg1889 |
| 7 | 91541050 | 91542500 | d7Mseg1896 |
| 7 | 91559900 | 91561500 | d7Mseg1897 |
| 7 | 91597950 | 91599250 | d7Mseg1902 |
| 7 | 91600700 | 91604600 | d7Mseg1903 |
| 7 | 91650300 | 91651600 | d7Mseg1907 |
| 7 | 91670700 | 91671700 | d7Mseg1908 |
| 7 | 91713250 | 91714850 | d7Mseg1910 |
| 7 | 91727350 | 91728700 | d7Mseg1911 |
| 7 | 91747100 | 91748300 | d7Mseg1912 |
| 7 | 91755800 | 91757500 | d7Mseg1913 |
| 7 | 91769350 | 91771250 | d7Mseg1914 |
| 7 | 91791500 | 91792700 | d7Mseg1917 |
| 7 | 91818050 | 91819700 | d7Mseg1919 |
| 7 | 91864550 | 91866450 | d7Mseg1920 |
| 7 | 91886000 | 91887000 | d7Mseg1922 |

TABLE IVC-continued

Mouse Moderate Sites

| c/d | start | end | segment |
|---|---|---|---|
| 7 | 91893900 | 91895050 | d7Mseg1924 |
| 7 | 91901750 | 91903650 | d7Mseg1925 |
| 7 | 91916750 | 91920300 | d7Mseg1926 |
| 7 | 91964250 | 91965350 | d7Mseg1927 |
| 7 | 91977800 | 91979550 | d7Mseg1929 |
| 7 | 92003150 | 92005050 | d7Mseg1930 |
| 7 | 92019100 | 92020400 | d7Mseg1931 |
| 7 | 92035250 | 92039800 | d7Mseg1932 |
| 7 | 92063300 | 92064800 | d7Mseg1933 |
| 7 | 92076550 | 92078300 | d7Mseg1934 |
| 7 | 92099050 | 92100650 | d7Mseg1935 |
| 7 | 92110950 | 92111950 | d7Mseg1936 |
| 7 | 92116800 | 92119750 | d7Mseg1937 |
| 7 | 92179650 | 92181300 | d7Mseg1938 |
| 7 | 92212450 | 92213650 | d7Mseg1939 |
| 7 | 92321100 | 92322550 | d7Mseg1946 |
| 7 | 92381000 | 92382850 | d7Mseg1951 |
| 7 | 92478100 | 92479900 | d7Mseg1952 |
| 7 | 92647200 | 92648350 | d7Mseg1957 |
| 7 | 92676050 | 92677250 | d7Mseg1960 |
| 7 | 92678350 | 92681100 | d7Mseg1961 |
| 7 | 92686450 | 92687750 | d7Mseg1962 |
| 7 | 92701300 | 92702400 | d7Mseg1963 |
| 7 | 92727750 | 92729400 | d7Mseg1965 |
| 7 | 92794200 | 92796000 | d7Mseg1966 |
| 7 | 92862350 | 92864200 | d7Mseg1967 |
| 7 | 92871050 | 92872650 | d7Mseg1968 |
| 7 | 92924000 | 92925550 | d7Mseg1971 |
| 7 | 92966050 | 92967650 | d7Mseg1972 |
| 7 | 92988700 | 92990750 | d7Mseg1973 |
| 7 | 93035700 | 93037300 | d7Mseg1974 |
| 7 | 93078700 | 93080750 | d7Mseg1975 |
| 7 | 93160450 | 93162000 | d7Mseg1977 |
| 7 | 93261400 | 93263450 | d7Mseg1982 |
| 7 | 93334400 | 93336100 | d7Mseg1987 |
| 7 | 93447300 | 93448950 | d7Mseg1990 |
| 7 | 93482600 | 93483750 | d7Mseg1991 |
| 7 | 93518500 | 93519750 | d7Mseg1994 |
| 7 | 93613750 | 93615350 | d7Mseg1995 |
| 7 | 93630850 | 93632600 | d7Mseg1996 |
| 7 | 93639800 | 93641500 | d7Mseg1997 |
| 7 | 93671250 | 93673150 | d7Mseg1998 |
| 7 | 93686750 | 93687750 | d7Mseg1999 |
| 7 | 93698300 | 93699600 | d7Mseg2001 |
| 7 | 93760100 | 93761600 | d7Mseg2003 |
| 7 | 93823400 | 93824900 | d7Mseg2004 |
| 7 | 93891750 | 93893450 | d7Mseg2005 |
| 7 | 93895900 | 93897450 | d7Mseg2006 |
| 7 | 94070200 | 94071800 | d7Mseg2007 |
| 7 | 94090250 | 94092300 | d7Mseg2008 |
| 7 | 94096350 | 94098050 | d7Mseg2009 |
| 7 | 94120450 | 94122950 | d7Mseg2010 |
| 7 | 94140900 | 94142850 | d7Mseg2011 |
| 7 | 94179250 | 94180550 | d7Mseg2013 |
| 7 | 94264000 | 94265550 | d7Mseg2014 |
| 7 | 94268500 | 94270150 | d7Mseg2015 |
| 7 | 94321100 | 94322850 | d7Mseg2016 |
| 7 | 94334850 | 94336550 | d7Mseg2017 |
| 7 | 94408500 | 94410000 | d7Mseg2018 |
| 7 | 94440600 | 94441900 | d7Mseg2019 |
| 7 | 94645350 | 94646450 | d7Mseg2024 |
| 7 | 94687150 | 94688500 | d7Mseg2025 |
| 7 | 94730450 | 94733550 | d7Mseg2026 |
| 7 | 94785700 | 94787200 | d7Mseg2027 |
| 7 | 94824850 | 94826450 | d7Mseg2028 |
| 7 | 94827500 | 94828550 | d7Mseg2029 |
| 7 | 94877300 | 94878450 | d7Mseg2030 |
| 7 | 94919550 | 94920650 | d7Mseg2032 |
| 7 | 94974750 | 94976250 | d7Mseg2033 |
| 7 | 95025800 | 95027500 | d7Mseg2034 |
| 7 | 95067450 | 95069150 | d7Mseg2036 |
| 7 | 95228050 | 95229850 | d7Mseg2037 |
| 7 | 95242500 | 95243500 | d7Mseg2038 |
| 7 | 95293250 | 95294500 | d7Mseg2039 |
| 7 | 95339750 | 95341600 | d7Mseg2040 |
| 7 | 95471650 | 95475650 | d7Mseg2049 |
| 7 | 95531000 | 95532000 | d7Mseg2050 |
| 7 | 95594400 | 95595900 | d7Mseg2051 |
| 7 | 95988850 | 95990400 | d7Mseg2060 |
| 7 | 96012100 | 96015100 | d7Mseg2061 |
| 7 | 96224400 | 96226250 | d7Mseg2069 |
| 7 | 96573750 | 96575400 | d7Mseg2099 |
| 7 | 96840950 | 96842900 | d7Mseg2119 |
| 7 | 96866250 | 96867750 | d7Mseg2122 |
| 7 | 96896450 | 96898750 | d7Mseg2125 |
| 7 | 96956300 | 96958300 | d7Mseg2126 |
| 7 | 96966450 | 96967950 | d7Mseg2127 |
| 7 | 96993650 | 96994900 | d7Mseg2128 |
| 7 | 97107350 | 97108950 | d7Mseg2133 |
| 7 | 97229950 | 97231100 | d7Mseg2140 |
| 7 | 97237150 | 97240100 | d7Mseg2141 |
| 7 | 97271350 | 97273300 | d7Mseg2142 |
| 7 | 97319800 | 97321300 | d7Mseg2145 |
| 7 | 97331950 | 97333200 | d7Mseg2146 |
| 7 | 97402500 | 97403950 | d7Mseg2151 |
| 7 | 97629450 | 97630600 | d7Mseg2154 |
| 7 | 97646000 | 97647750 | d7Mseg2156 |
| 7 | 97656450 | 97658400 | d7Mseg2157 |
| 7 | 97730150 | 97731700 | d7Mseg2161 |
| 7 | 97840050 | 97841800 | d7Mseg2166 |
| 7 | 98019650 | 98020800 | d7Mseg2175 |
| 7 | 98031050 | 98032900 | d7Mseg2176 |
| 7 | 98104100 | 98105800 | d7Mseg2178 |
| 7 | 98119550 | 98121850 | d7Mseg2179 |
| 7 | 98163500 | 98165400 | d7Mseg2181 |
| 7 | 98199250 | 98200300 | d7Mseg2182 |
| 7 | 98249300 | 98250550 | d7Mseg2184 |
| 7 | 98253850 | 98256950 | d7Mseg2185 |
| 7 | 98265150 | 98267050 | d7Mseg2186 |
| 7 | 98286800 | 98288200 | d7Mseg2188 |
| 7 | 98318150 | 98320000 | d7Mseg2189 |
| 7 | 98332350 | 98333600 | d7Mseg2190 |
| 7 | 98368200 | 98369800 | d7Mseg2191 |
| 7 | 98556150 | 98557900 | d7Mseg2200 |
| 7 | 98701800 | 98704650 | d7Mseg2209 |
| 7 | 98799700 | 98804050 | d7Mseg2210 |
| 7 | 98821350 | 98823250 | d7Mseg2211 |
| 7 | 98947250 | 98950200 | d7Mseg2218 |
| 7 | 98955400 | 98958650 | d7Mseg2219 |
| 7 | 98981300 | 98983100 | d7Mseg2221 |
| 7 | 98999450 | 99001100 | d7Mseg2223 |
| 7 | 99008200 | 99009950 | d7Mseg2224 |
| 7 | 99027350 | 99029050 | d7Mseg2225 |
| 7 | 99100850 | 99104750 | d7Mseg2233 |
| 7 | 99302700 | 99304600 | d7Mseg2246 |
| 7 | 99401150 | 99402750 | d7Mseg2252 |
| 7 | 99430550 | 99431550 | d7Mseg2253 |
| 7 | 99459250 | 99460750 | d7Mseg2256 |
| 7 | 99471500 | 99473200 | d7Mseg2257 |
| 7 | 99646350 | 99648100 | d7Mseg2266 |
| 7 | 99798500 | 99799900 | d7Mseg2271 |
| 7 | 99845100 | 99847100 | d7Mseg2273 |
| 7 | 99863350 | 99864500 | d7Mseg2274 |
| 7 | 99946750 | 99948300 | d7Mseg2278 |
| 7 | 99964000 | 99965550 | d7Mseg2279 |
| 7 | 99968500 | 99970450 | d7Mseg2280 |
| 7 | 99904950 | 99986500 | d7Mseg2282 |
| 7 | 99994250 | 99995450 | d7Mseg2283 |
| 7 | 100014150 | 100015850 | d7Mseg2284 |
| 7 | 100028950 | 100031050 | d7Mseg2286 |
| 7 | 100036850 | 100038650 | d7Mseg2287 |
| 7 | 100053600 | 100056350 | d7Mseg2288 |
| 7 | 100062000 | 100065450 | d7Mseg2289 |
| 7 | 100141500 | 100143100 | d7Mseg2292 |
| 7 | 100171450 | 100172900 | d7Mseg2293 |
| 7 | 100175800 | 100177150 | d7Mseg2294 |
| 7 | 100184100 | 100185600 | d7Mseg2295 |
| 7 | 100189250 | 100190250 | d7Mseg2296 |
| 7 | 100242750 | 100244400 | d7Mseg2298 |
| 7 | 100246950 | 100248700 | d7Mseg2299 |
| 7 | 100259250 | 100261150 | d7Mseg2300 |
| 7 | 100281350 | 100283000 | d7Mseg2301 |

TABLE IVC-continued

Mouse Moderate Sites

| c/d | start | end | segment |
|---|---|---|---|
| 7 | 100304650 | 100306000 | d7Mseg2302 |
| 7 | 100343800 | 100345400 | d7Mseg2303 |
| 7 | 100359250 | 100361100 | d7Mseg2304 |
| 7 | 100371600 | 100372800 | d7Mseg2305 |
| 7 | 100401400 | 100404400 | d7Mseg2306 |
| 7 | 100430850 | 100432600 | d7Mseg2307 |
| 7 | 100491450 | 100492900 | d7Mseg2308 |
| 7 | 100542500 | 100543850 | d7Mseg2312 |
| 7 | 100593650 | 100595150 | d7Mseg2315 |
| 7 | 100617500 | 100619350 | d7Mseg2317 |
| 7 | 100626400 | 100627550 | d7Mseg2318 |
| 7 | 100631800 | 100633850 | d7Mseg2319 |
| 7 | 100687100 | 100688800 | d7Mseg2321 |
| 7 | 100690700 | 100692350 | d7Mseg2322 |
| 7 | 100724000 | 100725850 | d7Mseg2323 |
| 7 | 100795550 | 100796950 | d7Mseg2324 |
| 7 | 100955000 | 100956600 | d7Mseg2330 |
| 7 | 101025150 | 101026500 | d7Mseg2337 |
| 7 | 101038600 | 101040600 | d7Mseg2338 |
| 7 | 101047850 | 101049800 | d7Mseg2339 |
| 7 | 101060950 | 101062550 | d7Mseg2340 |
| 7 | 101092200 | 101094200 | d7Mseg2342 |
| 7 | 101098550 | 101099650 | d7Mseg2343 |
| 7 | 101110650 | 101112550 | d7Mseg2344 |
| 7 | 101115300 | 101117250 | d7Mseg2345 |
| 7 | 101122750 | 101123750 | d7Mseg2346 |
| 7 | 101144300 | 101146050 | d7Mseg2347 |
| 7 | 101198250 | 101201800 | d7Mseg2352 |
| 7 | 101214150 | 101215650 | d7Mseg2354 |
| 7 | 101219800 | 101224350 | d7Mseg2355 |
| 7 | 101228050 | 101229950 | d7Mseg2356 |
| 7 | 101240100 | 101241800 | d7Mseg2357 |
| 7 | 101285250 | 101286450 | d7Mseg2360 |
| 7 | 101455800 | 101457700 | d7Mseg2364 |
| 7 | 101480450 | 101482200 | d7Mseg2365 |
| 7 | 101528100 | 101532450 | d7Mseg2367 |
| 7 | 101541300 | 101544300 | d7Mseg2368 |
| 7 | 101585100 | 101586800 | d7Mseg2370 |
| 7 | 101662800 | 101664850 | d7Mseg2375 |
| 7 | 101707850 | 101709500 | d7Mseg2379 |
| 7 | 101796600 | 101800900 | d7Mseg2383 |
| 7 | 101854300 | 101855650 | d7Mseg2386 |
| 7 | 101894700 | 101896000 | d7Mseg2390 |
| 7 | 101910200 | 101911600 | d7Mseg2391 |
| 7 | 101914900 | 101916700 | d7Mseg2392 |
| 7 | 101941250 | 101943000 | d7Mseg2393 |
| 7 | 101956100 | 101958100 | d7Mseg2394 |
| 7 | 101989100 | 101991000 | d7Mseg2396 |
| 7 | 102072700 | 102073700 | d7Mseg2399 |
| 7 | 102095500 | 102098550 | d7Mseg2400 |
| 7 | 102118050 | 102119750 | d7Mseg2401 |
| 7 | 102141200 | 102143500 | d7Mseg2402 |
| 7 | 102176450 | 102178200 | d7Mseg2404 |
| 7 | 102195400 | 102199000 | d7Mseg2405 |
| 7 | 102202900 | 102204350 | d7Mseg2406 |
| 7 | 102207450 | 102210200 | d7Mseg2407 |
| 7 | 102212350 | 102214050 | d7Mseg2408 |
| 7 | 102222300 | 102224050 | d7Mseg2409 |
| 7 | 102228100 | 102229200 | d7Mseg2410 |
| 7 | 102312250 | 102317450 | d7Mseg2411 |
| 7 | 102335100 | 102336150 | d7Mseg2412 |
| 7 | 102345400 | 102347100 | d7Mseg2413 |
| 7 | 102348750 | 102349750 | d7Mseg2414 |
| 7 | 102483200 | 102484850 | d7Mseg2417 |
| 7 | 102708300 | 102710250 | d7Mseg2425 |
| 7 | 102712550 | 102713550 | d7Mseg2426 |
| 7 | 102746000 | 102748100 | d7Mseg2428 |
| 7 | 102784250 | 102785450 | d7Mseg2430 |
| 7 | 102895600 | 102898450 | d7Mseg2433 |
| 7 | 102920350 | 102921650 | d7Mseg2434 |
| 7 | 102925850 | 102927350 | d7Mseg2435 |
| 7 | 102948850 | 102950050 | d7Mseg2436 |
| 7 | 102981950 | 102983200 | d7Mseg2439 |
| 7 | 103151550 | 103153500 | d7Mseg2444 |
| 7 | 103254000 | 103255800 | d7Mseg2447 |
| 7 | 103298500 | 103300250 | d7Mseg2450 |
| 7 | 103400100 | 103401500 | d7Mseg2451 |
| 7 | 103532500 | 103534450 | d7Mseg2454 |
| 7 | 103551950 | 103553400 | d7Mseg2456 |
| 7 | 103554800 | 103556200 | d7Mseg2457 |
| 7 | 103607350 | 103609600 | d7Mseg2458 |
| 7 | 103614500 | 103616200 | d7Mseg2459 |
| 7 | 103617800 | 103619650 | d7Mseg2460 |
| 7 | 103659000 | 103660900 | d7Mseg2463 |
| 7 | 103678450 | 103680550 | d7Mseg2464 |
| 7 | 103701400 | 103702950 | d7Mseg2465 |
| 7 | 103714450 | 103716100 | d7Mseg2466 |
| 7 | 103736950 | 103738400 | d7Mseg2467 |
| 7 | 103810800 | 103812550 | d7Mseg2468 |
| 7 | 103826550 | 103828400 | d7Mseg2469 |
| 7 | 103834900 | 103836400 | d7Mseg2471 |
| 7 | 103891800 | 103893250 | d7Mseg2472 |
| 7 | 103960650 | 103962650 | d7Mseg2473 |
| 7 | 103968100 | 103969650 | d7Mseg2474 |
| 7 | 103974800 | 103976000 | d7Mseg2475 |
| 7 | 103986650 | 103987800 | d7Mseg2476 |
| 7 | 104024500 | 104025650 | d7Mseg2480 |
| 7 | 104045400 | 104046750 | d7Mseg2483 |
| 7 | 104189500 | 104190900 | d7Mseg2489 |
| 7 | 104265000 | 104266050 | d7Mseg2490 |
| 7 | 104303300 | 104304650 | d7Mseg2492 |
| 7 | 104316900 | 104318900 | d7Mseg2493 |
| 7 | 104326650 | 104327650 | d7Mseg2494 |
| 7 | 104426450 | 104428500 | d7Mseg2497 |
| 7 | 104543100 | 104544900 | d7Mseg2500 |
| 7 | 104638500 | 104640150 | d7Mseg2503 |
| 7 | 104730500 | 104732300 | d7Mseg2504 |
| 7 | 104776450 | 104778200 | d7Mseg2505 |
| 7 | 104787150 | 104788600 | d7Mseg2506 |
| 7 | 104957950 | 104959000 | d7Mseg2508 |
| 7 | 105113750 | 105115000 | d7Mseg2512 |
| 7 | 105236000 | 105237750 | d7Mseg2513 |
| 7 | 105718850 | 105720750 | d7Mseg2514 |
| 7 | 105734400 | 105736150 | d7Mseg2515 |
| 7 | 105754800 | 105756350 | d7Mseg2516 |
| 7 | 105771800 | 105772950 | d7Mseg2517 |
| 7 | 105790250 | 105791750 | d7Mseg2518 |
| 7 | 105834850 | 105836000 | d7Mseg2519 |
| 7 | 105909850 | 105910850 | d7Mseg2520 |
| 7 | 105912900 | 105914350 | d7Mseg2521 |
| 7 | 106034050 | 106035400 | d7Mseg2523 |
| 7 | 106130650 | 106132450 | d7Mseg2525 |
| 7 | 106191250 | 106192800 | d7Mseg2526 |
| 7 | 106195700 | 106197350 | d7Mseg2527 |
| 7 | 106215800 | 106217800 | d7Mseg2530 |
| 7 | 106368300 | 106370150 | d7Mseg2536 |
| 7 | 106372850 | 106374450 | d7Mseg2537 |
| 7 | 106431000 | 106432500 | d7Mseg2539 |
| 7 | 106500900 | 106502500 | d7Mseg2540 |
| 7 | 106621050 | 106622350 | d7Mseg2541 |
| 7 | 106704400 | 106705550 | d7Mseg2542 |
| 7 | 107064150 | 107065650 | d7Mseg2546 |
| 7 | 107136000 | 107137350 | d7Mseg2547 |
| 7 | 107246700 | 107248150 | d7Mseg2550 |
| 7 | 107451300 | 107452800 | d7Mseg2551 |
| 7 | 107570650 | 107572100 | d7Mseg2553 |
| 7 | 107790100 | 107791400 | d7Mseg2554 |
| 7 | 107951050 | 107952500 | d7Mseg2558 |
| 7 | 107979300 | 107980900 | d7Mseg2560 |
| 7 | 107988500 | 107990000 | d7Mseg2561 |
| 7 | 107991550 | 107992600 | d7Mseg2562 |
| 7 | 108036800 | 108038650 | d7Mseg2565 |
| 7 | 108172050 | 108173250 | d7Mseg2566 |
| 7 | 108387950 | 108389400 | d7Mseg2567 |
| 7 | 108416950 | 108418050 | d7Mseg2568 |
| 7 | 108753500 | 108755100 | d7Mseg2578 |
| 7 | 108926650 | 108928400 | d7Mseg2582 |
| 7 | 109005500 | 109010500 | d7Mseg2583 |
| 7 | 109012800 | 109014600 | d7Mseg2584 |
| 7 | 109026400 | 109032350 | d7Mseg2585 |
| 7 | 109055700 | 109057400 | d7Mseg2586 |
| 7 | 109078950 | 109080450 | d7Mseg2587 |

TABLE IVC-continued

Mouse Moderate Sites

| c/d | start | end | segment |
|---|---|---|---|
| 7 | 109113750 | 109115050 | d7Mseg2588 |
| 7 | 109194450 | 109196250 | d7Mseg2589 |
| 7 | 109253950 | 109255750 | d7Mseg2591 |
| 7 | 109304150 | 109305750 | d7Mseg2592 |
| 7 | 109393800 | 109395700 | d7Mseg2594 |
| 7 | 109399400 | 109401250 | d7Mseg2595 |
| 7 | 109402850 | 109403900 | d7Mseg2596 |
| 7 | 109408000 | 109409300 | d7Mseg2597 |
| 7 | 109436700 | 109437900 | d7Mseg2599 |
| 7 | 109633300 | 109635150 | d7Mseg2605 |
| 7 | 109689050 | 109690900 | d7Mseg2606 |
| 7 | 109699600 | 109701400 | d7Mseg2607 |
| 7 | 109792300 | 109793950 | d7Mseg2611 |
| 7 | 109819000 | 109820350 | d7Mseg2613 |
| 7 | 109934350 | 109936000 | d7Mseg2615 |
| 7 | 110060600 | 110062500 | d7Mseg2617 |
| 7 | 110352400 | 110353400 | d7Mseg2621 |
| 7 | 110603300 | 110604850 | d7Mseg2629 |
| 7 | 110634100 | 110635550 | d7Mseg2631 |
| 7 | 110726250 | 110728150 | d7Mseg2632 |
| 7 | 110984800 | 110986000 | d7Mseg2636 |
| 7 | 111049350 | 111051000 | d7Mseg2638 |
| 7 | 111081150 | 111082250 | d7Mseg2639 |
| 7 | 111235600 | 111237550 | d7Mseg2640 |
| 7 | 111697650 | 111699350 | d7Mseg2643 |
| 7 | 111724750 | 111726250 | d7Mseg2644 |
| 7 | 111799650 | 111801400 | d7Mseg2646 |
| 7 | 111848150 | 111849550 | d7Mseg2647 |
| 7 | 111881950 | 111883350 | d7Mseg2648 |
| 7 | 112086950 | 112088450 | d7Mseg2649 |
| 7 | 112466650 | 112467650 | d7Mseg2651 |
| 7 | 112637950 | 112639450 | d7Mseg2652 |
| 7 | 112804550 | 112806250 | d7Mseg2653 |
| 7 | 112968450 | 112970450 | d7Mseg2654 |
| 7 | 113022200 | 113024050 | d7Mseg2655 |
| 7 | 113541850 | 113543250 | d7Mseg2656 |
| 7 | 113819300 | 113821250 | d7Mseg2657 |
| 7 | 114172100 | 114174100 | d7Mseg2658 |
| 7 | 114281400 | 114282950 | d7Mseg2659 |
| 7 | 114668600 | 114670100 | d7Mseg2660 |
| 7 | 114723350 | 114724850 | d7Mseg2661 |
| 7 | 114848500 | 114850000 | d7Mseg2663 |
| 7 | 115051000 | 115052850 | d7Mseg2664 |
| 7 | 115682900 | 115684350 | d7Mseg2665 |
| 7 | 115693000 | 115694250 | d7Mseg2666 |
| 7 | 115735700 | 115737000 | d7Mseg2667 |
| 7 | 115993000 | 115994800 | d7Mseg2668 |
| 7 | 116084650 | 116086150 | d7Mseg2669 |
| 7 | 116144250 | 116145500 | d7Mseg2670 |
| 7 | 116698050 | 116699850 | d7Mseg2671 |
| 7 | 116885550 | 116886550 | d7Mseg2672 |
| 7 | 117214700 | 117215950 | d7Mseg2674 |
| 7 | 117922650 | 117923950 | d7Mseg2683 |
| 7 | 118263700 | 118265300 | d7Mseg2684 |
| 7 | 118439050 | 118440350 | d7Mseg2685 |
| 7 | 118593200 | 118594700 | d7Mseg2687 |
| 7 | 118677800 | 118679500 | d7Mseg2688 |
| 7 | 118996700 | 118997800 | d7Mseg2689 |
| 7 | 119360500 | 119361500 | d7Mseg2692 |
| 7 | 120033400 | 120034650 | d7Mseg2696 |
| 7 | 121281300 | 121282850 | d7Mseg2697 |
| 7 | 123185600 | 123187450 | d7Mseg2698 |
| 7 | 123983400 | 123985350 | d7Mseg2699 |
| 7 | 124150350 | 124151550 | d7Mseg2700 |
| 7 | 124192000 | 124193650 | d7Mseg2701 |
| 7 | 124284800 | 124286200 | d7Mseg2702 |
| 7 | 124628600 | 124630200 | d7Mseg2703 |
| 7 | 125148500 | 125150100 | d7Mseg2706 |
| 7 | 125165400 | 125167000 | d7Mseg2707 |
| 7 | 125543700 | 125544700 | d7Mseg2709 |
| 7 | 125639150 | 125640450 | d7Mseg2710 |
| 7 | 126004100 | 126005650 | d7Mseg2712 |
| 7 | 127047750 | 127049950 | d7Mseg2728 |
| 7 | 127503700 | 127505300 | d7Mseg2736 |
| 7 | 127544050 | 127545750 | d7Mseg2737 |
| 7 | 127584100 | 127586000 | d7Mseg2738 |
| 7 | 127671650 | 127673150 | d7Mseg2742 |
| 7 | 127738500 | 127740000 | d7Mseg2743 |
| 7 | 127829050 | 127830450 | d7Mseg2744 |
| 7 | 128005000 | 128006650 | d7Mseg2746 |
| 7 | 128432000 | 128433700 | d7Mseg2751 |
| 7 | 128609250 | 128610600 | d7Mseg2754 |
| 7 | 128742000 | 128743100 | d7Mseg2756 |
| 7 | 128821450 | 128823250 | d7Mseg2757 |
| 7 | 129020550 | 129022050 | d7Mseg2761 |
| 7 | 129027200 | 129028700 | d7Mseg2762 |
| 7 | 129136650 | 129138100 | d7Mseg2763 |
| 7 | 129212450 | 129214350 | d7Mseg2764 |
| 7 | 129232850 | 129234450 | d7Mseg2765 |
| 7 | 129300400 | 129302100 | d7Mseg2767 |
| 7 | 129334500 | 129335700 | d7Mseg2769 |
| 7 | 129359600 | 129361250 | d7Mseg2770 |
| 7 | 129532800 | 129534300 | d7Mseg2775 |
| 7 | 129639850 | 129641450 | d7Mseg2776 |
| 7 | 129690350 | 129691400 | d7Mseg2777 |
| 7 | 129702100 | 129703300 | d7Mseg2778 |
| 7 | 129738650 | 129740350 | d7Mseg2780 |
| 7 | 129780550 | 129782500 | d7Mseg2781 |
| 7 | 129885550 | 129886650 | d7Mseg2783 |
| 7 | 130075900 | 130077700 | d7Mseg2786 |
| 7 | 130106200 | 130107600 | d7Mseg2787 |
| 7 | 130111200 | 130112450 | d7Mseg2788 |
| 7 | 130256750 | 130258450 | d7Mseg2794 |
| 7 | 130331350 | 130333050 | d7Mseg2796 |
| 7 | 130342050 | 130343850 | d7Mseg2797 |
| 7 | 130543650 | 130545400 | d7Mseg2807 |
| 7 | 130569200 | 130570700 | d7Mseg2809 |
| 7 | 130769200 | 130770500 | d7Mseg2814 |
| 7 | 130879700 | 130881350 | d7Mseg2819 |
| 7 | 130931100 | 130932550 | d7Mseg2820 |
| 7 | 130934650 | 130935750 | d7Mseg2821 |
| 7 | 131012650 | 131014050 | d7Mseg2827 |
| 7 | 131042550 | 131044100 | d7Mseg2828 |
| 7 | 131103050 | 131106850 | d7Mseg2831 |
| 7 | 131151100 | 131153300 | d7Mseg2833 |
| 7 | 131158250 | 131161550 | d7Mseg2834 |
| 7 | 131188900 | 131190900 | d7Mseg2836 |
| 7 | 131214300 | 131216200 | d7Mseg2837 |
| 7 | 131325300 | 131326600 | d7Mseg2849 |
| 7 | 131459800 | 131461700 | d7Mseg2856 |
| 7 | 131497800 | 131500350 | d7Mseg2859 |
| 7 | 131514150 | 131515300 | d7Mseg2860 |
| 7 | 131568500 | 131570050 | d7Mseg2866 |
| 7 | 131573100 | 131574800 | d7Mseg2867 |
| 7 | 131585350 | 131587050 | d7Mseg2868 |
| 7 | 131588500 | 131589700 | d7Mseg2869 |
| 7 | 131608250 | 131609250 | d7Mseg2870 |
| 7 | 131611450 | 131612750 | d7Mseg2871 |
| 7 | 131615450 | 131617050 | d7Mseg2872 |
| 7 | 131631200 | 131634000 | d7Mseg2873 |
| 7 | 131746800 | 131748700 | d7Mseg2875 |
| 7 | 131763000 | 131764600 | d7Mseg2876 |
| 7 | 131784950 | 131786450 | d7Mseg2877 |
| 7 | 131789150 | 131791000 | d7Mseg2878 |
| 7 | 131812950 | 131815000 | d7Mseg2879 |
| 7 | 131819150 | 131820600 | d7Mseg2880 |
| 7 | 131823550 | 131825000 | d7Mseg2881 |
| 7 | 131848150 | 131849700 | d7Mseg2882 |
| 7 | 132098750 | 132100350 | d7Mseg2884 |
| 7 | 132101750 | 132103400 | d7Mseg2885 |
| 7 | 132143250 | 132144450 | d7Mseg2887 |
| 7 | 132159850 | 132160950 | d7Mseg2888 |
| 7 | 132205100 | 132206250 | d7Mseg2889 |
| 7 | 132219750 | 132221250 | d7Mseg2890 |
| 7 | 132224350 | 132226300 | d7Mseg2891 |
| 7 | 132273100 | 132275300 | d7Mseg2893 |
| 7 | 132319400 | 132322000 | d7Mseg2896 |
| 7 | 132338850 | 132341700 | d7Mseg2898 |
| 7 | 132396450 | 132397550 | d7Mseg2900 |
| 7 | 132430600 | 132432050 | d7Mseg2901 |
| 7 | 132490150 | 132491700 | d7Mseg2902 |
| 7 | 132543350 | 132544600 | d7Mseg2905 |

TABLE IVC-continued

Mouse Moderate Sites

| c/d | start | end | segment |
|---|---|---|---|
| 7 | 132649200 | 132650350 | d7Mseg2912 |
| 7 | 132680800 | 132682800 | d7Mseg2914 |
| 7 | 132793400 | 132795100 | d7Mseg2917 |
| 7 | 132810650 | 132812200 | d7Mseg2919 |
| 7 | 132818400 | 132821150 | d7Mseg2920 |
| 7 | 132967500 | 132969600 | d7Mseg2921 |
| 7 | 132971550 | 132973550 | d7Mseg2922 |
| 7 | 133047600 | 133049150 | d7Mseg2923 |
| 7 | 133052400 | 133054000 | d7Mseg2924 |
| 7 | 133057650 | 133059300 | d7Mseg2925 |
| 7 | 133078850 | 133080250 | d7Mseg2926 |
| 7 | 133083450 | 133084500 | d7Mseg2927 |
| 7 | 133120400 | 133123200 | d7Mseg2928 |
| 7 | 133144950 | 133146450 | d7Mseg2929 |
| 7 | 133153800 | 133155900 | d7Mseg2930 |
| 7 | 133174250 | 133175850 | d7Mseg2932 |
| 7 | 133182050 | 133183650 | d7Mseg2934 |
| 7 | 133417700 | 133419150 | d7Mseg2944 |
| 7 | 133437800 | 133439750 | d7Mseg2946 |
| 7 | 133560350 | 133561650 | d7Mseg2947 |
| 7 | 133571250 | 133573150 | d7Mseg2948 |
| 7 | 133580300 | 133582250 | d7Mseg2949 |
| 7 | 133632500 | 133641950 | d7Mseg2950 |
| 7 | 133646250 | 133647850 | d7Mseg2951 |
| 7 | 133661400 | 133663150 | d7Mseg2953 |
| 7 | 133671200 | 133672800 | d7Mseg2954 |
| 7 | 133793050 | 133794450 | d7Mseg2958 |
| 7 | 133809900 | 133811050 | d7Mseg2959 |
| 7 | 134014700 | 134016100 | d7Mseg2965 |
| 7 | 134075300 | 134076850 | d7Mseg2966 |
| 7 | 134115900 | 134119950 | d7Mseg2968 |
| 7 | 134148050 | 134150100 | d7Mseg2971 |
| 7 | 134369350 | 134370650 | d7Mseg2978 |
| 7 | 134441600 | 134442850 | d7Mseg2980 |
| 7 | 134472600 | 134474300 | d7Mseg2981 |
| 7 | 134833150 | 134834900 | d7Mseg2988 |
| 7 | 134892600 | 134894400 | d7Mseg2989 |
| 7 | 134953950 | 134955350 | d7Mseg2991 |
| 7 | 134959200 | 134960500 | d7Mseg2992 |
| 7 | 134979950 | 134981400 | d7Mseg2994 |
| 7 | 135027250 | 135029200 | d7Mseg2998 |
| 7 | 135222300 | 135224200 | d7Mseg3001 |
| 7 | 135276350 | 135277600 | d7Mseg3004 |
| 7 | 135559750 | 135561450 | d7Mseg3010 |
| 7 | 135621300 | 135622450 | d7Mseg3012 |
| 7 | 135630250 | 135631750 | d7Mseg3013 |
| 7 | 135699650 | 135700900 | d7Mseg3015 |
| 7 | 135781300 | 135782400 | d7Mseg3017 |
| 7 | 135826900 | 135828650 | d7Mseg3019 |
| 7 | 135932550 | 135933850 | d7Mseg3022 |
| 7 | 135936650 | 135937750 | d7Mseg3023 |
| 7 | 135941500 | 135943050 | d7Mseg3024 |
| 7 | 135983250 | 135984900 | d7Mseg3025 |
| 7 | 136261800 | 136263250 | d7Mseg3036 |
| 7 | 136307000 | 136308150 | d7Mseg3038 |
| 7 | 136407750 | 136409300 | d7Mseg3042 |
| 7 | 136428200 | 136429900 | d7Mseg3044 |
| 7 | 136519700 | 136520800 | d7Mseg3046 |
| 7 | 136534750 | 136536300 | d7Mseg3047 |
| 7 | 136697000 | 136698350 | d7Mseg3055 |
| 7 | 136762050 | 136763850 | d7Mseg3062 |
| 7 | 136855650 | 136856750 | d7Mseg3068 |
| 7 | 136860950 | 136861950 | d7Mseg3069 |
| 7 | 136996100 | 136997500 | d7Mseg3082 |
| 7 | 137153100 | 137155850 | d7Mseg3094 |
| 7 | 137159200 | 137160550 | d7Mseg3095 |
| 7 | 137336500 | 137337550 | d7Mseg3108 |
| 7 | 137350550 | 137352250 | d7Mseg3110 |
| 7 | 137353950 | 137357900 | d7Mseg3111 |
| 7 | 137359800 | 137361700 | d7Mseg3112 |
| 7 | 137381450 | 137382550 | d7Mseg3113 |
| 7 | 137388600 | 137390100 | d7Mseg3114 |
| 7 | 137422400 | 137424300 | d7Mseg3116 |
| 7 | 137530800 | 137531900 | d7Mseg3121 |
| 7 | 137584500 | 137588700 | d7Mseg3122 |
| 7 | 137736000 | 137737550 | d7Mseg3133 |
| 7 | 137754050 | 137755800 | d7Mseg3134 |
| 7 | 137808250 | 137810450 | d7Mseg3138 |
| 7 | 137842050 | 137845850 | d7Mseg3141 |
| 7 | 137925850 | 137927750 | d7Mseg3147 |
| 7 | 137938600 | 137940650 | d7Mseg3148 |
| 7 | 137990950 | 137992150 | d7Mseg3151 |
| 7 | 138002550 | 138004000 | d7Mseg3152 |
| 7 | 138040900 | 138042400 | d7Mseg3154 |
| 7 | 138061650 | 138063400 | d7Mseg3158 |
| 7 | 138134800 | 138136400 | d7Mseg3164 |
| 7 | 138139050 | 138140800 | d7Mseg3165 |
| 7 | 138239550 | 138241300 | d7Mseg3172 |
| 7 | 138244300 | 138245450 | d7Mseg3173 |
| 7 | 138304550 | 138305700 | d7Mseg3177 |
| 7 | 138310750 | 138312450 | d7Mseg3178 |
| 7 | 138469300 | 138470950 | d7Mseg3181 |
| 7 | 138570600 | 138572550 | d7Mseg3187 |
| 7 | 138666750 | 138668350 | d7Mseg3190 |
| 7 | 138676200 | 138677300 | d7Mseg3191 |
| 7 | 138697950 | 138699500 | d7Mseg3194 |
| 7 | 138732100 | 138734000 | d7Mseg3195 |
| 7 | 138758200 | 138759950 | d7Mseg3197 |
| 7 | 138995800 | 138997250 | d7Mseg3210 |
| 7 | 139024250 | 139026200 | d7Mseg3215 |
| 7 | 139057050 | 139058750 | d7Mseg3217 |
| 7 | 139065800 | 139069750 | d7Mseg3219 |
| 7 | 139076700 | 139078350 | d7Mseg3220 |
| 7 | 139082500 | 139087250 | d7Mseg3221 |
| 7 | 139088600 | 139090350 | d7Mseg3222 |
| 7 | 139126250 | 139129650 | d7Mseg3225 |
| 7 | 139178050 | 139179600 | d7Mseg3228 |
| 7 | 139241750 | 139242800 | d7Mseg3232 |
| 7 | 139472200 | 139473350 | d7Mseg3239 |
| 7 | 139489450 | 139491050 | d7Mseg3241 |
| 7 | 139563200 | 139564200 | d7Mseg3247 |
| 7 | 139614600 | 139616150 | d7Mseg3249 |
| 7 | 139646050 | 139647600 | d7Mseg3250 |
| 7 | 139660450 | 139661700 | d7Mseg3251 |
| 7 | 139684250 | 139685500 | d7Mseg3252 |
| 7 | 139894300 | 139895650 | d7Mseg3257 |
| 7 | 139929350 | 139931050 | d7Mseg3258 |
| 7 | 139942550 | 139943800 | d7Mseg3260 |
| 7 | 140037600 | 140038950 | d7Mseg3265 |
| 7 | 140151800 | 140154000 | d7Mseg3271 |
| 7 | 140487450 | 140489000 | d7Mseg3282 |
| 7 | 140506700 | 140508050 | d7Mseg3283 |
| 7 | 140609750 | 140610750 | d7Mseg3289 |
| 7 | 140731800 | 140732800 | d7Mseg3291 |
| 7 | 140748800 | 140750450 | d7Mseg3292 |
| 7 | 140841150 | 140842750 | d7Mseg3299 |
| 7 | 140912650 | 140914550 | d7Mseg3301 |
| 7 | 140921200 | 140923050 | d7Mseg3302 |
| 7 | 140990450 | 140992200 | d7Mseg3304 |
| 7 | 141000400 | 141002150 | d7Mseg3305 |
| 7 | 141158250 | 141159450 | d7Mseg3310 |
| 7 | 141168950 | 141170000 | d7Mseg3311 |
| 7 | 141182300 | 141183450 | d7Mseg3312 |
| 7 | 141212850 | 141214050 | d7Mseg3313 |
| 7 | 141249600 | 141251100 | d7Mseg3315 |
| 7 | 141277900 | 141279600 | d7Mseg3317 |
| 7 | 141686950 | 141688700 | d7Mseg3330 |
| 7 | 141700400 | 141702400 | d7Mseg3331 |
| 7 | 141744400 | 141745900 | d7Mseg3332 |
| 7 | 142029150 | 142031150 | d7Mseg3344 |
| 7 | 142042400 | 142043400 | d7Mseg3345 |
| 7 | 142062650 | 142064300 | d7Mseg3346 |
| 7 | 142077550 | 142079000 | d7Mseg3347 |
| 7 | 142235850 | 142237300 | d7Mseg3350 |
| 7 | 142284450 | 142285950 | d7Mseg3354 |
| 7 | 142433750 | 142435050 | d7Mseg3355 |
| 7 | 142628500 | 142630400 | d7Mseg3357 |
| 7 | 142704250 | 142705350 | d7Mseg3358 |
| 7 | 142797900 | 142799150 | d7Mseg3359 |
| 7 | 142842900 | 142844550 | d7Mseg3360 |
| 7 | 142911150 | 142912400 | d7Mseg3362 |
| 7 | 142932500 | 142933850 | d7Mseg3363 |

TABLE IVC-continued

Mouse Moderate Sites

| c/d | start | end | segment |
|---|---|---|---|
| 7 | 143041500 | 143042700 | d7Mseg3365 |
| 7 | 143181450 | 143183100 | d7Mseg3366 |
| 7 | 143480350 | 143481950 | d7Mseg3372 |
| 7 | 143597750 | 143599250 | d7Mseg3375 |
| 7 | 143697850 | 143699650 | d7Mseg3378 |
| 7 | 143704050 | 143705600 | d7Mseg3379 |
| 7 | 143708950 | 143710500 | d7Mseg3380 |
| 7 | 143718800 | 143720350 | d7Mseg3381 |
| 7 | 143728900 | 143730500 | d7Mseg3382 |
| 7 | 143889000 | 143890600 | d7Mseg3384 |
| 7 | 144086450 | 144088200 | d7Mseg3388 |
| 7 | 145311050 | 145312900 | d7Mseg3389 |
| 7 | 146051350 | 146052700 | d7Mseg3390 |
| 7 | 146380650 | 146381950 | d7Mseg3391 |
| 7 | 146578200 | 146579500 | d7Mseg3392 |
| 7 | 146610750 | 146611800 | d7Mseg3393 |
| 7 | 146781550 | 146783350 | d7Mseg3394 |
| 7 | 146788750 | 146790050 | d7Mseg3395 |
| 7 | 146888900 | 146890600 | d7Mseg3396 |
| 7 | 147039950 | 147041350 | d7Mseg3400 |
| 7 | 147082100 | 147083900 | d7Mseg3403 |
| 7 | 147093800 | 147095450 | d7Mseg3404 |
| 7 | 147107800 | 147109800 | d7Mseg3405 |
| 7 | 147190800 | 147191850 | d7Mseg3406 |
| 7 | 147197500 | 147199200 | d7Mseg3407 |
| 7 | 147205500 | 147206850 | d7Mseg3408 |
| 7 | 147212800 | 147214000 | d7Mseg3409 |
| 7 | 147358550 | 147360350 | d7Mseg3417 |
| 7 | 147458150 | 147460000 | d7Mseg3420 |
| 7 | 147531750 | 147533500 | d7Mseg3425 |
| 7 | 147618650 | 147619850 | d7Mseg3426 |
| 7 | 147654950 | 147656800 | d7Mseg3428 |
| 7 | 147714800 | 147716200 | d7Mseg3429 |
| 7 | 147771350 | 147772450 | d7Mseg3430 |
| 7 | 147823450 | 147824600 | d7Mseg3432 |
| 7 | 147830900 | 147832850 | d7Mseg3433 |
| 7 | 147969600 | 147971150 | d7Mseg3435 |
| 7 | 147992750 | 147994200 | d7Mseg3437 |
| 7 | 148078450 | 148079900 | d7Mseg3439 |
| 7 | 148088650 | 148090350 | d7Mseg3440 |
| 7 | 148113300 | 148115050 | d7Mseg3441 |
| 7 | 148166600 | 148170950 | d7Mseg3442 |
| 7 | 148176550 | 148178150 | d7Mseg3443 |
| 7 | 148217250 | 148218500 | d7Mseg3444 |
| 7 | 148231300 | 148232800 | d7Mseg3445 |
| 7 | 148382100 | 148385300 | d7Mseg3450 |
| 7 | 148476800 | 148478500 | d7Mseg3455 |
| 7 | 148540350 | 148541650 | d7Mseg3458 |
| 7 | 148819900 | 148822150 | d7Mseg3473 |
| 7 | 148834300 | 148835850 | d7Mseg3474 |
| 7 | 148862600 | 148864250 | d7Mseg3475 |
| 7 | 148906350 | 148908000 | d7Mseg3476 |
| 7 | 148917800 | 148919250 | d7Mseg3477 |
| 7 | 148973150 | 148974850 | d7Mseg3478 |
| 7 | 148977250 | 148978900 | d7Mseg3479 |
| 7 | 148985850 | 148987500 | d7Mseg3480 |
| 7 | 149033200 | 149034650 | d7Mseg3481 |
| 7 | 149068250 | 149069550 | d7Mseg3483 |
| 7 | 149211650 | 149215250 | d7Mseg3485 |
| 7 | 149289500 | 149291150 | d7Mseg3490 |
| 7 | 149294900 | 149296400 | d7Mseg3491 |
| 7 | 149308600 | 149310250 | d7Mseg3492 |
| 7 | 149354500 | 149356300 | d7Mseg3493 |
| 7 | 149411750 | 149414200 | d7Mseg3495 |
| 7 | 149481000 | 149482700 | d7Mseg3501 |
| 7 | 149501850 | 149503450 | d7Mseg3502 |
| 7 | 149513850 | 149515100 | d7Mseg3503 |
| 7 | 149531800 | 149533050 | d7Mseg3504 |
| 7 | 149569100 | 149570250 | d7Mseg3507 |
| 7 | 149647450 | 149648800 | d7Mseg3509 |
| 7 | 149655250 | 149657200 | d7Mseg3510 |
| 7 | 149667600 | 149668600 | d7Mseg3511 |
| 7 | 149702250 | 149703350 | d7Mseg3514 |
| 7 | 149834500 | 149836300 | d7Mseg3519 |
| 7 | 149885200 | 149887150 | d7Mseg3520 |
| 7 | 149888650 | 149889750 | d7Mseg3521 |
| 7 | 149906250 | 149907950 | d7Mseg3522 |
| 7 | 149952550 | 149954500 | d7Mseg3525 |
| 7 | 149992800 | 149994550 | d7Mseg3526 |
| 7 | 150022000 | 150024250 | d7Mseg3527 |
| 7 | 150059550 | 150061000 | d7Mseg3528 |
| 7 | 150148450 | 150150050 | d7Mseg3530 |
| 7 | 150193900 | 150196000 | d7Mseg3531 |
| 7 | 150239000 | 150240650 | d7Mseg3532 |
| 7 | 150314500 | 150316200 | d7Mseg3534 |
| 7 | 150340600 | 150342100 | d7Mseg3535 |
| 7 | 150631950 | 150633000 | d7Mseg3536 |
| 7 | 150718850 | 150719950 | d7Mseg3537 |
| 7 | 150812450 | 150813950 | d7Mseg3538 |
| 7 | 151157750 | 151159100 | d7Mseg3539 |
| 7 | 151289300 | 151290750 | d7Mseg3540 |
| 7 | 151369800 | 151371500 | d7Mseg3541 |
| 7 | 151378800 | 151380050 | d7Mseg3542 |
| 7 | 151495350 | 151497100 | d7Mseg3544 |
| 7 | 151506650 | 151507900 | d7Mseg3545 |
| 7 | 151577700 | 151578800 | d7Mseg3546 |
| 7 | 151652800 | 151654150 | d7Mseg3548 |
| 7 | 151740100 | 151741400 | d7Mseg3551 |
| 7 | 151786900 | 151788100 | d7Mseg3552 |
| 7 | 151819500 | 151821100 | d7Mseg3553 |
| 7 | 151825500 | 151826500 | d7Mseg3554 |
| 7 | 151900150 | 151901750 | d7Mseg3555 |
| 7 | 151906150 | 151907850 | d7Mseg3556 |
| 7 | 151909700 | 151911400 | d7Mseg3557 |
| 7 | 151931200 | 151932250 | d7Mseg3558 |
| 7 | 151966600 | 151968100 | d7Mseg3560 |
| 7 | 152177250 | 152178650 | d7Mseg3568 |
| 7 | 152312800 | 152314250 | d7Mseg3570 |
| 7 | 152555900 | 152557050 | d7Mseg3575 |
| 7 | 152664500 | 152665900 | d7Mseg3577 |
| 7 | 152725700 | 152726800 | d7Mseg3579 |
| 7 | 152965750 | 152967350 | d7Mseg3581 |
| 7 | 152975250 | 152976800 | d7Mseg3582 |
| 7 | 152985900 | 152987450 | d7Mseg3583 |
| 7 | 153142500 | 153144300 | d7Mseg3584 |
| 7 | 153152750 | 153153850 | d7Mseg3585 |
| 7 | 153184500 | 153186250 | d7Mseg3586 |
| 7 | 153188400 | 153189950 | d7Mseg3587 |
| 7 | 153205600 | 153207050 | d7Mseg3588 |
| 7 | 153409500 | 153411250 | d7Mseg3594 |
| 7 | 154587400 | 154588700 | d7Mseg3616 |
| 7 | 154605550 | 154606750 | d7Mseg3617 |
| 7 | 154630650 | 154632100 | d7Mseg3618 |
| 7 | 154662550 | 154664200 | d7Mseg3620 |
| 7 | 154801300 | 154803250 | d7Mseg3623 |
| 7 | 154962100 | 154963650 | d7Mseg3629 |
| 7 | 155170750 | 155172350 | d7Mseg3636 |
| 7 | 155354800 | 155356700 | d7Mseg3642 |
| 7 | 155394250 | 155395750 | d7Mseg3644 |
| 7 | 155409350 | 155411150 | d7Mseg3646 |
| 7 | 155833950 | 155835450 | d7Mseg3658 |
| 7 | 155847650 | 155849300 | d7Mseg3659 |
| 7 | 155867750 | 155868950 | d7Mseg3662 |
| 7 | 155893550 | 155895050 | d7Mseg3663 |
| 7 | 155964400 | 155968450 | d7Mseg3664 |
| 7 | 156586600 | 156588000 | d7Mseg3688 |
| 7 | 156620350 | 156621750 | d7Mseg3689 |
| 7 | 156623550 | 156624650 | d7Mseg3690 |
| 7 | 157050850 | 157052650 | d7Mseg3709 |
| 7 | 157314650 | 157315850 | d7Mseg3721 |
| 7 | 157484650 | 157486350 | d7Mseg3730 |
| 7 | 157512450 | 157514100 | d7Mseg3731 |
| 7 | 157527600 | 157529050 | d7Mseg3732 |
| 7 | 157543050 | 157545000 | d7Mseg3733 |
| 7 | 157565850 | 157567750 | d7Mseg3734 |
| 7 | 157571600 | 157573100 | d7Mseg3735 |
| 7 | 157591450 | 157592650 | d7Mseg3736 |
| 7 | 157657300 | 157659150 | d7Mseg3738 |
| 7 | 157716750 | 157718400 | d7Mseg3739 |
| 7 | 157726150 | 157727550 | d7Mseg3740 |
| 7 | 157736550 | 157738300 | d7Mseg3741 |
| 7 | 157787400 | 157791450 | d7Mseg3742 |

TABLE IVC-continued

Mouse Moderate Sites

| c/d | start | end | segment |
|---|---|---|---|
| 7 | 158060900 | 158062450 | d7Mseg3757 |
| 7 | 158105850 | 158107600 | d7Mseg3759 |
| 7 | 158237250 | 158238400 | d7Mseg3770 |
| 7 | 158241550 | 158243300 | d7Mseg3771 |
| 7 | 158260200 | 158261950 | d7Mseg3773 |
| 7 | 158789950 | 158792150 | d7Mseg3809 |
| 7 | 158869150 | 158873000 | d7Mseg3811 |
| 7 | 159013100 | 159014150 | d7Mseg3815 |
| 7 | 159100500 | 159102350 | d7Mseg3820 |
| 7 | 159335350 | 159336700 | d7Mseg3825 |
| 7 | 159345850 | 159346900 | d7Mseg3826 |
| 7 | 159349250 | 159350950 | d7Mseg3827 |
| 7 | 159670550 | 159671950 | d7Mseg3834 |
| 7 | 159724200 | 159727450 | d7Mseg3835 |
| 7 | 159911500 | 159913150 | d7Mseg3843 |
| 7 | 160131000 | 160132050 | d7Mseg3851 |
| 7 | 160138600 | 160140100 | d7Mseg3852 |
| 7 | 160154950 | 160156500 | d7Mseg3853 |
| 7 | 160194600 | 160201150 | d7Mseg3857 |
| 7 | 160216100 | 160217500 | d7Mseg3858 |
| 7 | 160453400 | 160454550 | d7Mseg3867 |
| 7 | 160457750 | 160459400 | d7Mseg3868 |
| 7 | 160502150 | 160503750 | d7Mseg3870 |
| 7 | 160696650 | 160697650 | d7Mseg3884 |
| 7 | 160762300 | 160764000 | d7Mseg3888 |
| 7 | 160848350 | 160850050 | d7Mseg3892 |
| 7 | 160910200 | 160912050 | d7Mseg3895 |
| 7 | 160953000 | 160954700 | d7Mseg3897 |
| 7 | 161026850 | 161028100 | d7Mseg3899 |
| 7 | 161091000 | 161092450 | d7Mseg3902 |
| 7 | 161176700 | 161177950 | d7Mseg3903 |
| 7 | 161215650 | 161217550 | d7Mseg3904 |
| 7 | 161367850 | 161369050 | d7Mseg3909 |
| 7 | 161456600 | 161458450 | d7Mseg3912 |
| 7 | 161524850 | 161526300 | d7Mseg3915 |
| 7 | 161810350 | 161812000 | d7Mseg3925 |
| 7 | 161857150 | 161858850 | d7Mseg3926 |
| 7 | 161864550 | 161866100 | d7Mseg3927 |
| 7 | 162373800 | 162375600 | d7Mseg3929 |
| 7 | 162508800 | 162509900 | d7Mseg3931 |
| 7 | 163180250 | 163181450 | d7Mseg3960 |
| 7 | 163716000 | 163717750 | d7Mseg3977 |
| 7 | 163883350 | 163884650 | d7Mseg3983 |
| 7 | 164174100 | 164177400 | d7Mseg3995 |
| 7 | 164214300 | 164216150 | d7Mseg3997 |
| 7 | 164442250 | 164443800 | d7Mseg4007 |
| 7 | 164519350 | 164520600 | d7Mseg4010 |
| 7 | 164568950 | 164570250 | d7Mseg4013 |
| 7 | 164660250 | 164663750 | d7Mseg4015 |
| 7 | 164899200 | 164900500 | d7Mseg4022 |
| 7 | 164926200 | 164928000 | d7Mseg4023 |
| 7 | 164978000 | 164979750 | d7Mseg4024 |
| 7 | 165049550 | 165051250 | d7Mseg4027 |
| 7 | 165120350 | 165121750 | d7Mseg4028 |
| 7 | 165264000 | 165265700 | d7Mseg4038 |
| 7 | 165778100 | 165779700 | d7Mseg4053 |
| 7 | 165788300 | 165789800 | d7Mseg4054 |
| 7 | 165830800 | 165832450 | d7Mseg4056 |
| 7 | 165880900 | 165881950 | d7Mseg4057 |
| 7 | 165895350 | 165896700 | d7Mseg4059 |
| 7 | 165917350 | 165918700 | d7Mseg4061 |
| 7 | 166017800 | 166019650 | d7Mseg4063 |
| 7 | 166425600 | 166428850 | d7Mseg4076 |
| 7 | 166434450 | 166435950 | d7Mseg4077 |
| M | 3853650 | 3855000 | MMseg1 |
| M | 3913600 | 3914800 | MMseg2 |
| M | 4182500 | 4184150 | MMseg3 |
| M | 4758150 | 4759400 | MMseg4 |
| M | 5039250 | 5040550 | MMseg5 |
| M | 5418550 | 5419600 | MMseg6 |
| M | 5428450 | 5430450 | MMseg7 |
| M | 5502250 | 5503450 | MMseg8 |
| M | 5508350 | 5509900 | MMseg9 |
| M | 5651250 | 5652400 | MMseg10 |
| M | 5962150 | 5963800 | MMseg12 |
| M | 6560100 | 6561450 | MMseg18 |
| M | 6615900 | 6616950 | MMseg19 |
| M | 7011150 | 7012750 | MMseg24 |
| M | 7129050 | 7130650 | MMseg25 |
| M | 7558000 | 7559000 | MMseg31 |
| M | 8239550 | 8241250 | MMseg34 |
| M | 8905600 | 8906700 | MMseg35 |
| M | 9127600 | 9129200 | MMseg37 |
| M | 9287800 | 9288850 | MMseg38 |
| M | 9555150 | 9556750 | MMseg40 |
| M | 10621950 | 10623150 | MMseg48 |
| M | 12991250 | 12992550 | MMseg74 |
| M | 12999900 | 13001150 | MMseg75 |
| M | 13082550 | 13083550 | MMseg77 |
| M | 13353300 | 13354800 | MMseg79 |
| M | 13406700 | 13407700 | MMseg80 |
| M | 13503000 | 13504700 | MMseg81 |
| M | 13679750 | 13680900 | MMseg83 |
| M | 13985150 | 13986400 | MMseg85 |
| M | 14134000 | 14135250 | MMseg86 |
| M | 14490950 | 14492650 | MMseg88 |
| M | 15005150 | 15006850 | MMseg89 |
| M | 15139700 | 15141000 | MMseg91 |
| M | 15379600 | 15381300 | MMseg92 |
| M | 15393700 | 15394850 | MMseg93 |
| M | 15413700 | 15415150 | MMseg94 |
| M | 15588650 | 15590050 | MMseg95 |
| M | 15729750 | 15731250 | MMseg97 |
| M | 16775200 | 16776700 | MMseg104 |
| M | 16932850 | 16934350 | MMseg105 |
| M | 16940550 | 16942300 | MMseg106 |
| M | 17622900 | 17624800 | MMseg108 |
| M | 18065050 | 18066550 | MMseg112 |
| M | 18184600 | 18186150 | MMseg113 |
| M | 18400350 | 18402200 | MMseg115 |
| M | 18941550 | 18943100 | MMseg117 |
| M | 19251350 | 19253050 | MMseg119 |
| M | 19397250 | 19398500 | MMseg120 |
| M | 19557100 | 19558600 | MMseg122 |
| M | 19815300 | 19816600 | MMseg126 |
| M | 19908500 | 19909600 | MMseg130 |
| M | 19948200 | 19949800 | MMseg131 |
| M | 20036000 | 20037200 | MMseg133 |
| M | 20188800 | 20190600 | MMseg135 |
| M | 20562700 | 20564250 | MMseg139 |
| M | 20592400 | 20593750 | MMseg140 |
| M | 20899000 | 20900950 | MMseg142 |
| M | 20943950 | 20945350 | MMseg143 |
| M | 21002150 | 21003550 | MMseg144 |
| M | 21345950 | 21346950 | MMseg147 |
| M | 21459600 | 21461200 | MMseg148 |
| M | 21849650 | 21851100 | MMseg149 |
| M | 22518300 | 22519450 | MMseg153 |
| M | 23312100 | 23313450 | MMseg159 |
| M | 23502250 | 23503600 | MMseg160 |
| M | 24068550 | 24070050 | MMseg161 |
| M | 24784200 | 24785900 | MMseg162 |
| M | 25495850 | 25497200 | MMseg163 |
| M | 33282900 | 33283950 | MMseg165 |
| M | 33664350 | 33665550 | MMseg168 |
| M | 33938650 | 33940000 | MMseg173 |
| M | 34384450 | 34386250 | MMseg175 |
| M | 34654900 | 34656500 | MMseg180 |
| M | 34906250 | 34907450 | MMseg181 |
| M | 35106550 | 35107600 | MMseg182 |
| M | 35254900 | 35256700 | MMseg183 |
| M | 35912050 | 35913150 | MMseg185 |
| M | 36011250 | 36012300 | MMseg187 |
| M | 36289600 | 36290600 | MMseg192 |
| M | 36326900 | 36328200 | MMseg193 |
| M | 36784200 | 36785850 | MMseg195 |
| M | 36854050 | 36855500 | MMseg196 |
| M | 37066250 | 37068000 | MMseg198 |
| M | 37101450 | 37103500 | MMseg199 |
| M | 37347150 | 37348200 | MMseg200 |
| M | 38284900 | 38285900 | MMseg205 |
| M | 38464950 | 38466450 | MMseg207 |

TABLE IVC-continued

Mouse Moderate Sites

| c/d | start | end | segment |
|---|---|---|---|
| M | 38478150 | 38479750 | MMseg208 |
| M | 39070400 | 39071600 | MMseg212 |
| M | 39658500 | 39659950 | MMseg214 |
| M | 41053850 | 41055400 | MMseg222 |
| M | 41188600 | 41190350 | MMseg224 |
| M | 41475550 | 41477000 | MMseg225 |
| M | 41838950 | 41840250 | MMseg228 |
| M | 42952250 | 42953650 | MMseg234 |
| M | 43164050 | 43165700 | MMseg235 |
| M | 43300500 | 43301700 | MMseg236 |
| M | 43357850 | 43358850 | MMseg237 |
| M | 43428250 | 43429850 | MMseg238 |
| M | 43508100 | 43509350 | MMseg239 |
| M | 43513800 | 43515250 | MMseg240 |
| M | 43876250 | 43877650 | MMseg242 |
| M | 44741100 | 44742600 | MMseg246 |
| M | 44980800 | 44982100 | MMseg248 |
| M | 45542000 | 45543350 | MMseg252 |
| M | 46151950 | 46153350 | MMseg255 |
| M | 46246300 | 46247300 | MMseg256 |
| M | 46875250 | 46876600 | MMseg262 |
| M | 46897200 | 46899000 | MMseg263 |
| M | 47000050 | 47001600 | MMseg264 |
| M | 47079450 | 47081150 | MMseg265 |
| M | 47195000 | 47196750 | MMseg267 |
| M | 47571850 | 47573350 | MMseg269 |
| M | 47687500 | 47688700 | MMseg270 |
| M | 47930700 | 47932100 | MMseg272 |
| M | 48036250 | 48038000 | MMseg273 |
| M | 48093550 | 48094850 | MMseg274 |
| M | 48308050 | 48310000 | MMseg278 |
| M | 49014000 | 49015350 | MMseg286 |
| M | 50234600 | 50235950 | MMseg302 |
| M | 50735900 | 50737350 | MMseg306 |
| M | 50826250 | 50827500 | MMseg307 |
| M | 51044400 | 51045800 | MMseg309 |
| M | 51083050 | 51084050 | MMseg310 |
| M | 51136650 | 51137950 | MMseg311 |
| M | 51278250 | 51281050 | MMseg313 |
| M | 51482200 | 51486500 | MMseg314 |
| M | 53165750 | 53167450 | MMseg315 |
| M | 53249650 | 53251250 | MMseg316 |
| M | 53639200 | 53640800 | MMseg317 |
| M | 53820100 | 53821400 | MMseg319 |
| M | 53826350 | 53828150 | MMseg320 |
| M | 54236300 | 54238200 | MMseg322 |
| M | 54520000 | 54521000 | MMseg324 |
| M | 54999100 | 55000650 | MMseg327 |
| M | 55444450 | 55446000 | MMseg335 |
| M | 55483150 | 55484400 | MMseg336 |
| M | 55747650 | 55749450 | MMseg337 |
| M | 55900050 | 55901700 | MMseg338 |
| M | 56106050 | 56107450 | MMseg340 |
| M | 56965100 | 56966400 | MMseg348 |
| M | 57142100 | 57143250 | MMseg350 |
| M | 57730200 | 57731950 | MMseg355 |
| M | 58285000 | 58286650 | MMseg359 |
| M | 58341150 | 58342500 | MMseg360 |
| M | 58621950 | 58623450 | MMseg362 |
| M | 58721900 | 58723300 | MMseg363 |
| M | 58780650 | 58782050 | MMseg364 |
| M | 58865700 | 58867350 | MMseg365 |
| M | 59293500 | 59295250 | MMseg368 |
| M | 59540050 | 59541450 | MMseg369 |
| M | 59748650 | 59749700 | MMseg371 |
| M | 60453600 | 60455000 | MMseg372 |
| M | 60616600 | 60617950 | MMseg374 |
| M | 60698850 | 60700300 | MMseg375 |
| M | 60714950 | 60716650 | MMseg376 |
| M | 60790600 | 60792450 | MMseg377 |
| M | 61016450 | 61017650 | MMseg378 |
| M | 61040000 | 61041000 | MMseg379 |
| M | 61100400 | 61102150 | MMseg381 |
| M | 61436750 | 61437850 | MMseg382 |
| M | 61635600 | 61636950 | MMseg384 |
| M | 61753450 | 61754950 | MMseg386 |
| M | 61814600 | 61816300 | MMseg387 |
| M | 61908750 | 61910050 | MMseg388 |
| M | 62017450 | 62018850 | MMseg390 |
| M | 62055450 | 62056700 | MMseg391 |
| M | 62178300 | 62179350 | MMseg392 |
| M | 62287150 | 62288450 | MMseg393 |
| M | 62650950 | 62652550 | MMseg394 |
| M | 63122400 | 63123850 | MMseg395 |
| M | 63161850 | 63163150 | MMseg396 |
| M | 63173650 | 63175800 | MMseg397 |
| M | 63193700 | 63195550 | MMseg398 |
| M | 63220800 | 63222600 | MMseg399 |
| M | 63490650 | 63491900 | MMseg400 |
| M | 63678500 | 63680300 | MMseg401 |
| M | 64283600 | 64284900 | MMseg405 |
| M | 64305350 | 64306500 | MMseg406 |
| M | 64500200 | 64501550 | MMseg408 |
| M | 64679350 | 64680350 | MMseg409 |
| M | 64846350 | 64847550 | MMseg410 |
| M | 65009500 | 65010700 | MMseg412 |
| M | 66108350 | 66110150 | MMseg415 |
| M | 66332100 | 66333400 | MMseg417 |
| M | 67137700 | 67138900 | MMseg425 |
| M | 67496900 | 67498100 | MMseg429 |
| M | 68460650 | 68461800 | MMseg432 |
| M | 68588200 | 68589400 | MMseg434 |
| M | 69561150 | 69562600 | MMseg440 |
| M | 69870950 | 69872600 | MMseg442 |
| M | 69885650 | 69889050 | MMseg443 |
| M | 69913200 | 69914350 | MMseg445 |
| M | 70024950 | 70026350 | MMseg446 |
| M | 70651400 | 70652750 | MMseg447 |
| M | 70909300 | 70910550 | MMseg452 |
| M | 70946400 | 70947800 | MMseg454 |
| M | 71348700 | 71350300 | MMseg458 |
| M | 71380650 | 71382200 | MMseg459 |
| M | 71814350 | 71816050 | MMseg462 |
| M | 71846750 | 71848000 | MMseg463 |
| M | 71930850 | 71932050 | MMseg464 |
| M | 72217150 | 72218800 | MMseg465 |
| M | 72239800 | 72241600 | MMseg466 |
| M | 72396500 | 72398000 | MMseg469 |
| M | 72772150 | 72773250 | MMseg472 |
| M | 73302650 | 73303700 | MMseg477 |
| M | 73508550 | 73510300 | MMseg481 |
| M | 73721700 | 73723550 | MMseg483 |
| M | 73747600 | 73748900 | MMseg484 |
| M | 73907500 | 73909300 | MMseg485 |
| M | 74287750 | 74288900 | MMseg488 |
| M | 74371800 | 74373200 | MMseg489 |
| M | 74549700 | 74551200 | MMseg490 |
| M | 74702550 | 74703850 | MMseg491 |
| M | 74785350 | 74786750 | MMseg493 |
| M | 75212300 | 75213900 | MMseg498 |
| M | 75242700 | 75244200 | MMseg499 |
| M | 75332250 | 75333750 | MMseg500 |
| M | 75497000 | 75499000 | MMseg501 |
| M | 75613800 | 75615000 | MMseg502 |
| M | 75873650 | 75875150 | MMseg505 |
| M | 76088250 | 76089700 | MMseg506 |
| M | 76295900 | 76297600 | MMseg507 |
| M | 76844550 | 76845850 | MMseg509 |
| M | 77235800 | 77237100 | MMseg511 |
| M | 77545850 | 77547150 | MMseg512 |
| M | 77550750 | 77552250 | MMseg513 |
| M | 77577300 | 77578950 | MMseg515 |
| M | 77631150 | 77632900 | MMseg516 |
| M | 77681050 | 77682200 | MMseg517 |
| M | 77685850 | 77687000 | MMseg518 |
| M | 78018300 | 78019700 | MMseg519 |
| M | 78672950 | 78674250 | MMseg523 |
| M | 78809700 | 78811000 | MMseg524 |
| M | 78844550 | 78845800 | MMseg525 |
| M | 79106900 | 79108550 | MMseg527 |
| M | 79305500 | 79306550 | MMseg529 |
| M | 79523750 | 79525400 | MMseg531 |

TABLE IVC-continued

Mouse Moderate Sites

| c/d | start | end | segment |
|---|---|---|---|
| M | 79823200 | 79824450 | MMseg532 |
| M | 80564550 | 80566300 | MMseg536 |
| M | 80637150 | 80638600 | MMseg537 |
| M | 80913700 | 80914900 | MMseg538 |
| M | 82552300 | 82553650 | MMseg550 |
| M | 83364850 | 83366000 | MMseg556 |
| M | 83371600 | 83373350 | MMseg557 |
| M | 83511200 | 83513850 | MMseg558 |
| M | 83639250 | 83640500 | MMseg560 |
| M | 84621550 | 84623100 | MMseg566 |
| M | 85395650 | 85398150 | MMseg573 |
| M | 85649200 | 85650850 | MMseg575 |
| M | 85753300 | 85754350 | MMseg577 |
| M | 86013300 | 86014450 | MMseg578 |
| M | 87286950 | 87288150 | MMseg583 |
| M | 87334850 | 87336400 | MMseg584 |
| M | 87366750 | 87368350 | MMseg585 |
| M | 87410800 | 87411950 | MMseg586 |
| M | 87513100 | 87515100 | MMseg587 |
| M | 87643150 | 87644900 | MMseg588 |
| M | 88092300 | 88093550 | MMseg590 |
| M | 88288000 | 88289700 | MMseg591 |
| M | 88347150 | 88348500 | MMseg592 |
| M | 88473950 | 88475600 | MMseg593 |
| M | 88760900 | 88762400 | MMseg594 |
| M | 89226800 | 89228700 | MMseg595 |
| M | 89285950 | 89287000 | MMseg596 |
| M | 90006500 | 90008250 | MMseg600 |
| M | 90150550 | 90151950 | MMseg601 |
| M | 90231250 | 90232550 | MMseg603 |
| M | 90234150 | 90235500 | MMseg604 |
| M | 90474100 | 90475400 | MMseg606 |
| M | 91423400 | 91425250 | MMseg617 |
| M | 91471600 | 91473200 | MMseg618 |
| M | 91533550 | 91536400 | MMseg621 |
| M | 91665450 | 91666700 | MMseg625 |
| M | 91824650 | 91826250 | MMseg627 |
| M | 91995750 | 91997350 | MMseg631 |
| M | 92172350 | 92174150 | MMseg632 |
| M | 92195100 | 92196750 | MMseg633 |
| M | 92301050 | 92302350 | MMseg634 |
| M | 92578950 | 92580750 | MMseg636 |
| M | 92588050 | 92589650 | MMseg637 |
| M | 92683900 | 92685200 | MMseg639 |
| M | 92863400 | 92864450 | MMseg640 |
| M | 93050700 | 93051900 | MMseg642 |
| M | 93104900 | 93106750 | MMseg643 |
| M | 93398050 | 93399150 | MMseg647 |
| M | 93400750 | 93401800 | MMseg648 |
| M | 93469050 | 93470400 | MMseg649 |
| M | 93528700 | 93530300 | MMseg650 |
| M | 93957800 | 93958900 | MMseg655 |
| M | 94010400 | 94011500 | MMseg656 |
| M | 94108050 | 94109750 | MMseg657 |
| M | 94187400 | 94188650 | MMseg658 |
| M | 94224450 | 94226000 | MMseg659 |
| M | 94268400 | 94269750 | MMseg660 |
| M | 94482050 | 94483700 | MMseg661 |
| M | 94993450 | 94995150 | MMseg663 |
| M | 95214700 | 95215900 | MMseg664 |
| M | 95262100 | 95263800 | MMseg666 |
| M | 95282100 | 95283700 | MMseg667 |
| M | 95311950 | 95313750 | MMseg668 |
| M | 95672450 | 95673950 | MMseg670 |
| M | 96123950 | 96125100 | MMseg672 |
| M | 97391250 | 97392350 | MMseg685 |
| M | 97748050 | 97749300 | MMseg688 |
| M | 97849550 | 97851300 | MMseg691 |
| M | 98207550 | 98208550 | MMseg697 |
| M | 98801500 | 98802800 | MMseg700 |
| M | 98941550 | 98942600 | MMseg703 |
| M | 98974200 | 98976450 | MMseg704 |
| M | 99033300 | 99034500 | MMseg705 |
| M | 99133450 | 99134700 | MMseg707 |
| M | 99409750 | 99410850 | MMseg710 |
| M | 100233950 | 100235250 | MMseg717 |
| M | 100239700 | 100240700 | MMseg718 |
| M | 100251300 | 100253550 | MMseg719 |
| M | 100340950 | 100342500 | MMseg720 |
| M | 100602700 | 100604000 | MMseg724 |
| M | 100639200 | 100646300 | MMseg725 |
| M | 100781050 | 100782700 | MMseg726 |
| M | 101106000 | 101107850 | MMseg730 |
| M | 101148650 | 101150250 | MMseg732 |
| M | 101530950 | 101532550 | MMseg736 |
| M | 101898700 | 101900050 | MMseg741 |
| M | 102262900 | 102264050 | MMseg743 |
| M | 102368400 | 102370100 | MMseg744 |
| M | 102474500 | 102475800 | MMseg746 |
| M | 102788050 | 102789300 | MMseg748 |
| M | 102856700 | 102857950 | MMseg749 |
| M | 103127200 | 103130750 | MMseg751 |
| M | 103490600 | 103491700 | MMseg754 |
| M | 103526150 | 103527600 | MMseg755 |
| M | 103553950 | 103535550 | MMseg756 |
| M | 103581350 | 103582850 | MMseg757 |
| M | 103678550 | 103681250 | MMseg758 |
| M | 103845250 | 103846300 | MMseg760 |
| M | 103867650 | 103869200 | MMseg761 |
| M | 103917000 | 103918550 | MMseg762 |
| M | 103922650 | 103924250 | MMseg763 |
| M | 104411000 | 104412350 | MMseg766 |
| M | 104468900 | 104470050 | MMseg768 |
| M | 104772600 | 104773900 | MMseg770 |
| M | 104848950 | 104849950 | MMseg771 |
| M | 105027400 | 105028450 | MMseg772 |
| M | 105207500 | 105208750 | MMseg774 |
| M | 105220800 | 105222600 | MMseg775 |
| M | 105377450 | 105378800 | MMseg776 |
| M | 105384550 | 105385950 | MMseg777 |
| M | 105388100 | 105389550 | MMseg778 |
| M | 105658650 | 105660100 | MMseg779 |
| M | 106215950 | 106217450 | MMseg783 |
| M | 106746100 | 106747800 | MMseg785 |
| M | 107668600 | 107670350 | MMseg791 |
| M | 107836650 | 107838150 | MMseg792 |
| M | 108610550 | 108612400 | MMseg797 |
| M | 108827450 | 108828700 | MMseg798 |
| M | 108963050 | 108964600 | MMseg799 |
| M | 108968700 | 108970300 | MMseg800 |
| M | 108997650 | 108998950 | MMseg801 |
| M | 109018600 | 109019600 | MMseg802 |
| M | 109037600 | 109038600 | MMseg803 |
| M | 109220150 | 109221500 | MMseg804 |
| M | 109436500 | 109438250 | MMseg805 |
| M | 109526200 | 109527800 | MMseg807 |
| M | 109562700 | 109563750 | MMseg808 |
| M | 109773250 | 109774900 | MMseg810 |
| M | 110255000 | 110256750 | MMseg814 |
| M | 110962200 | 110963200 | MMseg824 |
| M | 111271550 | 111273200 | MMseg826 |
| M | 111924150 | 111925500 | MMseg830 |
| M | 112983650 | 112985150 | MMseg833 |
| M | 113241050 | 113242450 | MMseg835 |
| M | 113461050 | 113462100 | MMseg836 |
| M | 113730600 | 113732150 | MMseg837 |
| M | 114172850 | 114174300 | MMseg838 |
| M | 114387400 | 114388800 | MMseg840 |
| M | 114413850 | 114415200 | MMseg841 |
| M | 114768850 | 114769850 | MMseg843 |
| M | 115105200 | 115106800 | MMseg844 |
| M | 115134650 | 115136150 | MMseg845 |
| M | 115656900 | 115658850 | MMseg846 |
| M | 115665950 | 115667250 | MMseg847 |
| M | 115678600 | 115679900 | MMseg848 |
| M | 115893950 | 115895000 | MMseg849 |
| M | 115947800 | 115949300 | MMseg850 |
| M | 116100300 | 116101700 | MMseg851 |
| M | 116508800 | 116510200 | MMseg854 |
| M | 117079050 | 117080600 | MMseg855 |
| M | 117316100 | 117317600 | MMseg857 |
| M | 117351800 | 117353500 | MMseg859 |

TABLE IVC-continued

Mouse Moderate Sites

| c/d | start | end | segment |
|---|---|---|---|
| M | 117683700 | 117685300 | MMseg862 |
| M | 117971700 | 117973450 | MMseg868 |
| M | 118276100 | 118277550 | MMseg869 |
| M | 118521900 | 118523700 | MMseg870 |
| M | 118594300 | 118595550 | MMseg871 |
| M | 119374450 | 119375950 | MMseg873 |
| M | 119904150 | 119905300 | MMseg876 |
| M | 119953200 | 119954950 | MMseg877 |
| M | 122902500 | 122904050 | MMseg878 |
| M | 123006500 | 123007800 | MMseg879 |
| M | 123323350 | 123324600 | MMseg880 |
| M | 123707800 | 123708800 | MMseg881 |
| M | 123856850 | 123858100 | MMseg883 |
| M | 123864900 | 123865950 | MMseg884 |
| M | 124369850 | 124370950 | MMseg886 |
| M | 124444500 | 124445950 | MMseg887 |
| M | 124465050 | 124466050 | MMseg888 |
| M | 124515700 | 124517350 | MMseg889 |
| M | 124663250 | 124665000 | MMseg890 |
| M | 125022300 | 125023900 | MMseg891 |
| M | 125153700 | 125154800 | MMseg893 |
| M | 125618400 | 125619700 | MMseg894 |
| M | 125677650 | 125678850 | MMseg895 |
| M | 126265250 | 126266850 | MMseg899 |
| M | 127107200 | 127108200 | MMseg903 |
| M | 127440900 | 127442250 | MMseg904 |
| M | 127530150 | 127531850 | MMseg905 |
| M | 127593150 | 127594250 | MMseg906 |
| M | 127653450 | 127655150 | MMseg907 |
| M | 127913200 | 127914200 | MMseg909 |
| M | 128956900 | 128958250 | MMseg921 |
| M | 129162200 | 129163650 | MMseg922 |
| M | 129461050 | 129464000 | MMseg924 |
| M | 130582100 | 130583200 | MMseg934 |
| M | 130768750 | 130770100 | MMseg936 |
| M | 130837350 | 130838550 | MMseg937 |
| M | 130898050 | 130899150 | MMseg938 |
| M | 131086950 | 131088550 | MMseg940 |
| M | 131104100 | 131105650 | MMseg941 |
| M | 131495200 | 131496350 | MMseg942 |
| M | 131730800 | 131732550 | MMseg943 |
| M | 132207900 | 132209100 | MMseg945 |
| M | 132232300 | 132233850 | MMseg946 |
| M | 132236600 | 132237650 | MMseg947 |
| M | 132364300 | 132365300 | MMseg949 |
| M | 132465900 | 132467200 | MMseg951 |
| M | 132648000 | 132649350 | MMseg954 |
| M | 132666000 | 132667650 | MMseg955 |
| M | 132838750 | 132840350 | MMseg958 |
| M | 132856800 | 132858450 | MMseg959 |
| M | 132984650 | 132985800 | MMseg960 |
| M | 133065750 | 133067150 | MMseg961 |
| M | 133118500 | 133119950 | MMseg962 |
| M | 133123300 | 133124600 | MMseg963 |
| M | 133127600 | 133129200 | MMseg964 |
| M | 133204150 | 133205750 | MMseg966 |
| M | 133538050 | 133539800 | MMseg973 |
| M | 133632600 | 133634450 | MMseg974 |
| M | 133637850 | 133641150 | MMseg975 |
| M | 133872000 | 133873250 | MMseg977 |
| M | 134292600 | 134294150 | MMseg981 |
| M | 134410300 | 134411850 | MMseg983 |
| M | 134535700 | 134537300 | MMseg984 |
| M | 134681700 | 134683150 | MMseg985 |
| M | 134729700 | 134731250 | MMseg986 |
| M | 134961050 | 134962400 | MMseg988 |
| M | 135124500 | 135126000 | MMseg990 |
| M | 135596500 | 135598150 | MMseg993 |
| M | 135879850 | 135881100 | MMseg994 |
| M | 135973700 | 135975000 | MMseg995 |
| M | 136447100 | 136448550 | MMseg997 |
| M | 136545600 | 136547200 | MMseg999 |
| M | 136594600 | 136598150 | MMseg1001 |
| M | 136797750 | 136799150 | MMseg1008 |
| M | 137015750 | 137017450 | MMseg1012 |
| M | 137350250 | 137351400 | MMseg1017 |
| M | 137916950 | 137918200 | MMseg1026 |
| M | 138381100 | 138383600 | MMseg1029 |
| M | 138645950 | 138647500 | MMseg1032 |
| M | 140647750 | 140648950 | MMseg1049 |
| M | 141684600 | 141686000 | MMseg1053 |
| M | 142240800 | 142241850 | MMseg1055 |
| M | 143084800 | 143086400 | MMseg1057 |
| M | 143679800 | 143681250 | MMseg1061 |
| M | 144057050 | 144058600 | MMseg1065 |
| M | 146277150 | 146278500 | MMseg1066 |
| M | 147153000 | 147154300 | MMseg1068 |
| M | 147373100 | 147374650 | MMseg1069 |
| M | 147596450 | 147597650 | MMseg1071 |
| M | 147599300 | 147600850 | MMseg1072 |
| M | 147638800 | 147640450 | MMseg1073 |
| M | 148724200 | 148725650 | MMseg1081 |
| M | 148899600 | 148901450 | MMseg1082 |
| M | 148905550 | 148907100 | MMseg1083 |
| M | 149019850 | 149021250 | MMseg1084 |
| M | 149186650 | 149187900 | MMseg1087 |
| M | 149360600 | 149361750 | MMseg1088 |
| M | 149857900 | 149859350 | MMseg1090 |
| M | 149866150 | 149868050 | MMseg1091 |
| M | 149942350 | 149943700 | MMseg1092 |
| M | 149953200 | 149954600 | MMseg1093 |
| M | 149995100 | 149996350 | MMseg1094 |
| M | 150023050 | 150024400 | MMseg1095 |
| M | 150691950 | 150693700 | MMseg1096 |
| M | 150907200 | 150908300 | MMseg1097 |
| M | 150982700 | 150983700 | MMseg1098 |
| M | 151001400 | 151002900 | MMseg1099 |
| M | 151091950 | 151093300 | MMseg1100 |
| M | 151230750 | 151232000 | MMseg1101 |
| M | 153281400 | 153283100 | MMseg1111 |
| M | 154760350 | 154761550 | MMseg1119 |
| M | 155235150 | 155236150 | MMseg1122 |
| M | 155673900 | 155675850 | MMseg1124 |
| M | 155887750 | 155889200 | MMseg1126 |
| M | 157441650 | 157443000 | MMseg1140 |
| M | 157565700 | 157567200 | MMseg1141 |
| M | 158701750 | 158703100 | MMseg1149 |
| M | 158898550 | 158899800 | MMseg1152 |
| M | 159015800 | 159017200 | MMseg1155 |
| M | 159352300 | 159354000 | MMseg1160 |
| M | 160138050 | 160139900 | MMseg1164 |
| M | 160154050 | 160155450 | MMseg1165 |
| M | 160197700 | 160200400 | MMseg1166 |
| M | 160720100 | 160721150 | MMseg1168 |
| M | 161454650 | 161456650 | MMseg1175 |
| M | 161716050 | 161717500 | MMseg1177 |
| M | 163323300 | 163324550 | MMseg1183 |
| M | 164180300 | 164181350 | MMseg1191 |
| M | 164412050 | 164413400 | MMseg1194 |
| M | 164572500 | 164573850 | MMseg1196 |
| M | 165395050 | 165396550 | MMseg1206 |
| M | 165513000 | 165514700 | MMseg1208 |
| M | 165596800 | 165598350 | MMseg1209 |

Table V presents a full list of strong EZH2 sites on mouse Chr13. For Table V: 0, day 0 ES cells; 7, day 7 ES cells; M, MEF cells.

TABLE V

| | start | end | name |
|---|---|---|---|
| 0 | 3356950 | 3360750 | 13.0seg_1 |
| 0 | 10357650 | 10360200 | 13.0seg_2 |
| 0 | 22094300 | 22095300 | 13.0seg_3 |
| 0 | 23377600 | 23379350 | 13.0seg_4 |

TABLE V-continued

| start | end | name |
|---|---|---|
| 0 | 23401050 | 23406550 | 13.0seg_5 |
| 0 | 23486500 | 23488700 | 13.0seg_6 |
| 0 | 28976050 | 28977450 | 13.0seg_7 |
| 0 | 29042750 | 29044450 | 13.0seg_8 |
| 0 | 30840550 | 30843850 | 13.0seg_9 |
| 0 | 31648650 | 31652000 | 13.0seg_10 |
| 0 | 31706400 | 31723100 | 13.0seg_11 |
| 0 | 31891450 | 31904050 | 13.0seg_12 |
| 0 | 34742650 | 34745050 | 13.0seg_13 |
| 0 | 36815800 | 36828450 | 13.0seg_14 |
| 0 | 38437500 | 38439550 | 13.0seg_15 |
| 0 | 40796400 | 40801550 | 13.0seg_16 |
| 0 | 40822500 | 40838550 | 13.0seg_17 |
| 0 | 42396950 | 42398050 | 13.0seg_18 |
| 0 | 46061450 | 46063350 | 13.0seg_19 |
| 0 | 48357100 | 48358700 | 13.0seg_20 |
| 0 | 48752600 | 48765950 | 13.0seg_21 |
| 0 | 49342350 | 49343550 | 13.0seg_22 |
| 0 | 51661800 | 51665000 | 13.0seg_23 |
| 0 | 53073250 | 53076100 | 13.0seg_24 |
| 0 | 53557950 | 53562600 | 13.0seg_25 |
| 0 | 53566450 | 53572600 | 13.0seg_26 |
| 0 | 55049500 | 55050600 | 13.0seg_27 |
| 0 | 55924950 | 55939300 | 13.0seg_28 |
| 0 | 56323550 | 56325750 | 13.0seg_29 |
| 0 | 56348800 | 56356000 | 13.0seg_30 |
| 0 | 56357250 | 56361850 | 13.0seg_31 |
| 0 | 56538800 | 56540550 | 13.0seg_32 |
| 0 | 56853050 | 56856150 | 13.0seg_33 |
| 0 | 58008150 | 58010000 | 13.0seg_34 |
| 0 | 58908050 | 58911250 | 13.0seg_35 |
| 0 | 63672500 | 63675550 | 13.0seg_36 |
| 0 | 72093850 | 72101050 | 13.0seg_37 |
| 0 | 72760300 | 72763850 | 13.0seg_38 |
| 0 | 72764950 | 72769750 | 13.0seg_39 |
| 0 | 72774250 | 72777300 | 13.0seg_40 |
| 0 | 72953350 | 72954800 | 13.0seg_41 |
| 0 | 73396950 | 73403550 | 13.0seg_42 |
| 0 | 73404600 | 73405900 | 13.0seg_43 |
| 0 | 73407750 | 73410550 | 13.0seg_44 |
| 0 | 76091600 | 76093150 | 13.0seg_45 |
| 0 | 76192300 | 76195450 | 13.0seg_46 |
| 0 | 78320050 | 78322600 | 13.0seg_47 |
| 0 | 78332100 | 78342350 | 13.0seg_48 |
| 0 | 78347000 | 78350900 | 13.0seg_49 |
| 0 | 83854500 | 83857050 | 13.0seg_50 |
| 0 | 83858550 | 83860900 | 13.0seg_51 |
| 0 | 83863250 | 83867100 | 13.0seg_52 |
| 0 | 83871450 | 83873550 | 13.0seg_53 |
| 0 | 84484400 | 84486350 | 13.0seg_54 |
| 0 | 92900200 | 92902200 | 13.0seg_55 |
| 0 | 95472100 | 95473350 | 13.0seg_56 |
| 0 | 95479900 | 95481300 | 13.0seg_57 |
| 0 | 95638750 | 95648950 | 13.0seg_58 |
| 0 | 95650900 | 95656850 | 13.0seg_59 |
| 0 | 96899200 | 96900650 | 13.0seg_60 |
| 0 | 97128850 | 97130750 | 13.0seg_61 |
| 0 | 99122600 | 99130250 | 13.0seg_62 |
| 0 | 99133200 | 99137850 | 13.0seg_63 |
| 0 | 99159800 | 99162950 | 13.0seg_64 |
| 0 | 99199350 | 99200550 | 13.0seg_65 |
| 0 | 99272300 | 99274000 | 13.0seg_66 |
| 0 | 99342550 | 99343800 | 13.0seg_67 |
| 0 | 100668150 | 100669250 | 13.0seg_68 |
| 0 | 104123000 | 104126400 | 13.0seg_69 |
| 0 | 105842800 | 105845100 | 13.0seg_70 |
| 0 | 106233400 | 106237300 | 13.0seg_71 |
| 0 | 108681100 | 108682950 | 13.0seg_72 |
| 0 | 113777300 | 113785050 | 13.0seg_73 |
| 0 | 113824250 | 113826600 | 13.0seg_74 |
| 0 | 115244750 | 115251450 | 13.0seg_75 |
| 0 | 117092800 | 117097000 | 13.0seg_76 |
| 0 | 117099700 | 117101800 | 13.0seg_77 |
| 0 | 117103150 | 117104300 | 13.0seg_78 |
| 0 | 117814500 | 117815600 | 13.0seg_79 |
| 7 | 3356750 | 3361400 | 13.7seg_1 |
| 7 | 10357800 | 10361400 | 13.7seg_2 |
| 7 | 22072350 | 22075250 | 13.7seg_3 |
| 7 | 22097900 | 22100100 | 13.7seg_4 |
| 7 | 23403900 | 23406150 | 13.7seg_5 |
| 7 | 23486450 | 23489050 | 13.7seg_6 |
| 7 | 29043000 | 29045350 | 13.7seg_7 |
| 7 | 31648100 | 31652850 | 13.7seg_8 |
| 7 | 31706200 | 31724650 | 13.7seg_9 |
| 7 | 31892150 | 31905800 | 13.7seg_10 |
| 7 | 34743050 | 34745800 | 13.7seg_11 |
| 7 | 35055450 | 35057000 | 13.7seg_12 |
| 7 | 36059900 | 36062550 | 13.7seg_13 |
| 7 | 36814750 | 36828100 | 13.7seg_14 |
| 7 | 38436250 | 38439650 | 13.7seg_15 |
| 7 | 40796150 | 40810900 | 13.7seg_16 |
| 7 | 40822500 | 40841050 | 13.7seg_17 |
| 7 | 43397550 | 43399350 | 13.7seg_18 |
| 7 | 43879700 | 43881750 | 13.7seg_19 |
| 7 | 46060500 | 46062150 | 13.7seg_20 |
| 7 | 47217850 | 47219300 | 13.7seg_21 |
| 7 | 48751050 | 48769050 | 13.7seg_22 |
| 7 | 48826200 | 48827900 | 13.7seg_23 |
| 7 | 51660950 | 51665250 | 13.7seg_24 |
| 7 | 51942100 | 51945450 | 13.7seg_25 |
| 7 | 53557200 | 53562950 | 13.7seg_26 |
| 7 | 53566150 | 53570950 | 13.7seg_27 |
| 7 | 55051250 | 55052550 | 13.7seg_28 |
| 7 | 55057900 | 55059100 | 13.7seg_29 |
| 7 | 55490850 | 55492350 | 13.7seg_30 |
| 7 | 55573800 | 55575000 | 13.7seg_31 |
| 7 | 55924850 | 55940600 | 13.7seg_32 |
| 7 | 56322300 | 56325350 | 13.7seg_33 |
| 7 | 56349750 | 56364000 | 13.7seg_34 |
| 7 | 56395300 | 56398650 | 13.7seg_35 |
| 7 | 56538900 | 56540800 | 13.7seg_36 |
| 7 | 56853300 | 56856050 | 13.7seg_37 |
| 7 | 58008450 | 58009950 | 13.7seg_38 |
| 7 | 58097150 | 58098300 | 13.7seg_39 |
| 7 | 58213150 | 58215150 | 13.7seg_40 |
| 7 | 58907500 | 58910800 | 13.7seg_41 |
| 7 | 63671950 | 63675950 | 13.7seg_42 |
| 7 | 69875950 | 69879900 | 13.7seg_43 |
| 7 | 72093300 | 72102850 | 13.7seg_44 |
| 7 | 72760100 | 72763650 | 13.7seg_45 |
| 7 | 72764700 | 72770500 | 13.7seg_46 |
| 7 | 72773400 | 72779100 | 13.7seg_47 |
| 7 | 73396600 | 73410250 | 13.7seg_48 |
| 7 | 76192300 | 76194350 | 13.7seg_49 |
| 7 | 78302350 | 78303850 | 13.7seg_50 |
| 7 | 78311400 | 78313900 | 13.7seg_51 |
| 7 | 78315300 | 78326450 | 13.7seg_52 |
| 7 | 78328450 | 78329550 | 13.7seg_53 |
| 7 | 78331750 | 78345750 | 13.7seg_54 |
| 7 | 78347000 | 78351100 | 13.7seg_55 |
| 7 | 83853900 | 83862350 | 13.7seg_56 |
| 7 | 83863900 | 83869700 | 13.7seg_57 |
| 7 | 83871600 | 83873650 | 13.7seg_58 |
| 7 | 83878050 | 83879550 | 13.7seg_59 |
| 7 | 93196150 | 93198050 | 13.7seg_60 |
| 7 | 95479200 | 95481200 | 13.7seg_61 |
| 7 | 95639150 | 95656550 | 13.7seg_62 |
| 7 | 96213300 | 96214500 | 13.7seg_63 |
| 7 | 96900700 | 96904350 | 13.7seg_64 |
| 7 | 97693800 | 97696300 | 13.7seg_65 |
| 7 | 99122200 | 99139350 | 13.7seg_66 |
| 7 | 99160300 | 99162850 | 13.7seg_67 |
| 7 | 99271550 | 99276800 | 13.7seg_68 |
| 7 | 99342150 | 99344200 | 13.7seg_69 |
| 7 | 105842950 | 105845900 | 13.7seg_70 |
| 7 | 106234300 | 106236950 | 13.7seg_71 |
| 7 | 109004400 | 109006200 | 13.7seg_72 |
| 7 | 113775950 | 113785400 | 13.7seg_73 |
| 7 | 113787700 | 113790300 | 13.7seg_74 |
| 7 | 113823900 | 113826450 | 13.7seg_75 |
| 7 | 115246450 | 115250350 | 13.7seg_76 |
| 7 | 115890950 | 115892650 | 13.7seg_77 |
| 7 | 117082950 | 117105350 | 13.7seg_78 |
| 7 | 117495700 | 117497650 | 13.7seg_79 |
| 7 | 117813300 | 117816000 | 13.7seg_80 |
| 7 | 119502750 | 119504650 | 13.7seg_81 |

TABLE V-continued

|   | start | end | name |
|---|---|---|---|
| M | 3357350 | 3360800 | 13.Mseg_1 |
| M | 12197650 | 12199550 | 13.Mseg_2 |
| M | 12611450 | 12612950 | 13.Mseg_3 |
| M | 13875800 | 13877800 | 13.Mseg_4 |
| M | 19039700 | 19041400 | 13.Mseg_5 |
| M | 20181300 | 20183850 | 13.Mseg_6 |
| M | 21334350 | 21335400 | 13.Mseg_7 |
| M | 22086850 | 22089450 | 13.Mseg_8 |
| M | 22097600 | 22099800 | 13.Mseg_9 |
| M | 23400950 | 23406350 | 13.Mseg_10 |
| M | 23487000 | 23488600 | 13.Mseg_11 |
| M | 25146700 | 25149200 | 13.Mseg_12 |
| M | 30840050 | 30843450 | 13.Mseg_13 |
| M | 31649550 | 31652750 | 13.Mseg_14 |
| M | 31706200 | 31707550 | 13.Mseg_15 |
| M | 36060050 | 36061950 | 13.Mseg_16 |
| M | 38242350 | 38245450 | 13.Mseg_17 |
| M | 38436150 | 38439900 | 13.Mseg_18 |
| M | 40798050 | 40801350 | 13.Mseg_19 |
| M | 40803050 | 40806600 | 13.Mseg_20 |
| M | 40822600 | 40837900 | 13.Mseg_21 |
| M | 41209050 | 41210750 | 13.Mseg_22 |
| M | 43879750 | 43881300 | 13.Mseg_23 |
| M | 46512500 | 46515600 | 13.Mseg_24 |
| M | 48752700 | 48765900 | 13.Mseg_25 |
| M | 48825700 | 48828500 | 13.Mseg_26 |
| M | 49240400 | 49244450 | 13.Mseg_27 |
| M | 51661750 | 51664150 | 13.Mseg_28 |
| M | 53556650 | 53563050 | 13.Mseg_29 |
| M | 53566200 | 53572700 | 13.Mseg_30 |
| M | 54149750 | 54151600 | 13.Mseg_31 |
| M | 54866250 | 54868550 | 13.Mseg_32 |
| M | 54972950 | 54977050 | 13.Mseg_33 |
| M | 55050200 | 55052100 | 13.Mseg_34 |
| M | 55056400 | 55058200 | 13.Mseg_35 |
| M | 55479650 | 55480900 | 13.Mseg_36 |
| M | 55925150 | 55939650 | 13.Mseg_37 |
| M | 56321550 | 56326000 | 13.Mseg_38 |
| M | 56350700 | 56354900 | 13.Mseg_39 |
| M | 56357500 | 56362450 | 13.Mseg_40 |
| M | 56396300 | 56399550 | 13.Mseg_41 |
| M | 56538900 | 56540700 | 13.Mseg_42 |
| M | 56853850 | 56855800 | 13.Mseg_43 |
| M | 58008900 | 58010050 | 13.Mseg_44 |
| M | 58907300 | 58910550 | 13.Mseg_45 |
| M | 60703100 | 60704500 | 13.Mseg_46 |
| M | 63672900 | 63675800 | 13.Mseg_47 |
| M | 69876150 | 69879350 | 13.Mseg_48 |
| M | 72093600 | 72106600 | 13.Mseg_49 |
| M | 73397450 | 73403500 | 13.Mseg_50 |
| M | 73405300 | 73410050 | 13.Mseg_51 |
| M | 74776800 | 74777900 | 13.Mseg_52 |
| M | 76520800 | 76522700 | 13.Mseg_53 |
| M | 81771200 | 81773200 | 13.Mseg_54 |
| M | 83855650 | 83856850 | 13.Mseg_55 |
| M | 83859850 | 83861800 | 13.Mseg_56 |
| M | 83863850 | 83873800 | 13.Mseg_57 |
| M | 93195000 | 93197800 | 13.Mseg_58 |
| M | 93563650 | 93565150 | 13.Mseg_59 |
| M | 94443900 | 94445100 | 13.Mseg_60 |
| M | 95364800 | 95367500 | 13.Mseg_61 |
| M | 95454700 | 95456050 | 13.Mseg_62 |
| M | 95470950 | 95474500 | 13.Mseg_63 |
| M | 95476500 | 95482400 | 13.Mseg_64 |
| M | 95637750 | 95648350 | 13.Mseg_65 |
| M | 95651300 | 95656700 | 13.Mseg_66 |
| M | 96660450 | 96661950 | 13.Mseg_67 |
| M | 96900900 | 96904150 | 13.Mseg_68 |
| M | 97840950 | 97842850 | 13.Mseg_69 |
| M | 101320050 | 101323950 | 13.Mseg_70 |
| M | 104123300 | 104125050 | 13.Mseg_71 |
| M | 105843150 | 105845800 | 13.Mseg_72 |
| M | 106083650 | 106085350 | 13.Mseg_73 |
| M | 112141900 | 112143250 | 13.Mseg_74 |
| M | 113777450 | 113780200 | 13.Mseg_75 |
| M | 113782950 | 113785550 | 13.Mseg_76 |
| M | 113821150 | 113823500 | 13.Mseg_77 |
| M | 113824600 | 113826100 | 13.Mseg_78 |
| M | 117088200 | 117089450 | 13.Mseg_79 |
| M | 117093000 | 117094750 | 13.Mseg_80 |
| M | 117098050 | 117102350 | 13.Mseg_81 |
| M | 117493650 | 117500700 | 13.Mseg_82 |
| M | 118391300 | 118392850 | 13.Mseg_83 |

Example 8

Identification of lncRNAs Modifying X-linked Disease Genes

For the mouse inactive X-chromosome, strong and moderate PRC2 sites were identified by the allele-specific ChIP-seq analysis of days 0 and 7 mouse female ES cells, and MEFs (mouse embryonic fibroblasts) as described above. The transcriptome of day 7 differentiating female ES cells was also obtained by RNA-seq analysis. Transcripts in the RNA-seq library were aligned to the mouse July 2007 (NCBI37/mm9) genome using TopHat (Trapnell et al., Bioinformatics, 2009 May 1; 25(9):1105-11) to identify splice junctions, Additionally, Cufflinks (Trapnell et al., Nature Biotechnology 28, 511-515(2010)) was used to assemble full transcripts and quantitate their abundance. To call an lncRNA, transcripts were flagged that overlapped more than 80% with a protein-coding mRNA, The remaining transcripts were called "X-linked lncRNA", Previously annotated lncRNAs are given a specific ENSEMBL ID in Tables VI and VIII (e.g., ENSMUST00000083484). Novel predicted lncRNAs are given CUFF names (e.g., CUFF.14406) in Tables VI and VIII On the X chromosome, there are 54 disease genes known to date, To reactivate a specific gene for therapeutic purposes, it was reasoned that one could target a nearby strong or moderate site, or both. Relevant strong sites may reside several megabases away. Because there is one strong site for every 10 coding genes on average and there are 20-30 moderate sites on average in this interval, PRC2-associated lncRNAs were identified within strong and moderate sites in a +/−100 kb window from the TSS of the disease gene of interest. The following was done: first all EZH2 sites within +/−100 kb of the transcription start site (TSS) of a disease gene were identified. EZH2 segments that intersect the +/−100-kb window by ≥1 bp were included. This list of EZH2 segments was then intersected with the list of assembled "X-linked lncRNA" (identified by RNA-seq and TopHat/Cufflinks assembly, per above) to obtain Table VI. A total of 47 such lncRNAs were identified (See Table VI). There are 125 entries for these 47 distinct lncRNAs due to the fact that a single lncRNA can overlap multiple EZH2 sites.

TABLE VI

LncRNAs associated with strong and moderate EZH2 sites

Table VI presents a total of 47 distinct lncRNAs with XCI-associated PRC2 sites located within +/−100 kb of a disease gene of interest. The "start" and "stop" columns show the Start and stop base numbers (coordinates) on the mm9 ChrX; STR, strand (+/−) information. "SIN" refers to the SEQ ID NO:. The predicted transcript is named under "Transcript ID" using ENSEMBL nomenclature when the transcript is a previously annotated RNA. In the case of novel lncRNAs, the transcript is identified as "CUFF.X" where X is a newly assigned numerical. "Ezh2 ID" refers to the PRC2 segment shown in Table IVA or B (a strong or moderate site, as designated in column I as "Ezh2 type"). The "start" and "stop" coordinates of the Ezh2 site are also indicated (Ezh2 start and Ezh2 stop). Human LiftOver chromosome and start and stop coordinates for the predicted corresponding human lncRNAs are shown in the columns "h Chr", "hg19 start" and "hg19 stop" with strand information (+/−); numbers correspond to human genome build 19. Predicted human EZH2 sites are shown in columns "ezh2 hg19 start" and ezh2 hg19 stop". The nearest disease gene of interest corresponding to these PRC2-associated lncRNAs is shown in the last column ("disease gene").

| Start | Stop | Str | SIN: | Transcript_ID | Ezh2_ID | Ezh2_start | Ezh2_stop | Ezh2 type | h Chr | hg19_Start | hg19_Stop | hg19-str | SIN: | ezh2_hg19_start | ezh2_hg19_stop | Disease gene |
|---|---|---|---|---|---|---|---|---|---|---|---|---|---|---|---|---|
| 6948402 | 6952952 | − | 1 | ENSMUST00000134976 | seg_67 | 6952250 | 6954400 | M | chrX | 49644159 | 49648485 | + | 157 | 49642649 | 49644648 | CLCN5 |
| 6953051 | 6955168 | + | 2 | ENSMUST00000128858 | seg_67 | 6952250 | 6954400 | M | chrX | 49641851 | 49644052 | − | 158 | 49642649 | 49644648 | CLCN5 |
| 7418487 | 7449418 | + | 3 | CUFF.13987.1 | seg_100 | 7418000 | 7419950 | M | chrX | 48783029 | 48815641 | − | 174 | 48814127 | 48816443 | PQBP1 |
| 7418957 | 7453752 | + | 4 | CUFF.13988.3 | seg_100 | 7418000 | 7419950 | M | chrX | 48778055 | 48815149 | − | 175 | 48814127 | 48816443 | PQBP1 |
| 7418957 | 7452410 | + | 5 | CUFF.13988.4 | seg_100 | 7418000 | 7419950 | M | chrX | 48778055 | 48815149 | − | 222 | 48814127 | 48816443 | PQBP1 |
| 7419731 | 7452410 | + | 6 | ENSMUST00000150644 | seg_100 | 7418000 | 7419950 | M | chrX | 48779489 | 48814344 | − | 189 | 48814127 | 48816443 | PQBP1 |
| 7419731 | 7452750 | + | 7 | ENSMUST00000150644 | seg_102 | 7451100 | 7452750 | M | chrX | 48779489 | 48814344 | − | 190 | 48779300 | 48780883 | PQBP1 |
| 7476440 | 7483890 | + | 8 | CUFF.13992.1 | seg_105 | 7475700 | 7477250 | M | chrX | 48750837 | 48754815 | − | 176 | 48754430 | 48755836 | PQBP1 |
| 7476463 | 7497358 | + | 9 | CUFF.13985.1 | seg_105 | 7475700 | 7477250 | M | chrX | 48693572 | 48755112 | − | 177 | 48754430 | 48755836 | PQBP1 |
| 7476463 | 7497358 | + | 10 | CUFF.13985.1 | seg_106 | 7497150 | 7506950 | M | chrX | 48693572 | 48755112 | − | 178 | 48683657 | 48693841 | PQBP1 |
| 7476501 | 7476531 | + | 11 | CUFF.13986.1 | seg_105 | 7475700 | 7477250 | M | chrX | 48755060 | 48755074 | + | 179 | 48754430 | 48755836 | PQBP1 |
| 7476797 | 7483890 | + | 12 | CUFF.13992.3 | seg_105 | 7475700 | 7477250 | M | chrX | 48750837 | 48754815 | − | 183 | 48754430 | 48755836 | PQBP1 |
| 7527282 | 7527994 | − | 13 | ENSMUST00000117520 | seg_108 | 7526550 | 7528550 | M | other | 0 | 0 | + |  | 0 | 0 | OA1 = GPR143 |
| 7624355 | 7624525 | + | 14 | ENSMUST00000119726 | seg_114 | 7623400 | 7624800 | M | other | 0 | 0 | + |  | 0 | 0 | OA1 = GPR143 |
| 7624355 | 7624525 | + | 15 | ENSMUST00000119726 | seg_114 | 7623400 | 7624800 | M | other | 0 | 0 | + |  | 0 | 0 | OA1 = GPR143 |
| 7682420 | 7683239 | + | 16 | ENSMUST00000118546 | seg_117 | 7681350 | 7682450 | M | other | 0 | 0 | + |  | 0 | 0 | OA1 = GPR143 |
| 7682420 | 7683239 | + | 17 | ENSMUST00000118546 | seg_117 | 7681350 | 7682450 | M | other | 0 | 0 | + |  | 0 | 0 | OA1 = GPR143 |
| 7706844 | 7709637 | − | 18 | ENSMUST00000149257 | seg_120 | 7708050 | 7709850 | M | chrX | 48456197 | 48458240 | + | 223 | 48455984 | 48457509 | WAS |
| 7708468 | 7709984 | − | 19 | CUFF.13998.10 | seg_120 | 7708050 | 7709850 | M | chrX | 48455856 | 48457390 | + | 200 | 48455984 | 48457509 | WAS |
| 7731609 | 7753084 | − | 20 | ENSMUST00000133093 | seg_123 | 7752200 | 7753550 | M | chrX | 48398062 | 48419602 | + | 224 | 48397692 | 48398968 | WAS |
| 7731609 | 7753084 | − | 21 | ENSMUST100000133093 | seg_123 | 7752200 | 7753550 | M | chrX | 48398062 | 48419602 | + | 225 | 48397692 | 48398968 | WAS |
| 7731617 | 7753017 | − | 22 | ENSMUST00000143984 | seg_123 | 7752200 | 7753550 | M | chrX | 48398130 | 48419594 | + | 226 | 48397692 | 48398968 | WAS |
| 8903530 | 8904209 | − | 23 | CUFF.14023.1 | seg_142 | 8902450 | 8904350 | M | other | 0 | 0 | + |  | 0 | 0 | OA1 = GPR143 |
| 8904262 | 8904575 | − | 24 | CUFF.14022.1 | seg_142 | 8902450 | 8904350 | M | other | 0 | 0 | + |  | 0 | 0 | OA1 = GPR143 |

TABLE VI-continued

LncRNAs associated with strong and moderate EZH2 sites

Table VI presents a total of 47 distinct lncRNAs with XCI-associated PRC2 sites located within +/−100 kb of a disease gene of interest. The "start" and "stop" columns show the Start and stop base numbers (coordinates) on the mm9 ChrX; STR, strand (+/−) information; "SIN" refers to the SEQ ID NO. The predicted transcript is named under "Transcript ID" using ENSEMBL nomenclature when the transcript is a previously annotated RNA. In the case of novel lncRNAs, the transcript is identified as "CUFF.X" where X is a newly assigned numerical. "Ezh2 ID" refers to the PRC2 segment shown in Table IVA or B (a strong or moderate site, as designated in column I as "Ezh2 type"). The "start" and "stop" coordinates of the Ezh2 site are also indicated (Ezh2 start and Ezh2 stop). Human LiftOver chromosome and start and stop coordinates for the predicted corresponding human lncRNAs are shown in the columns "h Chr", "hg19 start" and "hg19 stop" with strand information (+/−); numbers correspond to human genome build 19. Predicted human EZH2 sites are shown in columns "ezh2 hg19 start" and ezh2 hg19 stop". The nearest disease gene of interest corresponding to these PRC2-associated lncRNAs is shown in the last column ("disease gene").

| Start | Stop | Str | SIN: | Transcript ID | Ezh2_ID | Ezh2_start | Ezh2_stop | Ezh2 type | h Chr | hg19_Start | hg19_Stop | hg19-str | SIN: | ezh2_hg19_start | ezh2_hg19_stop | Disease gene |
|---|---|---|---|---|---|---|---|---|---|---|---|---|---|---|---|---|
| 20194399 | 20225033 | + | 25 | CUFF.14074.1 | seg_17 | 20194000 | 20195500 | S | chrX | 47004091 | 47041189 | + | 137 | 47003630 | 47005197 | UBA1 |
| 20194399 | 20225033 | + | 26 | CUFF.14074.1 | seg_391 | 20193650 | 20196400 | M | chrX | 47004091 | 47041189 | + | 138 | 47003141 | 47006163 | UBA1 |
| 20194629 | 20228027 | + | 27 | CUFF.14095.1 | seg_17 | 20194000 | 20195500 | S | chrX | 47004307 | 47046225 | + | 196 | 47003630 | 47005197 | UBA1 |
| 20194629 | 20228027 | + | 28 | CUFF.14095.1 | seg_391 | 20193650 | 20196400 | M | chrX | 47004307 | 47046225 | + | 197 | 47003141 | 47006163 | UBA1 |
| 20194911 | 20226322 | + | 29 | ENSMUST00000141128 | seg_17 | 20194000 | 20195500 | S | chrX | 47004623 | 47044506 | + | 207 | 47003630 | 47005197 | UBA1 |
| 20194911 | 20226322 | + | 30 | ENSMUST00000141128 | seg_391 | 20193650 | 20196400 | M | chrX | 47004623 | 47044506 | + | 208 | 47003141 | 47006163 | UBA1 |
| 20194911 | 20226322 | + | 31 | ENSMUST00000141128 | seg_17 | 20194000 | 20195500 | S | chrX | 47004623 | 47044506 | + | 209 | 47003630 | 47005197 | UBA1 |
| 20194911 | 20226322 | + | 32 | ENSMUST00000141128 | seg_391 | 20193650 | 20196400 | M | chrX | 47004623 | 47044506 | + | 210 | 47003141 | 47006163 | UBA1 |
| 20281032 | 20294944 | + | 33 | CUFF.14075.2 | seg_394 | 20294250 | 20296200 | M | chrX | 47092379 | 47103954 | + | 139 | 47103171 | 47106480 | UBA1 |
| 45162547 | 45245729 | − | 34 | CUFF.14233.3 | seg_768 | 45243800 | 45248200 | M | chrX | 128580480 | 128657501 | − | 198 | 128655532 | 128659505 | OCRL |
| 45227508 | 45245609 | − | 35 | ENSMUST00000141084 | seg_768 | 45243800 | 45248200 | M | chrX | 128638885 | 128657382 | − | 211 | 128655532 | 128659505 | OCRL |
| 45363158 | 45363341 | + | 36 | CUFF.14229.1 | seg_774 | 45362150 | 45363400 | M | other | 0 | 0 | + | | 0 | 0 | OA1 = GPR143 |
| 45363178 | 45363342 | + | 37 | CUFF.14188.1 | seg_774 | 45362150 | 45363400 | M | other | 0 | 0 | + | | 0 | 0 | OA1 = GPR143 |
| 48368108 | 48371354 | − | 38 | CUFF.14256.2 | seg_899 | 48367900 | 48369550 | M | chrX | 131348118 | 131351566 | − | 184 | 131347929 | 131349656 | NYS1 = FRMD7 |
| 48371324 | 48371616 | − | 39 | CUFF.14209.1 | seg_900 | 48371400 | 48373300 | M | chrX | 131351532 | 131351823 | − | 140 | 131351609 | 131353535 | NYS1 = FRMD7 |
| 48371476 | 48371850 | − | 40 | CUFF.14210.1 | seg_900 | 48371400 | 48373300 | M | chrX | 131351714 | 131352061 | + | 141 | 131351609 | 131353535 | NYS1 = FRMD7 |
| 50341229 | 50374836 | + | 41 | CUFF.14271.1 | seg_1003 | 50340900 | 50342400 | M | chrX | 133594153 | 133634696 | + | 142 | 133593796 | 133595251 | HPRT1 = HPRT |
| 50341250 | 50341769 | + | 42 | CUFF.14224.1 | seg_1003 | 50340900 | 50342400 | M | chrX | 133594174 | 133594686 | + | 143 | 133593796 | 133595251 | HPRT1 = HPRT |
| 50407432 | 50407526 | − | 43 | ENSMUST00000083484 | seg_1004 | 50407500 | 50413850 | M | chrX | 133680658 | 133680753 | − | 144 | 133680727 | 133686885 | HPRT1 = HPRT |
| 50408223 | 50410367 | − | 44 | ENSMUST00000155622 | seg_1004 | 50407500 | 50413850 | M | chrX | 133681640 | 133683674 | − | 145 | 133680727 | 133686885 | HPRT1 = HPRT |
| 50408223 | 50410367 | − | 45 | ENSMUST00000155622 | seg_37 | 50410150 | 50413500 | S | chrX | 133681640 | 133683674 | − | 146 | 133683549 | 133686542 | HPRT1 = HPRT |
| 50408947 | 50410413 | − | 46 | CUFF.14272.4 | seg_1004 | 50407500 | 50413850 | M | chrX | 133682420 | 133683720 | − | 147 | 133680727 | 133686885 | HPRT1 = HPRT |

TABLE VI-continued

LncRNAs associated with strong and moderate EZH2 sites

Table VI presents a total of 47 distinct lncRNAs with XCI-associated PRC2 sites located within +/−100 kb of a disease gene of interest. The "start" and "stop" columns show the Start and stop base numbers (coordinates) on the mm9 ChrX; STR, strand (+/−) information; "SIN" refers to the SEQ ID NO. The predicted transcript is named under "Transcript ID" using ENSEMBL nomenclature when the transcript is a previously annotated RNA. In the case of novel lncRNAs, the transcript is identified as "CUFF.X" where X is a newly assigned numerical. "Ezh2 ID" refers to the PRC2 segment shown in Table IVA or B (a strong or moderate site, as designated in column I as "Ezh2 type"). The "start" and "stop" coordinates of the Ezh2 site are also indicated (Ezh2 start and Ezh2 stop). Human LiftOver chromosome and start and stop coordinates for the predicted corresponding human lncRNAs are shown in the columns "h Chr", "hg19 start" and "hg19 stop" with strand information (+/−); numbers correspond to human genome build 19. Predicted human EZH2 sites are shown in columns "ezh2 hg19 start" and ezh2 hg19 stop". The nearest disease gene of interest corresponding to these PRC2-associated lncRNAs is shown in the last column ("disease gene").

| Start | Stop | Str | SIN: | Transcript ID | Ezh2 ID | Ezh2_start | Ezh2_stop | Ezh2 type | h Chr | hg19_Start | hg19_Stop | hg19-str | SIN: | ezh2_hg19_start | ezh2_hg19_stop | Disease gene |
|---|---|---|---|---|---|---|---|---|---|---|---|---|---|---|---|---|
| 50408947 | 50410413 | − | 47 | CUFF.14272.4 | seg_37 | 50410150 | 50413500 | S | chrX | 133682420 | 133683720 | − | 148 | 133683549 | 133686542 | HPRT1 = HPRT |
| 50409370 | 50410367 | − | 48 | ENSMUST00000151099 | seg_1004 | 50407500 | 50413850 | M | chrX | 133682808 | 133683674 | − | 149 | 133680727 | 133686885 | HPRT1 = HPRT |
| 50409370 | 50410367 | − | 49 | ENSMUST00000151099 | seg_37 | 50410150 | 50413500 | S | chrX | 133682808 | 133683674 | − | 150 | 133683549 | 133686542 | HPRT1 = HPRT |
| 50409370 | 50410367 | − | 50 | ENSMUST00000151099 | seg_1004 | 50407500 | 50413850 | M | chrX | 133682808 | 133683674 | − | 151 | 133680727 | 133686885 | HPRT1 = HPRT |
| 50409370 | 50410367 | − | 51 | ENSMUST00000151099 | seg_37 | 50410150 | 50413500 | S | chrX | 133682808 | 133683674 | − | 152 | 133583549 | 133686547 | HPRT1 = HPRT |
| 65920689 | 65931574 | + | 52 | ENSMUST00000101520 | seg_1309 | 65930300 | 65933100 | M | chrX | 146974056 | 146993242 | + | 153 | 146992254 | 146994838 | FMR1 |
| 65931716 | 65951510 | + | 53 | CUFF.14287.2 | seg_1309 | 65930300 | 65933100 | M | chrX | 146993398 | 147012157 | + | 154 | 146992254 | 146994838 | FMR1 |
| 65931716 | 65970681 | + | 54 | CUFF.14287.3 | seg_1309 | 65930300 | 65933100 | M | chrX | 146993398 | 147032195 | + | 155 | 146992254 | 146994838 | FMR1 |
| 65931716 | 65970681 | + | 55 | CUFF.14352.1 | seg_1309 | 65930300 | 65933100 | M | chrX | 146993398 | 147032195 | + | 156 | 146992254 | 146994838 | FMR1 |
| 65932068 | 65932563 | + | 56 | CUFF.14288.1 | seg_1309 | 65930300 | 65933100 | M | chrX | 146993774 | 146994298 | + | 212 | 146992254 | 146994838 | FMR1 |
| 65932227 | 65932774 | + | 57 | CUFF.14353.1 | seg_1309 | 65930300 | 65933100 | M | chrX | 146993961 | 146994506 | + | 213 | 146992254 | 146994838 | FMR1 |
| 70884707 | 70887453 | + | 58 | CUFF.14399.1 | seg_1504 | 70880300 | 70886600 | M | chrX | 152912601 | 152915465 | + | 159 | 152907256 | 152914605 | ABCD1 |
| 70884707 | 70887453 | + | 59 | CUFF.14399.1 | seg_56 | 70884700 | 70886100 | S | chrX | 152912601 | 152915465 | + | 160 | 152912593 | 152913737 | ABCD1 |
| 70918489 | 70919425 | + | 60 | CUFF.14406.3 | seg_1507 | 70919050 | 70921750 | M | chrX | 152953368 | 152954327 | + | 161 | 152953952 | 152956569 | ABCD1 |
| 71038698 | 71070106 | − | 61 | CUFF.14350.4 | seg_1515 | 71069800 | 71072250 | M | chrX | 153067624 | 153096149 | − | 162 | 153095872 | 153098097 | L1CAM |
| 71167461 | 71171740 | + | 62 | ENSMUST00000135213 | seg_1524 | 71165700 | 71168200 | M | chrX | 153198707 | 153205716 | + | 214 | 153201262 | 153205716 | AVPR2 |
| 71188131 | 71212039 | − | 63 | CUFF.14346.3 | seg_1526 | 71210350 | 71212250 | M | chrX | 153213005 | 153236998 | − | 188 | 153235226 | 153237200 | AVPR2 |
| 71209543 | 71210383 | − | 64 | CUFF.14432.1 | seg_1526 | 71210350 | 71212250 | M | chrX | 153234378 | 153235269 | − | 215 | 153235226 | 153237200 | AVPR2 |
| 71212129 | 71212322 | + | 65 | CUFF.14347.1 | seg_1526 | 71210350 | 71212250 | M | chrX | 153237078 | 153237272 | + | 163 | 153235226 | 153237200 | AVPR2 |
| 71252041 | 71252841 | + | 66 | ENSMUST00000120692 | seg_1528 | 71251100 | 71253700 | M | other | 0 | 0 | + | 0 | 0 | 0 | OA1 = GPR143 |
| 71252041 | 71252841 | + | 67 | ENSMUST00000120692 | seg_1528 | 71251100 | 71253700 | M | other | 0 | 0 | + | 0 | 0 | 0 | OA1 = GPR143 |
| 71491032 | 71491211 | − | 63 | CUFF.14417.1 | seg_1536 | 71489000 | 71492050 | M | chrX | 153598856 | 153599051 | − | 216 | 153599880 | 153599880 | EMD |
| 71491144 | 71491278 | + | 69 | CUFF.14563.1 | seg_1536 | 71489000 | 71492050 | M | chrX | 153598983 | 153599133 | + | 217 | 153599880 | 153599880 | EMD |
| 71500026 | 71500436 | + | 70 | CUFF.14439.2 | seg_1537 | 71499550 | 71501250 | M | chrX | 153607566 | 153607980 | + | 164 | 153606662 | 153608766 | EMD |
| 71500100 | 71501024 | + | 71 | ENSMUST00000129516 | seg_1537 | 71499550 | 71501250 | M | chrX | 153607643 | 153608527 | + | 218 | 153606662 | 153608766 | EMD |
| 71527251 | 71528204 | + | 72 | ENSMUST00000146260 | seg_1538 | 71525800 | 71528950 | M | chrX | 153637932 | 153640001 | + | 165 | 153636852 | 153640773 | EMD |
| 71527251 | 71528254 | + | 73 | ENSMUST00000135012 | seg_1538 | 71525800 | 71528950 | M | chrX | 153637932 | 153640082 | + | 166 | 153636852 | 153640773 | EMD |

TABLE VI-continued

LncRNAs associated with strong and moderate EZH2 sites

Table VI presents a total of 47 distinct lncRNAs with XCI-associated PRC2 sites located within +/−100 kb of a disease gene of interest. The "start" and "stop" columns show the Start and stop base numbers (coordinates) on the mm9 ChrX; STR, strand (+/−) information; "SIN" refers to the SEQ ID NO:. The predicted transcript is named under "Transcript ID" using ENSEMBL nomenclature when the transcript is a previously annotated RNA. In the case of novel lncRNAs, the transcript is identified as "CUFF.X" where X is a newly assigned numerical. "Ezh2 ID" refers to the PRC2 segment shown in Table IVA or B (a strong or moderate site, as designated in column I as "Ezh2 type"). The "start" and "stop" coordinates of the Ezh2 site are also indicated (Ezh2 start and Ezh2 stop). Human LiftOver chromosome and start and stop coordinates for the predicted corresponding human lncRNAs are shown in the columns "h Chr", "hg19 start" and "hg19 stop" with strand information (+/−); numbers correspond to human genome build 19. Predicted human EZH2 sites are shown in columns "ezh2 hg19 start" and ezh2 hg19 stop". The nearest disease gene of interest corresponding to these PRC2-associated lncRNAs is shown in the last column ("disease gene").

| Start | Stop | Str | SIN: | Transcript ID | Ezh2 ID | Ezh2_start | Ezh2_stop | Ezh2 type | h Chr | hg19_Start | hg19_Stop | hg19 str | SIN: | ezh2_hg19_start | ezh2_hg19_stop | Disease gene |
|---|---|---|---|---|---|---|---|---|---|---|---|---|---|---|---|---|
| 71527980 | 71535490 | + | 74 | CUFF.14421.3 | seg_1538 | 71525800 | 71528950 | M | chrX | 153639773 | 153650067 | + | 167 | 153636852 | 153640773 | EMD |
| 71528089 | 71533374 | + | 75 | ENSMUST00000156880 | seg_1538 | 71525800 | 71528950 | M | chrX | 153639886 | 153647898 | + | 219 | 153636852 | 153640773 | EMD |
| 71528089 | 71535487 | + | 76 | ENSMUST00000124200 | seg_1538 | 71525800 | 71528950 | M | chrX | 153639886 | 153650064 | + | 220 | 153636852 | 153640773 | EMD |
| 71528090 | 71535488 | + | 77 | ENSMUST00000114182 | seg_1538 | 71525800 | 71528950 | M | chrX | 153639887 | 153650065 | + | 221 | 153636852 | 153640773 | EMD |
| 71550319 | 71553622 | + | 78 | CUFF.14360.1 | seg_1540 | 71549400 | 71551350 | M | chrX | 153665202 | 153668876 | + | 168 | 153664294 | 153666201 | EMD |
| 71550319 | 71557201 | + | 79 | CUFF.14360.2 | seg_1540 | 71549400 | 71551350 | M | chrX | 153665202 | 153671813 | + | 169 | 153664294 | 153666201 | EMD |
| 71550337 | 71553623 | + | 80 | CUFF.14449.2 | seg_1540 | 71549400 | 71551350 | M | chrX | 153665244 | 153668877 | + | 170 | 153664294 | 153666201 | EMD |
| 71574384 | 71597045 | + | 81 | CUFF.14364.2 | seg_1542 | 71572900 | 71574500 | M | chrX | 153686599 | 153702184 | + | 172 | 153686144 | 153686719 | IKBKG |
| 71574384 | 71590028 | + | 82 | CUFF.14364.1 | seg_1542 | 71572900 | 71574500 | M | chrX | 153686599 | 153702184 | + | 171 | 153686144 | 153686710 | IKBKG |
| 71574404 | 71588866 | + | 83 | CUFF.14453.2 | seg_1542 | 71572900 | 71574500 | M | chrX | 153686620 | 153701013 | + | 173 | 153686144 | 153686719 | IKBKG |
| 71598672 | 71598963 | − | 84 | CUFF.14450.4 | seg_1543 | 71597350 | 71599550 | M | chrX | 153707075 | 153707335 | − | 186 | 153706026 | 153707374 | IKBKG |
| 71598672 | 71598963 | + | 85 | CUFF.14450.4 | seg_58 | 71597850 | 71598950 | S | chrX | 153707075 | 153707335 | − | 187 | 153706412 | 153707323 | IKBKG |
| 71675010 | 71699193 | + | 86 | CUFF.14372.14 | seg_1547 | 71673000 | 71675050 | M | chrX | 153775825 | 153799420 | + | 199 | 153773591 | 153775852 | G6PD = G6PDX |
| 72388763 | 72388969 | + | 87 | ENSMUST00000121894 | seg_1564 | 72385650 | 72389350 | M | other | 0 | 0 | + | | 0 | 0 | OA1 = GPR143 |
| 72388763 | 72388969 | + | 88 | ENSMUST00000121894 | seg_1564 | 72385650 | 72389350 | M | other | 0 | 0 | + | | 0 | 0 | OA1 = GPR143 |
| 72389027 | 72389809 | + | 89 | ENSMUST00000116535 | seg_1564 | 72385650 | 72389350 | M | other | 0 | 0 | + | | 0 | 0 | OA1 = GPR143 |
| 72389027 | 72389809 | + | 90 | ENSMUST00000116535 | seg_1564 | 72385650 | 72389350 | M | other | 0 | 0 | + | | 0 | 0 | OA1 = GPR143 |
| 101531844 | 101543844 | − | 91 | CUFF.14676.1 | seg_2367 | 101528100 | 101532450 | M | other | 0 | 0 | + | | 0 | 0 | OA1 = GPR143 |
| 101531844 | 101543844 | − | 92 | CUFF.14676.1 | seg_2368 | 101541300 | 101544300 | M | other | 0 | 0 | + | | 0 | 0 | OA1 = GPR143 |
| 101541168 | 101543573 | − | 93 | ENSMUST00000120233 | seg_2368 | 101541300 | 101544300 | M | other | 0 | 0 | + | | 0 | 0 | OA1 = GPR143 |
| 103106842 | 103124685 | − | 94 | ENSMUST00000126345 | seg_2443 | 103106750 | 103108550 | M | chrX | 76995795 | 77041698 | − | 191 | 76995713 | 77031704 | ATRX |
| 131120171 | 131120713 | + | 95 | CUFF.14771.1 | seg_2832 | 131119150 | 131121200 | M | chrX | 100645947 | 100646543 | + | 126 | 100644952 | 100646916 | BTK |
| 131120229 | 131122601 | + | 96 | ENSMUST00000170828 | seg_2832 | 131119150 | 131121200 | M | chrX | 100646005 | 100650827 | + | 192 | 100644952 | 100646916 | BTK |
| 131216059 | 131216416 | + | 97 | ENSMUST00000117957 | seg_2837 | 131214300 | 131216200 | M | other | 0 | 0 | + | | 0 | 0 | OA1 = GPR143 |

TABLE VI-continued

LncRNAs associated with strong and moderate EZH2 sites

Table VI presents a total of 47 distinct lncRNAs with XCI-associated PRC2 sites located within +/−100 kb of a disease gene of interest. The "start" and "stop" columns show the Start and stop base numbers (coordinates) on the mm9 ChrX; STR, strand (+/−) information; "SIN" refers to the SEQ ID NO. The predicted transcript is named under "Transcript ID" using ENSEMBL nomenclature when the transcript is a previously annotated RNA. In the case of novel lncRNAs, the transcript is identified as "CUFF.X" where X is a newly assigned numerical. "Ezh2 ID" refers to the PRC2 segment shown in Table IVA or B (a strong or moderate site, as designated in column I as "Ezh2 type"). The "start" and "stop" coordinates of the Ezh2 site are also indicated (Ezh2 start and Ezh2 stop). Human LiftOver chromosome and start and stop coordinates for the predicted corresponding human lncRNAs are shown in the columns "h Chr", "hg19 start" and "hg19 stop" with strand information (+/−); numbers correspond to human genome build 19. Predicted human EZH2 sites are shown in columns "ezh2 hg19 start" and ezh2 hg19 stop". The nearest disease gene of interest corresponding to these PRC2-associated lncRNAs is shown in the last column ("disease gene").

| Start | Stop | Str | SIN: | Transcript ID | Ezh2_ID | Ezh2_start | Ezh2_stop | Ezh2 type | h Chr | hg19_Start | hg19_Stop | hg19-str | SIN: | ezh2_hg19_start | ezh2_hg19_stop | Disease gene |
|---|---|---|---|---|---|---|---|---|---|---|---|---|---|---|---|---|
| 131216059 | 131216416 | + | 98 | ENSMUST00000117957 | seg_2837 | 131214300 | 131216200 | M | other | 0 | 0 | + | 201 | 0 | 0 | OA1 = GPR143 |
| 131223346 | 131231296 | + | 99 | CUFF.14776.2 | seg_2838 | 131220750 | 131223850 | M | chrX | 100742982 | 100750790 | + | 127 | 100740062 | 100743543 | GLA |
| 136991152 | 136999981 | + | 100 | ENSMUST00000155235 | seg_3081 | 136989950 | 136993450 | M | chrX | 106871733 | 106882715 | + | 128 | 106870757 | 106873713 | PRPS1 |
| 136991152 | 136999981 | + | 101 | ENSMUST00000155235 | seg_3081 | 136989950 | 136993450 | M | chrX | 106871733 | 106882715 | + | 129 | 106870757 | 106873713 | PRPS1 |
| 137074067 | 137077207 | − | 102 | ENSMUST00000112995 | seg_3088 | 137074650 | 137078000 | M | chrX | 106956451 | 106959745 | − | 185 | 106955989 | 106960573 | PRPS1 |
| 137077642 | 137083068 | − | 103 | ENSMUST00000152048 | seg_3088 | 137074650 | 137078000 | M | chrX | 106960212 | 106965429 | − | | 106956989 | 106960573 | PRPS1 |
| 138062502 | 138063011 | + | 104 | ENSMUST00000118845 | seg_3158 | 138061650 | 138063400 | M | other | 0 | 0 | + | | 0 | 0 | OA1 = GPR143 |
| 147079847 | 147091979 | − | 105 | CUFF.14799.4 | seg_3402 | 147079250 | 147080800 | M | chrX | 54947223 | 54957868 | + | 182 | 54957123 | 54958355 | ALAS2 |
| 147417684 | 147442281 | − | 106 | CUFF.14800.3 | seg_3419 | 147442200 | 147443900 | M | chrX | 54561410 | 54591707 | + | 130 | 54560615 | 54561460 | FGD1 |
| 147481431 | 147502847 | + | 107 | CUFF.14802.3 | seg_3422 | 147478700 | 147483450 | M | chrX | 54475005 | 54522668 | − | 202 | 54520506 | 54525870 | FGD1 |
| 147481431 | 147521724 | + | 108 | CUFF.14907.2 | seg_3422 | 147478700 | 147483450 | M | chrX | 54475005 | 54522668 | − | 203 | 54520506 | 54525870 | FGD1 |
| 147481431 | 147521724 | + | 109 | CUFF.14802.2 | seg_3422 | 147478700 | 147483450 | M | chrX | 54475005 | 54522668 | − | 204 | 54520506 | 54525870 | FGD1 |
| 148089731 | 148090645 | + | 110 | ENSMUST00000121650 | seg_3440 | 148088650 | 148090350 | M | other | 0 | 0 | + | | 0 | 0 | OA1 = GPR143 |
| 148089731 | 148090645 | + | 111 | ENSMUST00000121650 | seg_3440 | 148088650 | 148090350 | M | other | 0 | 0 | + | | 0 | 0 | OA1 = GPR143 |
| 148578768 | 148639178 | + | 112 | CUFF.14816.1 | seg_119 | 148578700 | 148580800 | S | chrX | 53283545 | 53350548 | − | 131 | 53348417 | 53350616 | MRX1 = QSEC2 |
| 148578768 | 148639178 | + | 113 | CUFF.14816.1 | seg_3460 | 148578400 | 148581050 | M | chrX | 53283545 | 53350548 | − | 132 | 53348024 | 53350934 | MRX1 = QSEC2 |
| 149044052 | 149204222 | − | 114 | CUFF.14826.2 | seg_3484 | 149203250 | 149205000 | M | chrX | 9754409 | 9917528 | + | 193 | 9753597 | 9755295 | OA1 = GPR143 |
| 149057511 | 149204219 | − | 115 | CUFF.14936.7 | seg_3484 | 149203250 | 149205000 | M | chrX | 9754412 | 9901148 | + | 194 | 9753597 | 9755295 | OA1 = GPR143 |
| 151696962 | 151731456 | + | 116 | CUFF.14845.1 | seg_3550 | 151696250 | 151698050 | M | chrX | 23722764 | 23761432 | − | 133 | 23760757 | 23761726 | SAT = SAT1 |

TABLE VI-continued

LncRNAs associated with strong and moderate EZH2 sites

Table VI presents a total of 47 distinct lncRNAs with XCI-associated PRC2 sites located within +/−100 kb of a disease gene of interest. The "start" and "stop" columns show the Start and stop base numbers (coordinates) on the mm9 ChrX; STR, strand (+/−) information; "SIN" refers to the SEQ ID NO:. The predicted transcript is named under "Transcript ID" using ENSEMBL nomenclature when the transcript is a previously annotated RNA. In the case of novel lncRNAs, the transcript is identified as "CUFF.X" where X is a newly assigned numerical. "Ezh2 ID" refers to the PRC2 segment shown in Table IVA or B (a strong or moderate site, as designated in column I as "Ezh2 type"). The "start" and "stop" coordinates of the Ezh2 site are also indicated (Ezh2 start and Ezh2 stop). Human LiftOver chromosome and start and stop coordinates for the predicted corresponding human lncRNAs are shown in the columns "h Chr", "hg19 start" and "hg19 stop" with strand information (+/−); numbers correspond to human genome build 19. Predicted human EZH2 sites are shown in columns "ezh2_hg19_start" and ezh2_hg19 stop". The nearest disease gene of interest corresponding to these PRC2-associated lncRNAs is shown in the last column ("disease gene").

| Start | Stop | Str | SIN: | Transcript ID | Ezh2_ID | Ezh2_start | Ezh2_stop | Ezh2 type | h Chr | hg19_Start | hg19_Stop | hg19-str | SIN: | ezh2_hg19_start | ezh2_hg19_stop | Disease gene |
|---|---|---|---|---|---|---|---|---|---|---|---|---|---|---|---|---|
| 151696978 | 151697427 | + | 117 | CUFF.14962.1 | seg_3550 | 151696250 | 151698050 | M | chrX | 23761017 | 23761415 | − | 134 | 23760757 | 23761726 | SAT = SAT1 |
| 151696986 | 151698125 | + | 118 | ENSMUST00000134662 | seg_3550 | 151696250 | 151698050 | M | chrX | 23760757 | 23761407 | − | 135 | 23760757 | 23761726 | SAT = SAT1 |
| 151738742 | 151740292 | − | 119 | ENSMUST00000144428 | seg_3551 | 151740100 | 151741400 | M | other | 0 | 0 | + | | 0 | 0 | OA1 = GPR143 |
| 153915277 | 153915525 | − | 120 | CUFF.14971.1 | seg_3603 | 153914450 | 153916200 | M | chrX | 21971056 | 21975269 | + | 205 | 21974127 | 21976977 | PHEX |
| 157027663 | 157036207 | + | 121 | CUFF.15003.1 | seg_3707 | 157034600 | 157036250 | M | chrX | 18907129 | 18912800 | − | 181 | 18906778 | 18908445 | PHKA2 |
| 157241673 | 157241983 | − | 122 | CUFF.15005.1 | seg_3718 | 157241500 | 157242700 | M | chrX | 18651084 | 18651384 | + | 206 | 18650361 | 18651566 | RS1 |
| 157246270 | 157432634 | − | 123 | CUFF.15001.3 | seg_3729 | 157431550 | 157434400 | M | chrX | 18443703 | 18646844 | + | 180 | 18441881 | 18444750 | CDKL5 |
| 162827965 | 162878637 | − | 124 | CUFF.15054.2 | seg_3948 | 162877500 | 162879500 | M | chrX | 13752890 | 13788174 | + | 195 | 13750751 | 13753578 | OFD1 |
| 162948132 | 162948265 | + | 125 | CUFF.14908.1 | seg_3951 | 162946950 | 162949350 | M | chrX | 13671391 | 13671542 | − | 136 | 13670689 | 13672284 | SEDL = TRAPPC2 |

If the stringency were relaxed beyond +/−100 kb, a total of 230 distinct lncRNAs with XCI-associated PRC2 sites was observed; these are set forth in Table VII. There are 640 entries for these 230 distinct lncRNAs in Table VII, also due to the fact that a single lncRNA can overlap multiple EZH2 sites. A strong or moderate site located >100 kb away from a gene of interest may be involved in repressing the gene at long range. The present data suggests that a single strong EZH2 site (for example) could control genes over a 1-2 Mb domain,

TABLE VII

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 5976972 | 6214566 | + | CUFF.13967.2 | seg_25 | 5976300 | 5978850 | M | chrX | 50336327 | 50557310 | − | 124335918 | 124340213 | CLCN5 |
| 5977553 | 5977692 | + | CUFF.13962.1 | seg_25 | 5976300 | 5978850 | M | chrX | 50556592 | 50556724 | − | 124335918 | 124340213 | CLCN5 |
| 6356106 | 6474704 | + | CUFF.13966.1 | seg_1 | 6355950 | 6357900 | S | chrX | 50143999 | 50213570 | + | 50211825 | 50213570 | CLCN5 |
| 6356106 | 6474704 | + | CUFF.13966.1 | seg_33 | 6353350 | 6359000 | M | chrX | 50143999 | 50213570 | + | 50210632 | 50215941 | CLCN5 |
| 6948402 | 6952952 | − | ENSMUST00000134976 | seg_67 | 6952250 | 6954400 | M | chrX | 49644851 | 49648485 | + | 49642649 | 49644648 | CLCN5 |
| 6953051 | 6955168 | + | ENSMUST00000128858 | seg_67 | 6952250 | 6954400 | M | chrX | 49641851 | 49644052 | + | 49642649 | 49644648 | CLCN5 |
| 7134422 | 7154618 | − | CUFF.13970.2 | seg_82 | 7132850 | 7137250 | M | chrX | 49123140 | 49146158 | + | 49143046 | 49147196 | PQBP1 |
| 7215764 | 7224495 | + | ENSMUST00000149795 | seg_86 | 7224100 | 7226000 | M | chrX | 49049104 | 49056698 | − | 49143046 | 49147196 | PQBP1 |
| 7329256 | 7329540 | + | ENSMUST00000121084 | seg_92 | 7328650 | 7330300 | M | chrX | 114953264 | 114953549 | − | 73832957 | 73834636 | COL4A5 |
| 7329256 | 7329540 | + | ENSMUST00000121084 | seg_92 | 7328650 | 7330300 | M | chrX | 114953264 | 114953549 | − | 0 | 0 | COL4A5 |
| 7367144 | 7397082 | − | ENSMUST00000132456 | seg_95 | 7365650 | 7367450 | M | chrX | 48830738 | 48858649 | − | 95939522 | 95940514 | PQBP1 |
| 7367144 | 7397082 | − | ENSMUST00000132456 | seg_95 | 7365650 | 7367450 | M | chrX | 48830738 | 48858649 | − | 95939522 | 95940514 | PQBP1 |
| 7418487 | 7449418 | + | CUFF.13987.1 | seg_100 | 7418000 | 7419950 | M | chrX | 48783029 | 48815641 | − | 48814127 | 48816443 | PQBP1 |
| 7418957 | 7453752 | + | CUFF.13988.3 | seg_100 | 7418000 | 7419950 | M | chrX | 48778055 | 48815149 | − | 48814127 | 48816443 | PQBP1 |
| 7418957 | 7453752 | + | CUFF.13988.4 | seg_100 | 7418000 | 7419950 | M | chrX | 48778055 | 48815149 | − | 48814127 | 48816443 | PQBP1 |
| 7419731 | 7452410 | + | ENSMUST00000150644 | seg_100 | 7418000 | 7419950 | M | chrX | 48779489 | 48814344 | − | 48814127 | 48816443 | PQBP1 |
| 7419731 | 7452410 | + | ENSMUST00000150644 | seg_102 | 7451100 | 7452750 | M | chrX | 48779489 | 48814344 | − | 48779300 | 48780883 | PQBP1 |
| 7476440 | 7483890 | + | CUFF.13992.1 | seg_105 | 7475700 | 7477250 | M | chrX | 48750837 | 48754815 | − | 48754430 | 48755836 | PQBP1 |
| 7476463 | 7497358 | + | CUFF.13985.1 | seg_105 | 7475700 | 7477250 | M | chrX | 48693572 | 48755112 | − | 48754430 | 48755836 | PQBP1 |
| 7476463 | 7497358 | + | CUFF.13985.1 | seg_106 | 7497150 | 7506950 | M | chrX | 48693572 | 48755112 | − | 48683657 | 48693841 | PQBP1 |
| 7476501 | 7476531 | + | CUFF.13986.1 | seg_105 | 7475700 | 7477250 | M | chrX | 48755060 | 48755074 | − | 48754430 | 48755836 | PQBP1 |
| 7476797 | 7483890 | + | CUFF.13992.3 | seg_105 | 7475700 | 7477250 | M | chrX | 48750837 | 48754815 | + | 48754430 | 48755836 | PQBP1 |
| 7527282 | 7527994 | − | ENSMUST00000117520 | seg_108 | 7526550 | 7528550 | M | other | 0 | 0 | + | 106690970 | 106694548 | OA1 = GPR143 |
| 7624355 | 7624525 | + | ENSMUST00000119726 | seg_114 | 7623400 | 7624800 | M | other | 0 | 0 | + | 0 | 0 | OA1 = GPR143 |
| 7624355 | 7624525 | + | ENSMUST00000119726 | seg_114 | 7623400 | 7624800 | M | other | 0 | 0 | + | 0 | 0 | OA1 = GPR143 |
| 7682420 | 7683239 | + | ENSMUST00000118546 | seg_117 | 7681350 | 7682450 | M | other | 0 | 0 | + | 111324058 | 111328035 | OA1 = GPR143 |
| 7682420 | 7683239 | + | ENSMUST00000118546 | seg_117 | 7681350 | 7682450 | M | other | 0 | 0 | + | 111324058 | 111328035 | OA1 = GPR143 |
| 7706844 | 7709637 | + | ENSMUST00000149257 | seg_120 | 7708050 | 7709850 | M | chrX | 43456197 | 48458240 | + | 48455984 | 48457509 | WAS |
| 7708468 | 7709984 | + | CUFF.13998.10 | seg_120 | 7708050 | 7709850 | M | chrX | 48455856 | 48457390 | + | 48455984 | 48457509 | WAS |
| 7731609 | 7753084 | + | ENSMUST00000133093 | seg_123 | 7752200 | 7753550 | M | chrX | 48398062 | 48419602 | + | 48397692 | 48398968 | WAS |
| 7731609 | 7753084 | + | ENSMUST00000133093 | seg_123 | 7752200 | 7753550 | M | chrX | 48398062 | 48419602 | + | 48397692 | 48398968 | WAS |
| 7731617 | 7753017 | − | ENSMUST00000143984 | seg_123 | 7752200 | 7753550 | M | chrX | 48398130 | 48419594 | + | 48397692 | 48398968 | WAS |
| 7767001 | 7770024 | + | ENSMUST00000149495 | seg_124 | 7769500 | 7771450 | M | chrX | 48380199 | 48382586 | + | 48382586 | 23354524 | WAS |
| 7767001 | 7770024 | + | ENSMUST00000149495 | seg_124 | 7769500 | 7771450 | M | chrX | 48380199 | 48382586 | + | 48382586 | 23354524 | WAS |
| 7770971 | 7783651 | − | CUFF.14005.1 | seg_124 | 7769500 | 7771450 | M | chrX | 48367347 | 48371257 | + | 23349576 | 23354524 | WAS |
| 7770971 | 7783651 | − | CUFF.14005.1 | seg_125 | 7782550 | 7784550 | M | chrX | 48367347 | 48371257 | + | 48365856 | 48368481 | WAS |
| 7770974 | 7787507 | − | CUFF.13999.1 | seg_124 | 7769500 | 7771450 | M | chrX | 48363330 | 48379198 | + | 48363330 | 48364503 | WAS |
| 7770974 | 7787507 | − | CUFF.13999.1 | seg_126 | 7786050 | 7787900 | M | chrX | 48363330 | 48379198 | + | 48363330 | 48364503 | WAS |
| 7770979 | 7783623 | − | ENSMUST00000122943 | seg_124 | 7769500 | 7771450 | M | chrX | 48367374 | 48379193 | + | 23349576 | 23354524 | WAS |
| 7770979 | 7783623 | − | ENSMUST00000122943 | seg_125 | 7782550 | 7784550 | M | chrX | 48367374 | 48379193 | + | 48365856 | 48368481 | WAS |
| 7780134 | 7783651 | + | CUFF.13999.8 | seg_125 | 7782550 | 7784550 | M | chrX | 48367347 | 48371257 | + | 48365856 | 48368481 | WAS |
| 8769671 | 8792653 | + | CUFF.14016.1 | seg_139 | 8755150 | 8778300 | M | chrX | 37430765 | 37481482 | + | 37429656 | 37431928 | XK |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 8903530 | 8904209 | - | CUFF.14023.1 | seg_142 | 8902450 | 8904350 | M | other | 0 | 0 | + | 0 | 0 | OA1 = GPR143 |
| 8904262 | 8904575 | - | CUFF.14022.1 | seg_142 | 8902450 | 8904350 | M | other | 0 | 0 | + | 0 | 0 | OA1 = GPR143 |
| 9233402 | 9240129 | + | ENSMUST00000154091 | seg_145 | 9239450 | 9240700 | M | chrX | 37700168 | 37706872 | - | 37706179 | 37707339 | CYBB |
| 10062235 | 10173613 | + | CUFF.14024.1 | seg_170 | 10060250 | 10063600 | M | chrX | 38420746 | 38548056 | + | 38418377 | 38422130 | OTC |
| 10062248 | 10173731 | - | CUFF.14034.1 | seg_170 | 10060250 | 10063600 | M | chrX | 38420761 | 38548175 | - | 38418377 | 38422130 | OTC |
| 10284302 | 10295947 | - | CUFF.14026.1 | seg_176 | 10294100 | 10296950 | M | chrX | 38652969 | 38664787 | + | 38662899 | 38665833 | OTC |
| 10284302 | 10295947 | - | CUFF.14026.1 | seg_4 | 10294900 | 10296300 | S | chrX | 38652969 | 38664787 | + | 38663737 | 38665158 | OTC |
| 10292145 | 10296816 | + | CUFF.14027.3 | seg_176 | 10294100 | 10296950 | M | chrX | 38660685 | 38665692 | - | 38662899 | 38665833 | OTC |
| 10294443 | 10294862 | + | CUFF.14027.4 | seg_176 | 10294100 | 10296950 | M | chrX | 38663247 | 38663698 | - | 38662899 | 38665833 | OTC |
| 11241367 | 11241392 | - | CUFF.14028.1 | seg_222 | 11237650 | 11247250 | M | chrX | 39547664 | 39547694 | + | 39544481 | 39551310 | OTC |
| 11421805 | 11421826 | - | CUFF.14029.1 | seg_230 | 11421800 | 11423650 | M | other | 0 | 0 | - | 39719105 | 39720500 | OA1 = GPR143 |
| 11490217 | 11490415 | - | ENSMUST00000121919 | seg_233 | 11490400 | 11492200 | M | chrX | 39646386 | 39646595 | - | 39784049 | 39785370 | OTC |
| 11490217 | 11490415 | - | ENSMUST00000121919 | seg_233 | 11490400 | 11492200 | M | chrX | 39646386 | 39646595 | - | 39784049 | 39785370 | OTC |
| 11613866 | 11737559 | - | CUFF.14045.5 | seg_12 | 11727350 | 11738450 | 5 | chrX | 39910507 | 40036404 | - | 40025540 | 40037252 | OTC |
| 11613866 | 11737559 | - | CUFF.14045.5 | seg_245 | 11726100 | 11739000 | M | chrX | 39910507 | 40036404 | - | 40024407 | 40037420 | OTC |
| 11613866 | 11705532 | - | CUFF.14045.3 | seg_11 | 11699450 | 11718900 | S | chrX | 39910507 | 40005885 | - | 39999869 | 40018589 | OTC |
| 11613866 | 11705532 | - | CUFF.14045.3 | seg_243 | 11698650 | 11720400 | M | chrX | 39910507 | 40005885 | - | 39999141 | 40019359 | OTC |
| 11623972 | 11657682 | - | CUFF.14034.6 | seg_10 | 11650000 | 11672900 | S | chrX | 39921386 | 39957214 | - | 39949539 | 39972450 | OTC |
| 11623972 | 11657682 | - | CUFF.14034.6 | seg_239 | 11642000 | 11673350 | M | chrX | 39921386 | 39957214 | - | 39941129 | 39972450 | OTC |
| 11625208 | 11657693 | - | CUFF.14045.8 | seg_10 | 11650000 | 11672900 | S | chrX | 39922665 | 39957225 | - | 39949539 | 39972450 | OTC |
| 11625208 | 11657693 | - | CUFF.14045.8 | seg_239 | 11642000 | 11673350 | M | chrX | 39922665 | 39957225 | - | 39941129 | 39972450 | OTC |
| 12254777 | 12339238 | - | CUFF.14050.2 | seg_13 | 12338750 | 12340000 | S | chrX | 40511131 | 40595078 | - | 40594596 | 40595937 | CSNB1 = NYX |
| 12254777 | 12339238 | - | CUFF.14050.2 | seg_270 | 12338300 | 12340450 | M | chrX | 40511131 | 40595078 | - | 40594157 | 40596414 | CSNB1 = NYX |
| 12256875 | 12339199 | - | ENSMUST00000124053 | seg_13 | 12338750 | 12340000 | S | chrX | 40513127 | 40595044 | - | 40594596 | 40595937 | CSNB1 = NYX |
| 12256875 | 12339199 | - | ENSMUST00000124053 | seg_270 | 12338300 | 12340450 | M | chrX | 40513127 | 40595044 | - | 40594157 | 40596414 | CSNB1 = NYX |
| 12338584 | 12339240 | - | CUFF.14036.7 | seg_13 | 12338750 | 12340000 | S | chrX | 40594441 | 40595080 | - | 40594596 | 40595937 | CSNB1 = NYX |
| 12338584 | 12339240 | - | CUFF.14036.7 | seg_270 | 12338300 | 12340450 | M | chrX | 40594441 | 40595080 | - | 40594157 | 40596414 | CSNB1 = NYX |
| 12339404 | 12398618 | + | ENSMUST00000139163 | seg_13 | 12338750 | 12340000 | S | chrX | 40595245 | 40649934 | + | 40594596 | 40595937 | CSNB1 = NYX |
| 12339404 | 12398618 | + | ENSMUST00000139163 | seg_270 | 12338300 | 12340450 | M | chrX | 40595245 | 40649934 | + | 40594157 | 40596414 | CSNB1 = NYX |
| 12513998 | 12515254 | + | ENSMUST00000121924 | seg_279 | 12512850 | 12514750 | M | other | 0 | 0 | + | 0 | 0 | OA1 = GPR143 |
| 12513998 | 12515254 | + | ENSMUST00000121924 | seg_279 | 12512850 | 12514750 | M | other | 0 | 0 | + | 0 | 0 | OA1 = GPR143 |
| 12648548 | 12650070 | + | CUFF.14051.1 | seg_286 | 12648150 | 12650200 | M | chrX | 40944519 | 40945909 | + | 40944126 | 40946037 | CSNB1 = NYX |
| 12648599 | 12768156 | + | CUFF.14068.1 | seg_286 | 12648150 | 12650200 | M | chrX | 40944564 | 41100156 | + | 40944126 | 40946037 | CSNB1 = NYX |
| 12648599 | 12743898 | + | CUFF.14068.3 | seg_286 | 12648150 | 12650200 | M | chrX | 40944564 | 41089870 | + | 40944126 | 40946037 | CSNB1 = NYX |
| 12648599 | 12738071 | + | CUFF.14068.2 | seg_286 | 12648150 | 12650200 | M | chrX | 40944564 | 41082678 | + | 40944126 | 40946037 | CSNB1 = NYX |
| 12648884 | 12649225 | + | CUFF.14043.1 | seg_286 | 12648150 | 12650200 | M | chrX | 40944807 | 40945143 | + | 40944126 | 40946037 | CSNB1 = NYX |
| 12650018 | 12650277 | + | CUFF.14069.1 | seg_286 | 12648150 | 12650200 | M | chrX | 40945858 | 40946083 | + | 40944126 | 40946037 | CSNB1 = NYX |
| 12655982 | 12656311 | + | CUFF.14071.1 | seg_287 | 12656000 | 12657100 | M | chrX | 40950911 | 40950974 | + | 40950911 | 40951267 | CSNB1 = NYX |
| 13094206 | 13423886 | + | CUFF.14064.11 | seg_312 | 13422100 | 13425750 | M | chrX | 41374187 | 41782933 | - | 41781170 | 41784742 | CSNB1 = NYX |
| 13129411 | 13423893 | + | CUFF.14064.11 | seg_312 | 13422100 | 13425750 | M | chrX | 41416196 | 41782933 | - | 41781170 | 41784742 | CSNB1 = NYX |
| 13131747 | 13423893 | - | CUFF.14054.11 | seg_312 | 13422100 | 13425750 | M | chrX | 41418781 | 41782940 | - | 41781170 | 41784742 | CSNB1 = NYX |
| 13290060 | 13290192 | + | CUFF.14072.1 | seg_307 | 13289250 | 13291300 | M | other | 0 | 0 | + | 41643313 | 41645899 | OA1 = GPR143 |
| 16195694 | 16195958 | + | CUFF.14062.1 | seg_337 | 16195350 | 16197100 | M | chrX | 43514157 | 43514486 | - | 43513806 | 43515723 | NDP |
| 16196824 | 16254723 | + | CUFF.14077.1 | seg_337 | 16195350 | 16197100 | M | chrX | 43515447 | 43595516 | + | 43513806 | 43515723 | NDP |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 17135024 | 17148750 | − | ENSMUST00000127690 | seg_355 | 17147650 | 17149850 | M | chrX | 44383408 | 44401509 | − | 44400354 | 44402597 | NDP |
| 19636666 | 19674647 | + | CUFF.14085.1 | seg_16 | 19636100 | 19638650 | S | chrX | 46433208 | 46457778 | + | 46432903 | 46435184 | UBA1 |
| 19636666 | 19674647 | + | CUFF.14085.1 | seg_374 | 19635850 | 19639100 | M | chrX | 46433208 | 46457778 | + | 46432903 | 46435740 | UBA1 |
| 19636666 | 19638395 | + | CUFF.14085.2 | seg_16 | 19636100 | 19638650 | S | chrX | 46433208 | 46434914 | + | 46432903 | 46435184 | UBA1 |
| 19636666 | 19638395 | + | CUFF.14085.2 | seg_374 | 19635850 | 19639100 | M | chrX | 46433208 | 46434914 | + | 46432903 | 46435740 | UBA1 |
| 19772151 | 19868953 | − | CUFF.14069.5 | seg_379 | 19867400 | 19869550 | M | chrX | 46538672 | 46634914 | − | 46617058 | 46619162 | UBA1 |
| 20002814 | 20003061 | + | CUFF.14072.2 | seg_382 | 20001050 | 20006900 | M | chrX | 46772015 | 46772258 | + | 46770003 | 46775398 | UBA1 |
| 20003237 | 20003672 | + | CUFF.14092.1 | seg_382 | 20001050 | 20006900 | M | chrX | 46772434 | 46772864 | + | 46770003 | 46775398 | UBA1 |
| 20194399 | 20225033 | + | CUFF.14074.1 | seg_17 | 20193650 | 20195500 | S | chrX | 47004091 | 47041189 | + | 47003630 | 47005197 | UBA1 |
| 20194399 | 20225033 | + | CUFF.14074.1 | seg_391 | 20193650 | 20196400 | M | chrX | 47004091 | 47041189 | + | 47003141 | 47006163 | UBA1 |
| 20194629 | 20228027 | + | CUFF.14095.1 | seg_17 | 20193650 | 20195500 | S | chrX | 47004307 | 47046225 | + | 47003630 | 47005197 | UBA1 |
| 20194629 | 20228027 | + | CUFF.14095.1 | seg_391 | 20193650 | 20196400 | M | chrX | 47004307 | 47046225 | + | 47003141 | 47006163 | UBA1 |
| 20194911 | 20226322 | + | ENSMUST00000141128 | seg_17 | 20194000 | 20195500 | S | chrX | 47004623 | 47044506 | + | 47003630 | 47005197 | UBA1 |
| 20194911 | 20226322 | + | ENSMUST00000141128 | seg_391 | 20193650 | 20196400 | M | chrX | 47004623 | 47044506 | + | 47003141 | 47006163 | UBA1 |
| 20194911 | 20226322 | + | ENSMUST00000141128 | seg_17 | 20194000 | 20195500 | S | chrX | 47004623 | 47044506 | + | 47003630 | 47005197 | UBA1 |
| 20194911 | 20226322 | + | ENSMUST00000141128 | seg_391 | 20193650 | 20196400 | M | chrX | 47004623 | 47044506 | + | 47003141 | 47006163 | UBA1 |
| 20281032 | 20294944 | + | CUFF.14075.2 | seg_394 | 20294250 | 20296200 | M | chrX | 47092379 | 47103954 | + | 47103171 | 47106480 | UBA1 |
| 20539240 | 20563863 | + | ENSMUST00000136447 | seg_401 | 20538000 | 20539700 | M | other | 0 | 0 | + | 47517837 | 47518881 | OA1 = GPR143 |
| 20937991 | 20941748 | + | ENSMUST00000127554 | seg_413 | 20937100 | 20940950 | M | other | 0 | 0 | + | 0 | 0 | OA1 = GPR143 |
| 20938066 | 20940148 | + | ENSMUST00000132683 | seg_413 | 20937100 | 20940950 | M | other | 0 | 0 | + | 0 | 0 | OA1 = GPR143 |
| 20938066 | 20940148 | + | ENSMUST00000132683 | seg_413 | 20937100 | 20940950 | M | other | 0 | 0 | + | 0 | 0 | OA1 = GPR143 |
| 33428645 | 33616557 | + | CUFF.14157.1 | seg_461 | 33428350 | 33432700 | M | chrX | 117629607 | 117820108 | + | 117629279 | 117633627 | COL4A5 |
| 33523834 | 33616557 | + | CUFF.14123.1 | seg_461 | 33428350 | 33432700 | M | chrX | 117629622 | 117723351 | + | 117629279 | 117633627 | COL4A5 |
| 33428660 | 33616557 | + | CUFF.14123.2 | seg_461 | 33428350 | 33432700 | M | chrX | 117629622 | 117820108 | + | 117629279 | 117633627 | COL4A5 |
| 33735899 | 33739153 | + | CUFF.14150.2 | seg_470 | 33737800 | 33739750 | M | chrX | 117957705 | 117960935 | + | 117959581 | 117961051 | COL4A5 |
| 33868348 | 33882606 | + | CUFF.14151.3 | seg_19 | 33867300 | 33870050 | S | chrX | 118108524 | 118124402 | + | 118107473 | 118110151 | COL4A5 |
| 33868348 | 33882606 | + | CUFF.14151.3 | seg_478 | 33862700 | 33871850 | M | chrX | 118108524 | 118124402 | + | 118101867 | 118111814 | COL4A5 |
| 33868348 | 33902336 | + | CUFF.14151.5 | seg_19 | 33867300 | 33870050 | S | chrX | 118108524 | 118152100 | + | 118107473 | 118110151 | COL4A5 |
| 33868348 | 33902336 | + | CUFF.14151.5 | seg_478 | 33862700 | 33871850 | M | chrX | 118108524 | 118152100 | + | 118101867 | 118111814 | COL4A5 |
| 33868348 | 33902336 | + | CUFF.14151.4 | seg_19 | 33867300 | 33870050 | S | chrX | 118108524 | 118152100 | + | 118107473 | 118110151 | COL4A5 |
| 33868348 | 33902336 | + | CUFF.14151.4 | seg_478 | 33862700 | 33871850 | M | chrX | 118108524 | 118152100 | + | 118101867 | 118111814 | COL4A5 |
| 34138199 | 34138634 | + | CUFF.14127.1 | seg_490 | 34136250 | 34139900 | M | chrX | 118370243 | 118370677 | + | 118368673 | 118372101 | OCRL |
| 34139837 | 34139989 | + | CUFF.14154.1 | seg_490 | 34136250 | 34139900 | M | chrX | 118372040 | 118372343 | + | 118368673 | 118372101 | OCRL |
| 34148309 | 34185415 | + | CUFF.14129.2 | seg_492 | 34184100 | 34185750 | M | chrX | 118380626 | 118407635 | + | 118406356 | 118407906 | OCRL |
| 34148309 | 34185417 | − | CUFF.14156.1 | seg_492 | 34184100 | 34185750 | M | chrX | 118380626 | 118407637 | − | 118406356 | 118407906 | OCRL |
| 34190337 | 34208188 | − | CUFF.14126.1 | seg_493 | 34207150 | 34209200 | M | chrX | 118415403 | 118422937 | − | 0 | 0 | OCRL |
| 34208212 | 34209008 | + | ENSMUST00000118173 | seg_493 | 34207150 | 34209200 | M | other | 0 | 0 | + | 0 | 0 | OA1 = GPR143 |
| 34208212 | 34209008 | + | ENSMUST00000118173 | seg_493 | 34207150 | 34209200 | M | other | 0 | 0 | + | 0 | 0 | OA1 = GPR143 |
| 34354766 | 34357180 | − | ENSMUST00000170210 | seg_495 | 34353300 | 34354950 | M | chrX | 118627272 | 118628472 | − | 118625327 | 118626697 | OCRL |
| 34354766 | 34357180 | − | ENSMUST00000170210 | seg_495 | 34353300 | 34354950 | M | chrX | 118627272 | 118628472 | − | 118625327 | 118626697 | OCRL |
| 34391130 | 34404168 | − | ENSMUST00000143544 | seg_496 | 34403300 | 34405050 | M | chrX | 118673725 | 118699359 | − | 118693658 | 118699484 | OCRL |
| 34414316 | 34415329 | + | CUFF.14162.1 | seg_497 | 34414150 | 34417000 | M | chrX | 118708489 | 118709503 | + | 118708340 | 118710452 | OCRL |
| 34414316 | 34414834 | + | CUFF.14162.2 | seg_497 | 34414150 | 34417000 | M | chrX | 118708489 | 118708986 | + | 118708340 | 118710452 | OCRL |
| 34414323 | 34414681 | + | CUFF.14131.1 | seg_497 | 34414150 | 34417000 | M | chrX | 118708496 | 118708841 | + | 118708340 | 118710452 | OCRL |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 34427535 | 34443093 | - | CUFF.14163.2 | seg_500 | 34441550 | 34443350 | M | chrX | 118722300 | 118740065 | - | 118738473 | 118740315 | OCRL |
| 34442912 | 34442959 | + | CUFF.14135.1 | seg_500 | 34441550 | 34443350 | M | chrX | 118739875 | 118739921 | - | 118738473 | 118740315 | OCRL |
| 34443059 | 34443464 | + | CUFF.14136.1 | seg_500 | 34441550 | 34443350 | M | chrX | 118740012 | 118740391 | - | 118738473 | 118740315 | OCRL |
| 34443156 | 34443320 | - | CUFF.14161.1 | seg_500 | 34441550 | 34443350 | M | chrX | 118740127 | 118740291 | - | 118738473 | 118740315 | OCRL |
| 34631673 | 34650335 | - | CUFF.14138.2 | seg_515 | 34648750 | 34650650 | M | chrX | 118967985 | 118986994 | - | 118985453 | 118987309 | OCRL |
| 34648901 | 34650347 | - | CUFF.14169.5 | seg_515 | 34648750 | 34650650 | M | chrX | 118985453 | 118987006 | - | 118985453 | 118987309 | OCRL |
| 35180050 | 35183034 | + | CUFF.14184.1 | seg_532 | 35178900 | 35181600 | M | other | 0 | 0 | + | 0 | 0 | OA1 = GPR143 |
| 35180050 | 35183034 | + | CUFF.14184.1 | seg_533 | 35182900 | 35184500 | M | other | 0 | 0 | + | 0 | 0 | OA1 = GPR143 |
| 35533905 | 35534803 | + | ENSMUST00000118349 | seg_21 | 35533400 | 35534750 | M | other | 0 | 0 | + | 0 | 0 | OA1 = GPR143 |
| 35533905 | 35534803 | + | ENSMUST00000118349 | seg_551 | 35533250 | 35535100 | S | other | 0 | 0 | + | 0 | 0 | OA1 = GPR143 |
| 35533905 | 35534803 | + | ENSMUST00000118349 | seg_21 | 35533400 | 35534750 | M | other | 0 | 0 | + | 0 | 0 | OA1 = GPR143 |
| 35533905 | 35534803 | + | ENSMUST00000118349 | seg_551 | 35533250 | 35535100 | S | other | 0 | 0 | + | 0 | 0 | OA1 = GPR143 |
| 35542915 | 35550223 | + | CUFF.14157.1 | seg_552 | 35542250 | 35544050 | M | chrX | 117629607 | 119392253 | + | 119383881 | 119385797 | OCRL |
| 35542935 | 35550223 | + | CUFF.14192.1 | seg_552 | 35542250 | 35544050 | M | chrX | 119384666 | 119392253 | + | 119383881 | 119385797 | OCRL |
| 35600278 | 35604805 | - | CUFF.14159.1 | seg_22 | 35603700 | 35606500 | S | chrX | 119439594 | 119444569 | - | 119443375 | 119446145 | OCRL |
| 35600278 | 35604805 | - | CUFF.14159.1 | seg_556 | 35602250 | 35609250 | M | chrX | 119439594 | 119444569 | - | 119441828 | 119448975 | OCRL |
| 35897792 | 35917936 | - | CUFF.14166.5 | seg_566 | 35896800 | 35898250 | M | chrX | 119672390 | 119695039 | - | 119672194 | 119672859 | OCRL |
| 35961900 | 35966603 | + | ENSMUST00000133128 | seg_569 | 35960900 | 35962650 | M | chrX | 119742855 | 119746241 | + | 119742376 | 119742750 | OCRL |
| 38754031 | 38966276 | + | ENSMUST00000128197 | seg_23 | 38753650 | 38755500 | M | chrX | 122317775 | 122554831 | + | 122317397 | 122319184 | OCRL |
| 38754031 | 38966276 | + | ENSMUST00000128197 | seg_619 | 38753250 | 38755800 | S | chrX | 122317775 | 122554831 | + | 122316995 | 122319507 | OCRL |
| 38754659 | 39031778 | + | CUFF.14209.6 | seg_23 | 38753650 | 38755500 | M | chrX | 122318324 | 122624766 | + | 122317397 | 122319184 | OCRL |
| 38754659 | 39031778 | + | CUFF.14209.6 | seg_619 | 38753250 | 38755800 | S | chrX | 122318324 | 122624766 | + | 122316995 | 122319507 | OCRL |
| 38754659 | 38966731 | + | ENSMUST00000148212 | seg_23 | 38753650 | 38755500 | M | chrX | 122318324 | 122555502 | + | 122317397 | 122319184 | OCRL |
| 38754659 | 38966731 | + | ENSMUST00000148212 | seg_619 | 38753250 | 38755800 | S | chrX | 122318324 | 122555302 | + | 122316995 | 122319507 | OCRL |
| 39155509 | 39265102 | + | CUFF.14211.5 | seg_638 | 39262300 | 39268050 | M | chrX | 122744049 | 122866926 | + | 122863888 | 122867232 | OCRL |
| 39264775 | 39265102 | + | CUFF.14211.10 | seg_638 | 39262300 | 39268050 | M | chrX | 122754023 | 122866926 | + | 122863888 | 122867232 | OCRL |
| 39264775 | 39265789 | - | CUFF.14175.17 | seg_638 | 39262300 | 39268050 | M | chrX | 122866626 | 122866902 | + | 122863888 | 122867232 | OCRL |
| 40177535 | 40782180 | - | ENSMUST00000154433 | seg_25 | 40779750 | 40784250 | M | chrX | 123784986 | 124338187 | - | 124335918 | 124340213 | OCRL |
| 40177535 | 40782180 | - | ENSMUST00000154433 | seg_678 | 40779300 | 40784650 | M | chrX | 123784986 | 124338187 | - | 124335476 | 124340593 | OCRL |
| 40250312 | 40782303 | - | ENSMUST00000126161 | seg_25 | 40779750 | 40784250 | M | chrX | 123836202 | 124338304 | - | 124335918 | 124340213 | OCRL |
| 40250312 | 40782303 | - | ENSMUST00000126161 | seg_678 | 40779300 | 40784650 | M | chrX | 123836202 | 124338304 | - | 124335476 | 124340593 | OCRL |
| 40677132 | 40782180 | - | ENSMUST00000125231 | seg_25 | 40779750 | 40784250 | M | chrX | 124241111 | 124338187 | - | 124335918 | 124340213 | OCRL |
| 40677132 | 40782180 | - | ENSMUST00000125231 | seg_678 | 40779300 | 40784650 | M | chrX | 124241111 | 124338187 | - | 124335476 | 124340593 | OCRL |
| 40677132 | 40782180 | - | ENSMUST00000125231 | seg_25 | 40779750 | 40784250 | M | chrX | 124241111 | 124338187 | - | 124335918 | 124340213 | OCRL |
| 40677132 | 40782180 | - | ENSMUST00000125231 | seg_678 | 40779300 | 40784650 | M | chrX | 124241111 | 124338137 | - | 124335476 | 124340593 | OCRL |
| 45162547 | 45245729 | + | CUFF.14233.3 | seg_768 | 45243800 | 45248200 | M | chrX | 128580480 | 128657501 | + | 128655532 | 128659505 | OCRL |
| 45227508 | 45245609 | + | ENSMUST00000141084 | seg_768 | 45243800 | 45248200 | M | chrX | 128638886 | 128657382 | + | 128655532 | 128659505 | OCRL |
| 45363158 | 45363341 | + | CUFF.14229.1 | seg_774 | 45362150 | 45363400 | M | other | 0 | 0 | + | 0 | 0 | OA1 = GPR143 |
| 45363178 | 45363342 | + | CUFF.14188.1 | seg_774 | 45362150 | 45363400 | M | other | 0 | 0 | + | 0 | 0 | OA1 = GPR143 |
| 45694175 | 45694423 | - | CUFF.14198.1 | seg_28 | 45693200 | 45698600 | S | chrX | 129113942 | 129114135 | - | 129110141 | 129120295 | OCRL |
| 45694175 | 45694423 | - | CUFF.14198.1 | seg_28 | 45693200 | 45698600 | S | chrX | 129113942 | 129114135 | - | 129110141 | 129120295 | OCRL |
| 45694535 | 45755264 | + | CUFF.14240.2 | seg_793 | 45690600 | 45700600 | M | chrX | 129114248 | 129186162 | + | 129110141 | -129118262 | OCRL |
| 45694535 | 45755264 | + | CUFF.14240.2 | seg_793 | 45690600 | 45700600 | M | chrX | 129114248 | 129186162 | + | 129110141 | 129120295 | OCRL |
| 45694535 | 45761226 | + | CUFF.14240.3 | seg_28 | 45693200 | 45698600 | S | chrX | 129114248 | 129192040 | + | 129112931 | -129118262 | OCRL |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 45694535 | 45761226 | + | CUFF.14240.3 | seg_793 | 45690600 | 45700600 | M | chrX | 129114248 | 129119040 | + | 129110141 | 129120295 | OCRL |
| 45695238 | 45746514 | + | CUFF.14240.5 | seg_28 | 45693200 | 45698600 | S | chrX | 129114949 | 129173294 | + | 129112931 | -129118262 | OCRL |
| 45695238 | 45746514 | + | CUFF.14240.5 | seg_793 | 45690600 | 45700600 | M | chrX | 129114949 | 129173294 | + | 129110141 | 129120295 | OCRL |
| 45696947 | 45761226 | + | CUFF.14240.8 | seg_28 | 45693200 | 45698600 | S | chrX | 129116613 | 129192040 | + | 129112931 | 129118262 | OCRL |
| 45696947 | 45761226 | + | CUFF.14240.8 | seg_793 | 45690600 | 45700600 | M | chrX | 129116613 | 129192040 | + | 129110141 | 129120295 | OCRL |
| 45697574 | 45698600 | + | CUFF.14200.5 | seg_28 | 45693200 | 45698600 | S | chrX | 129117248 | 129118262 | - | 129112931 | -129118262 | OCRL |
| 45697574 | 45698600 | + | CUFF.14200.5 | seg_793 | 45690600 | 45700600 | M | chrX | 129117248 | 129118262 | - | 129110141 | 129120295 | OCRL |
| 45764223 | 45810380 | - | CUFF.14235.1 | seg_797 | 45799100 | 45810800 | M | chrX | 129195192 | 129248513 | + | 129237507 | 129249292 | OCRL |
| 45806529 | 45807451 | - | CUFF.14203.1 | seg_29 | 45805150 | 45807500 | S | chrX | 129244056 | 129244891 | - | 129242747 | 129244939 | OCRL |
| 45806529 | 45807451 | - | CUFF.14203.1 | seg_797 | 45799100 | 45810800 | M | chrX | 129244056 | 129244891 | - | 129237507 | 129249292 | OCRL |
| 45976590 | 46015471 | - | CUFF.14243.2 | seg_807 | 45976250 | 45977750 | M | chrX | 129473516 | 129507331 | + | 129473042 | 129474708 | OCRL |
| 45976926 | 46005231 | - | ENSMUST00000153047 | seg_807 | 45976250 | 45977750 | M | chrX | 129473871 | 129498726 | + | 129473042 | 129474708 | OCRL |
| 46838852 | 46848439 | - | ENSMUST00000151128 | seg_836 | 46835350 | 46841700 | M | chrX | 130207473 | 130217728 | + | 130204272 | 130210819 | NYS1 = FRMD7 |
| 46838852 | 46848439 | - | ENSMUST00000151128 | seg_837 | 46844950 | 46849750 | M | chrX | 130207473 | 130217728 | + | 130214253 | 130219020 | NYS1 = FRMD7 |
| 47135713 | 47150926 | - | CUFF.14205.9 | seg_844 | 47150550 | 47152600 | M | chrX | 130407480 | 130423284 | - | 130422906 | 130424949 | NYS1 = FRMD7 |
| 47139524 | 47150928 | - | CUFF.14249.5 | seg_844 | 47150550 | 47152600 | M | chrX | 130411301 | 130423286 | - | 130422906 | 130424949 | NYS1 = FRMD7 |
| 47148122 | 47150912 | - | ENSMUST00000135492 | seg_844 | 47150550 | 47152600 | M | chrX | 130420186 | 130423270 | - | 130422906 | 130424949 | NYS1 = FRMD7 |
| 47726321 | 47727201 | + | ENSMUST00000121522 | seg_869 | 47726600 | 47729450 | M | other | 0 | 0 | 0 | 0 | 0 | OA1 = GPR143 |
| 47727201 | 47727201 | + | ENSMUST00000121522 | seg_869 | 47726600 | 47729450 | M | other | 0 | 0 | 0 | 0 | 0 | OA1 = GPR143 |
| 47908438 | 47988438 | - | ENSMUST00000124842 | seg_877 | 47987350 | 47989500 | M | other | 0 | 0 | 0 | 0 | 0 | OA1 = GPR143 |
| 47930580 | 47930887 | - | CUFF.14345.1 | seg_875 | 47929100 | 47930850 | M | chrX | 130956109 | 130964776 | - | 130875046 | 130875479 | OA1 = GPR143 |
| 47948607 | 47988499 | - | CUFF.14211.3 | seg_877 | 47987350 | 47989500 | M | chrX | 130956109 | 130964775 | - | 0 | 0 | NYS1 = FRMD7 |
| 47968572 | 47988498 | - | ENSMUST00000143999 | seg_877 | 47987350 | 47989500 | M | chrX | 130956109 | 130964776 | - | 0 | 0 | NYS1 = FRMD7 |
| 47983977 | 47988499 | - | CUFF.14211.7 | seg_877 | 47987350 | 47989500 | M | chrX | 130960808 | 130964776 | - | 0 | 0 | NYS1 = FRMD7 |
| 48368108 | 48371354 | - | CUFF.14256.2 | seg_899 | 48367900 | 48369550 | M | chrX | 131348118 | 131351566 | - | 131347929 | 131349656 | NYS1 = FRMD7 |
| 48371324 | 48371616 | - | CUFF.14209.1 | seg_900 | 48371400 | 48373300 | M | chrX | 131351532 | 131351823 | - | 131351609 | 131353535 | NYS1 = FRMD7 |
| 48371476 | 48371850 | + | CUFF.14210.1 | seg_900 | 48371400 | 48373300 | M | chrX | 131351714 | 131352061 | + | 131351609 | 131353535 | NYS1 = FRMD7 |
| 49029960 | 49034525 | - | ENSMUST00000142738 | seg_34 | 49033400 | 49035850 | S | chrX | 132087343 | 132092376 | - | 132091169 | 132093740 | NYS1 = FRMD7 |
| 49029960 | 49034525 | - | ENSMUST00000142738 | seg_935 | 49029050 | 49041550 | M | chrX | 132087343 | 132092376 | - | 132086354 | 132099266 | NYS1 = FRMD7 |
| 49033169 | 49033742 | - | ENSMUST00000142983 | seg_34 | 49033400 | 49035850 | S | chrX | 132090938 | 132091521 | - | 132091169 | 132093740 | NYS1 = FRMD7 |
| 49033169 | 49033742 | - | ENSMUST00000142983 | seg_935 | 49029050 | 49041550 | M | chrX | 132090938 | 132091521 | - | 132086354 | 132099266 | NYS1 = FRMD7 |
| 49033355 | 49034263 | - | ENSMUST00000140145 | seg_34 | 49033400 | 49035850 | S | chrX | 132091124 | 132092112 | - | 132091169 | 132093740 | NYS1 = FRMD7 |
| 49033355 | 49034263 | - | ENSMUST00000140145 | seg_935 | 49029050 | 49041550 | M | chrX | 132091124 | 132092112 | - | 132086354 | 132099266 | NYS1 = FRMD7 |
| 49106697 | 49154410 | - | CUFF.14260.1 | seg_943 | 49154200 | 49156050 | M | chrX | 132159249 | 132231301 | - | 132231109 | 132231426 | NYS1 = FRMD7 |
| 49404740 | 49405157 | - | CUFF.14263.1 | seg_956 | 49404000 | 49405600 | M | chrX | 132435253 | 132435700 | - | 132434518 | 132436079 | NYS1 = FRMD7 |
| 49405289 | 49405837 | - | CUFF.14264.1 | seg_956 | 49404000 | 49405600 | M | chrX | 132435805 | 132436325 | - | 132434518 | 132436079 | NYS1 = FRMD7 |
| 49775584 | 49775692 | - | ENSMUST00000102259 | seg_976 | 49775500 | 49776800 | M | chrX | 132880759 | 132880877 | - | 132880685 | 132881912 | HPRT1 = HPRT |
| 50095234 | 50098237 | - | CUFF.14267.2 | seg_990 | 50096650 | 50098550 | M | chrX | 133303779 | 133307009 | - | 133305238 | 133307374 | HPRT1 = HPRT |
| 50095740 | 50097770 | - | ENSMUST00000133214 | seg_990 | 50096650 | 50098550 | M | chrX | 133304296 | 133306522 | - | 133305238 | 133307374 | HPRT1 = HPRT |
| 50095740 | 50097770 | - | ENSMUST00000138156 | seg_990 | 50096650 | 50098550 | M | chrX | 133304296 | 133306522 | - | 133305238 | 133307374 | HPRT1 = HPRT |
| 50095740 | 50097770 | - | ENSMUST00000143479 | seg_990 | 50096650 | 50098550 | M | chrX | 133304296 | 133306522 | - | 133305238 | 133307374 | HPRT1 = HPRT |
| 50095740 | 50097770 | - | ENSMUST00000138156 | seg_990 | 50096650 | 50098550 | M | chrX | 133304296 | 133306522 | - | 133305238 | 133307374 | HPRT1 = HPRT |
| 50095740 | 50097770 | - | ENSMUST00000143479 | seg_990 | 50096650 | 50098550 | M | chrX | 133304296 | 133306522 | - | 133305238 | 133307374 | HPRT1 = HPRT |
| 50265390 | 50265600 | + | CUFF.14269.1 | seg_1001 | 50264950 | 50267500 | M | chrX | 133507274 | 133507484 | + | 133506826 | 133509357 | HPRT1 = HPRT |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 50265421 | 50310120 | + | CUFF.14222.1 | seg_1001 | 50264950 | 50267500 | M | chrX | 133507305 | 133562820 | + | 133506826 | 133509357 | HPRT1 = HPRT |
| 50341229 | 50374836 | + | CUFF.14271.1 | seg_1003 | 50340900 | 50342400 | M | chrX | 133594153 | 133634696 | + | 133593796 | 133595251 | HPRT1 = HPRT |
| 50341250 | 50341769 | + | CUFF.14224.1 | seg_1003 | 50340900 | 50342400 | M | chrX | 133594174 | 133594686 | + | 133593796 | 133595251 | HPRT1 = HPRT |
| 50407432 | 50407526 | − | ENSMUST00000083484 | seg_1004 | 50407500 | 50413850 | M | chrX | 133680658 | 133680753 | − | 133680727 | 133686885 | HPRT1 = HPRT |
| 50408223 | 50410367 | − | ENSMUST00000155622 | seg_1004 | 50407500 | 50413850 | M | chrX | 133681640 | 133683674 | − | 133680727 | 133686885 | HPRT1 = HPRT |
| 50408223 | 50410367 | − | ENSMUST00000155622 | seg_37 | 50410150 | 50413850 | S | chrX | 133681640 | 133683674 | − | 133683549 | 133686542 | HPRT1 = HPRT |
| 50408947 | 50410413 | − | CUFF.14272.4 | seg_1004 | 50407500 | 50413850 | M | chrX | 133682420 | 133683720 | − | 133680727 | 133686885 | HPRT1 = HPRT |
| 50408947 | 50410413 | − | CUFF.14272.4 | seg_37 | 50410150 | 50413850 | S | chrX | 133682420 | 133683720 | − | 133683549 | 133686542 | HPRT1 = HPRT |
| 50409370 | 50410367 | − | ENSMUST00000151099 | seg_1004 | 50407500 | 50413850 | M | chrX | 133682808 | 133683674 | − | 133680727 | 133686885 | HPRT1 = HPRT |
| 50409370 | 50410367 | − | ENSMUST00000151099 | seg_37 | 50410150 | 50413850 | S | chrX | 133682808 | 133683674 | − | 133683549 | 133686542 | HPRT1 = HPRT |
| 50409370 | 50410367 | − | ENSMUST00000151099 | seg_1004 | 50407500 | 50413850 | M | chrX | 133682808 | 133683674 | − | 133680727 | 133686885 | HPRT1 = HPRT |
| 50409370 | 50410367 | − | ENSMUST00000151099 | seg_37 | 50410150 | 50413850 | S | chrX | 133682808 | 133683674 | − | 133683549 | 133686542 | HPRT1 = HPRT |
| 51076013 | 51076306 | + | ENSMUST00000119948 | seg_1035 | 51076300 | 51080000 | M | other | 0 | 0 | + | 0 | 0 | OA1 = GPR143 |
| 51272614 | 51278177 | − | ENSMUST00000152691 | seg_1038 | 51276550 | 51281350 | M | other | 0 | 0 | − | 0 | 0 | OA1 = GPR143 |
| 51272614 | 51278177 | − | ENSMUST00000152691 | seg_39 | 51277000 | 51280800 | S | other | 0 | 0 | − | 0 | 0 | OA1 = GPR143 |
| 53599576 | 53618851 | + | CUFF.14301.1 | seg_1050 | 53618100 | 53619850 | M | chrX | 134478720 | 134497065 | + | 134496269 | 134497771 | HPRT1 = HPRT |
| 53838689 | 53851246 | − | CUFF.14304.2 | seg_1060 | 53850250 | 53852000 | M | chrX | 135044238 | 135056037 | − | 135055069 | 135057268 | HPRT1 = HPRT |
| 53863012 | 53908257 | + | CUFF.14306.3 | seg_1062 | 53862950 | 53864950 | M | chrX | 135067645 | 135115687 | + | 135067584 | 135069491 | HPRT1 = HPRT |
| 53984857 | 54043843 | + | CUFF.14254.1 | seg_1073 | 53983050 | 53986450 | M | chrX | 135229664 | 135290816 | + | 135226915 | 135231187 | HPRT1 = HPRT |
| 53984936 | 54043843 | + | CUFF.14308.1 | seg_1073 | 53983050 | 53986450 | M | chrX | 135229664 | 135290816 | + | 135226915 | 135231187 | HPRT1 = HPRT |
| 54484662 | 54494066 | − | ENSMUST00000151768 | seg_1092 | 54492950 | 54494750 | M | chrX | 135747707 | 135759091 | − | 135758146 | 135759853 | HPRT1 = HPRT |
| 54644626 | 54644698 | − | ENSMUST00000083176 | seg_1095 | 54644100 | 54645900 | M | chrX | 135961358 | 135961432 | − | 135961062 | 135962620 | HPRT1 = HPRT |
| 54644626 | 54644698 | − | ENSMUST00000083176 | seg_1095 | 54644100 | 54645900 | M | chrX | 135961358 | 135961432 | − | 135961062 | 135962620 | HPRT1 = HPRT |
| 54939724 | 54991732 | + | ENSMUST00000117477 | seg_1113 | 54988950 | 54990200 | M | other | 0 | 0 | + | 0 | 0 | OA1 = GPR143 |
| 55175146 | 55175209 | + | CUFF.14315.1 | seg_1124 | 55168950 | 55177100 | M | chrX | 136512124 | 136512176 | + | 136505920 | 136514806 | F9 |
| 55175146 | 55175209 | + | CUFF.14315.1 | seg_43 | 55169850 | 55176350 | S | chrX | 136512124 | 136512176 | + | 136506771 | 136513469 | F9 |
| 55283804 | 55294913 | − | CUFF.14261.2 | seg_1129 | 55279400 | 55288000 | M | chrX | 136648285 | 136659851 | − | 136643868 | 136652525 | F9 |
| 55283804 | 55294913 | − | CUFF.14261.2 | seg_1130 | 55290400 | 55296750 | M | chrX | 136648285 | 136659851 | − | 136654976 | 136660703 | F9 |
| 55283804 | 55294913 | − | CUFF.14261.2 | seg_45 | 55283050 | 55287350 | S | chrX | 136648285 | 136659851 | − | 136647552 | 136651893 | F9 |
| 55283804 | 55286873 | − | CUFF.14316.3 | seg_1129 | 55279400 | 55288000 | M | chrX | 136648285 | 136651403 | − | 136643868 | 136652525 | F9 |
| 55283804 | 55286873 | − | CUFF.14316.3 | seg_45 | 55283050 | 55287350 | S | chrX | 136648285 | 136651403 | − | 136647552 | 136651893 | F9 |
| 55291586 | 55291918 | − | CUFF.14263.1 | seg_1130 | 55290400 | 55296750 | M | chrX | 136648285 | 132435700 | − | 136654976 | 136660703 | F9 |
| 56316667 | 56386391 | − | ENSMUST00000138503 | seg_1161 | 56386000 | 56388000 | M | chrX | 124352253 | 137714968 | − | 137791961 | 137793923 | HPRT1 = HPRT |
| 56421226 | 56421304 | − | CUFF.14323.1 | seg_1163 | 56418350 | 56421350 | M | chrX | 137714968 | 137792332 | − | 137820604 | 137823585 | F9 |
| 57309131 | 57432445 | − | CUFF.14324.1 | seg_1198 | 57428450 | 57434700 | M | chrX | 137823466 | 138663919 | − | 138771736 | 138771736 | F9 |
| 57377877 | 57431535 | − | CUFF.14324.7 | seg_1198 | 57428450 | 57434700 | M | chrX | 138663919 | 138773758 | − | 138771736 | 138780855 | F9 |
| 57392756 | 57392833 | − | CUFF.14325.1 | seg_1197 | 57391850 | 57393700 | M | other | 0 | 0 | − | 138714942 | 138716185 | OA1 = GPR143 |
| 57488638 | 57657223 | − | CUFF.14329.7 | seg_1205 | 57655000 | 57659550 | M | chrX | 138818955 | 139014388 | − | 139012164 | 139017130 | F9 |
| 57488638 | 57657479 | − | CUFF.14272.6 | seg_1205 | 57655000 | 57659550 | M | chrX | 138818955 | 139014657 | − | 139012164 | 139017130 | F9 |
| 57657230 | 57657464 | + | CUFF.14273.1 | seg_1205 | 57655000 | 57659550 | M | chrX | 139014395 | 139014642 | + | 139012164 | 139017130 | F9 |
| 57657681 | 57657808 | + | CUFF.14274.1 | seg_1205 | 57655000 | 57659550 | M | chrX | 139014914 | 139015030 | + | 139012164 | 139017130 | F9 |
| 57761975 | 57762010 | − | CUFF.14277.1 | seg_1210 | 57761900 | 57763800 | M | other | 0 | 0 | − | 0 | 0 | OA1 = GPR143 |
| 57801194 | 57802024 | + | ENSMUST00000117865 | seg_1212 | 57799400 | 57803350 | M | chrX | 139173902 | 139174723 | + | 139172227 | 139176447 | F9 |
| 57801194 | 57802024 | + | ENSMUST00000117865 | seg_1212 | 57799400 | 57803350 | M | chrX | 139173902 | 139174723 | + | 139172227 | 139176447 | F9 |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 58144545 | 58146615 | − | CUFF.14269.1 | seg_1227 | 58140550 | 58155350 | M | chrX | 133507274 | 133507484 | + | 139580491 | 139597036 | HPRT1 = HPRT |
| 58144545 | 58146615 | − | CUFF.14269.1 | seg_49 | 58143750 | 58152800 | S | chrX | 133507274 | 133507484 | + | 139584340 | 139594145 | HPRT1 = HPRT |
| 58146828 | 58151242 | + | ENSMUST00000145552 | seg_1227 | 58140550 | 58155350 | M | chrX | 139587446 | 139592481 | + | 139580491 | 139597036 | F9 |
| 58146828 | 58151242 | + | ENSMUST00000145552 | seg_49 | 58143750 | 58152800 | S | chrX | 139587446 | 139592481 | + | 139584340 | 139594145 | F9 |
| 65920689 | 65931574 | + | ENSMUST00000101520 | seg_1309 | 65930300 | 65933100 | M | chrX | 146974056 | 146993242 | − | 146992254 | 146994838 | FMR1 |
| 65931716 | 65951510 | + | CUFF.14287.2 | seg_1309 | 65930300 | 65933100 | M | chrX | 146993398 | 147012157 | − | 146992254 | 146994838 | FMR1 |
| 65931716 | 65970681 | + | CUFF.14287.3 | seg_1309 | 65930300 | 65933100 | M | chrX | 146993398 | 147032195 | − | 146992254 | 146994838 | FMR1 |
| 65931716 | 65970681 | + | CUFF.14352.1 | seg_1309 | 65930300 | 65933100 | M | chrX | 146993398 | 147032195 | − | 146992254 | 146994838 | FMR1 |
| 65932068 | 65932563 | + | CUFF.14288.1 | seg_1309 | 65930300 | 65933100 | M | chrX | 146993774 | 146994298 | − | 146992254 | 146994838 | FMR1 |
| 65932227 | 65932774 | + | CUFF.14353.1 | seg_1309 | 65930300 | 65933100 | M | chrX | 146993961 | 146994506 | − | 146992254 | 146994838 | FMR1 |
| 66858632 | 66859423 | − | ENSMUST00000163828 | seg_1334 | 66859150 | 66860650 | M | other | 0 | 0 | + | 0 | 0 | OA1 = GPR143 |
| 66858632 | 66859428 | − | ENSMUST00000163828 | seg_1334 | 66859150 | 66860650 | M | other | 0 | 0 | + | 0 | 0 | OA1 = GPR143 |
| 66355671 | 66859420 | + | ENSMUST00000120762 | seg_1334 | 66859150 | 66860650 | M | other | 0 | 0 | + | 0 | 0 | OA1 = GPR143 |
| 67712928 | 67730355 | − | CUFF.14360.2 | seg_1361 | 67729150 | 67730900 | M | chrX | 148678210 | 148713485 | + | 148712175 | 148714034 | MTM1 |
| 67712928 | 67730355 | − | CUFF.14295.2 | seg_1361 | 67729150 | 67730900 | M | chrX | 148678210 | 148713485 | + | 148712175 | 148714034 | MTM1 |
| 67716098 | 67730317 | + | ENSMUST00000134954 | seg_1361 | 67729150 | 67730900 | M | chrX | 148682045 | 148713449 | + | 148712175 | 148714034 | MTM1 |
| 68291015 | 68303292 | + | CUFF.14296.1 | seg_1381 | 68301500 | 68306350 | M | chrX | 149520032 | 149531563 | + | 149529888 | 149534532 | MTM1 |
| 68291015 | 68303292 | + | CUFF.14296.1 | seg_51 | 68305200 | 68305800 | S | chrX | 149520032 | 149531563 | + | 149530085 | 149534002 | MTM1 |
| 68809081 | 68812693 | + | CUFF.14369.2 | seg_1404 | 68805250 | 68809850 | M | chrX | 150151747 | 150156053 | + | 150146455 | 150152649 | MTM1 |
| 68809092 | 68812471 | + | CUFF.14301.1 | seg_1404 | 68805250 | 68809850 | M | chrX | 134478720 | 134497065 | + | 150146455 | 150152649 | HPRT1 = HPRT |
| 68809408 | 68809659 | + | CUFF.14301.6 | seg_1404 | 68805250 | 68809850 | M | chrX | 150152106 | 150152390 | + | 150146455 | 150152649 | MTM1 |
| 68809643 | 68809983 | + | CUFF.14370.1 | seg_1404 | 68805250 | 68809850 | M | chrX | 150152374 | 150152784 | + | 150146455 | 150152649 | MTM1 |
| 68809715 | 68813851 | + | CUFF.14301.7 | seg_1404 | 68805250 | 68809850 | M | chrX | 150152444 | 150157265 | + | 150146455 | 150157265 | MTM1 |
| 68917141 | 68920567 | + | ENSMUST00000131554 | seg_1411 | 68914050 | 68921750 | M | chrX | 150345344 | 150349110 | + | 150341934 | 150350499 | MTM1 |
| 68917141 | 68920567 | + | ENSMUST00000131554 | seg_53 | 68914500 | 68919750 | S | chrX | 150345344 | 150349110 | + | 150342370 | 150348293 | MTM1 |
| 68917141 | 68920567 | + | ENSMUST00000144712 | seg_1411 | 68914050 | 68921750 | M | chrX | 150345344 | 150349110 | + | 150341934 | 150350499 | MTM1 |
| 68917141 | 68920567 | + | ENSMUST00000144712 | seg_53 | 68914500 | 68919750 | S | chrX | 150345344 | 150349110 | + | 150342370 | 150348293 | MTM1 |
| 69062152 | 69066323 | + | ENSMUST00000138979 | seg_1416 | 69061200 | 69063200 | M | chrX | 150565693 | 150573568 | + | 150564437 | 150567623 | MTM1 |
| 69062152 | 69066323 | + | ENSMUST00000138979 | seg_1416 | 69061200 | 69063200 | M | chrX | 150565698 | 150573568 | + | 150564437 | 150567623 | MTM1 |
| 69514307 | 69520142 | − | ENSMUST00000153740 | seg_1436 | 69517250 | 69520800 | M | chrX | 151137877 | 151143202 | − | 151139787 | 151143870 | MTM1 |
| 69519852 | 69520142 | − | CUFF.14310.4 | seg_1436 | 69517250 | 69520800 | M | chrX | 151142857 | 151143202 | − | 151139787 | 151143870 | MTM1 |
| 70232678 | 70261234 | + | CUFF.14389.3 | seg_1465 | 70232550 | 70233700 | M | chrX | 152066590 | 152132534 | + | 152066464 | 152067633 | ABCD1 |
| 70232678 | 70276882 | + | CUFF.14389.4 | seg_1465 | 70232550 | 70233700 | M | chrX | 152066590 | 152142042 | + | 152066464 | 152067633 | ABCD1 |
| 70232678 | 70276882 | + | CUFF.14389.4 | seg_1469 | 70276250 | 70277250 | M | chrX | 152066590 | 152142042 | + | 152141408 | 152142118 | ABCD1 |
| 70232678 | 70276882 | + | ENSMUST00000144712 | seg_1465 | 70232550 | 70233700 | M | chrX | 152066590 | 152142042 | + | 152066464 | 152067633 | ABCD1 |
| 70232678 | 70276882 | + | ENSMUST00000144712 | seg_1469 | 70276250 | 70277250 | M | chrX | 152066590 | 152142042 | + | 152141408 | 152142118 | ABCD1 |
| 70232678 | 70276882 | + | CUFF.14389.2 | seg_1469 | 70276250 | 70277250 | M | chrX | 152066590 | 152142042 | + | 152141408 | 152142118 | ABCD1 |
| 70659581 | 70659693 | + | CUFF.14395.1 | seg_1486 | 70655550 | 70660200 | M | other | 0 | 0 | + | 0 | 0 | OA1 = GPR143 |
| 70682654 | 70704414 | − | CUFF.14396.3 | seg_1489 | 70702900 | 70704800 | M | chrX | 152731126 | 152736112 | − | 152676030 | 152680458 | ABCD1 |
| 70748725 | 70748751 | − | CUFF.14493.1 | seg_1493 | 70748300 | 70751550 | M | chrX | 152783300 | 152783425 | − | 152731557 | 152736608 | ABCD1 |
| 70884707 | 70887453 | + | CUFF.14399.1 | seg_1504 | 70880250 | 70886600 | M | chrX | 152912601 | 152915465 | − | 152907256 | 152914605 | ABCD1 |
| 70884707 | 70887453 | + | CUFF.14399.1 | seg_56 | 70884700 | 70886100 | S | chrX | 152912601 | 152915465 | − | 152912593 | 152913737 | ABCD1 |
| 70918489 | 70919425 | + | CUFF.14406.3 | seg_1507 | 70919050 | 70921750 | M | chrX | 152953368 | 152954327 | − | 152953952 | 152956569 | ABCD1 |
| 71038698 | 71070106 | + | CUFF.14350.4 | seg_1515 | 71069800 | 71072250 | M | chrX | 153067624 | 153096149 | − | 153095872 | 153098097 | L1CAM |
| 71167461 | 71171740 | − | ENSMUST00000135213 | seg_1524 | 71165700 | 71168200 | M | chrX | 153200721 | 153205716 | − | 153198707 | 153201262 | AVPR2 |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 71188131 | 71212039 | - | CUFF.14346.3 | seg_1526 | 71210350 | 71212250 | M | chrX | 153213005 | 153236998 | - | 153235226 | 153237200 | AVPR2 |
| 71209543 | 71210383 | - | CUFF.14432.1 | seg_1526 | 71210350 | 71212250 | M | chrX | 153234378 | 153235269 | - | 153235226 | 153237200 | AVPR2 |
| 71212129 | 71212322 | - | CUFF.14347.1 | seg_1526 | 71210350 | 71212250 | M | chrX | 153237078 | 153237272 | - | 153235226 | 153237200 | AVPR2 |
| 71252041 | 71252841 | + | ENSMUST00000120692 | seg_1528 | 71251100 | 71253700 | M | other | 0 | 0 | + | 0 | 0 | OA1 = GPR143 |
| 71252041 | 71252841 | + | ENSMUST00000120692 | seg_1528 | 71251100 | 71253700 | M | other | 0 | 0 | + | 0 | 0 | OA1 = GPR143 |
| 71491032 | 71491211 | - | CUFF.14417.1 | seg_1536 | 71489000 | 71492050 | M | chrX | 153598856 | 153599051 | + | 153596991 | 153599880 | EMD |
| 71491144 | 71491278 | - | CUFF.14563.1 | seg_1536 | 71489000 | 71492050 | M | chrX | 153598983 | 153599133 | + | 153596991 | 153599880 | EMD |
| 71500026 | 71500436 | + | CUFF.14439.2 | seg_1537 | 71499550 | 71501250 | M | chrX | 153607566 | 153607980 | + | 153606662 | 153608766 | EMD |
| 71500100 | 71501024 | + | ENSMUST00000129516 | seg_1537 | 71499550 | 71501250 | M | chrX | 153607643 | 153608527 | + | 153606662 | 153608766 | EMD |
| 71527251 | 71528204 | + | ENSMUST00000146260 | seg_1538 | 71525800 | 71528950 | M | chrX | 153637932 | 153640001 | + | 153636852 | 153640773 | EMD |
| 71527251 | 71528254 | + | ENSMUST00000135012 | seg_1538 | 71525800 | 71528950 | M | chrX | 153637932 | 153640082 | + | 153636852 | 153640773 | EMD |
| 71527980 | 71535490 | + | CUFF.14421.3 | seg_1538 | 71525800 | 71528950 | M | chrX | 153639773 | 153650067 | + | 153636852 | 153640773 | EMD |
| 71528089 | 71533374 | + | ENSMUST00000156880 | seg_1538 | 71525800 | 71528950 | M | chrX | 153639886 | 153647898 | + | 153636852 | 153640773 | EMD |
| 71528089 | 71535487 | + | ENSMUST00000124200 | seg_1538 | 71525800 | 71528950 | M | chrX | 153639886 | 153650064 | + | 153636852 | 153640773 | EMD |
| 71528090 | 71535488 | + | ENSMUST00000114182 | seg_1538 | 71525800 | 71528950 | M | chrX | 153639887 | 153650065 | + | 153636852 | 153640773 | EMD |
| 71550319 | 71557201 | + | CUFF.14360.2 | seg_1540 | 71549400 | 71551350 | M | chrX | 148678210 | 148713485 | + | 153664294 | 153666201 | MTM1 |
| 71550319 | 71553622 | + | CUFF.14360.1 | seg_1540 | 71549400 | 71551350 | M | chrX | 148678210 | 153668876 | + | 153664294 | 153666201 | OA1 = GPR143 |
| 71550337 | 71553623 | + | CUFF.14449.2 | seg_1540 | 71549400 | 71551350 | M | chrX | 153665244 | 153668877 | + | 153664294 | 153666201 | EMD |
| 71574384 | 71597045 | + | CUFF.14364.1 | seg_1542 | 71572900 | 71574500 | M | chrX | 153686599 | 153705719 | + | 153686144 | 153686719 | IKBKG |
| 71574384 | 71590028 | + | CUFF.14364.1 | seg_1542 | 71572900 | 71574500 | M | chrX | 153686599 | 153702184 | + | 153686144 | 153686719 | IKBKG |
| 71574404 | 71588866 | + | CUFF.14453.2 | seg_1542 | 71572900 | 71574500 | M | chrX | 153686620 | 153701013 | + | 153686144 | 153686719 | IKBKG |
| 71598672 | 71598963 | - | CUFF.14450.4 | seg_1543 | 71597350 | 71599950 | M | chrX | 153707075 | 153707335 | - | 153706026 | 153707314 | IKBKG |
| 71598672 | 71598963 | - | CUFF.14450.4 | seg_58 | 71597850 | 71599950 | S | chrX | 153707075 | 153707335 | - | 153706412 | 153707323 | IKBKG |
| 71675010 | 71699193 | + | CUFF.14372.14 | seg_1547 | 71673000 | 71675050 | M | chrX | 153773825 | 153799420 | + | 153773591 | 153775852 | G6PD = G6PDX |
| 72388763 | 72388969 | + | ENSMUST00000121894 | seg_1564 | 72385650 | 72389350 | M | other | 0 | 0 | + | 0 | 0 | OA1 = GPR143 |
| 72388763 | 72388969 | + | ENSMUST00000121894 | seg_1564 | 72385650 | 72389350 | M | other | 0 | 0 | + | 0 | 0 | OA1 = GPR143 |
| 72389027 | 72389809 | + | ENSMUST00000116535 | seg_1564 | 72385650 | 72389350 | M | other | 0 | 0 | + | 0 | 0 | OA1 = GPR143 |
| 72389027 | 72389809 | + | ENSMUST00000116535 | seg_1564 | 72385650 | 72389350 | M | other | 0 | 0 | + | 0 | 0 | OA1 = GPR143 |
| 72759615 | 72762429 | + | CUFF.14477.1 | seg_1574 | 72758200 | 72760250 | M | chrX | 154444700 | 154448461 | + | 154444033 | 154445346 | F8 |
| 72759656 | 72767094 | + | ENSMUST00000123419 | seg_1574 | 72758200 | 72760250 | M | chrX | 154444742 | 154456167 | + | 154444033 | 154445346 | F8 |
| 73030993 | 73120555 | - | CUFF.14480.2 | seg_1582 | 73118600 | 73123600 | M | chrX | 114795419 | 114885001 | - | 114793736 | 114797278 | COL4A5 |
| 73120309 | 73120521 | - | CUFF.14390.7 | seg_1582 | 73118600 | 73123600 | M | chrX | 114795453 | 114795667 | - | 114793736 | 114797278 | COL4A5 |
| 75715283 | 75829194 | + | ENSMUST00000126209 | seg_1613 | 75828600 | 75830000 | M | chrX | 37208552 | 37301473 | + | 37207651 | 37209173 | XK |
| 75715283 | 75829194 | + | ENSMUST00000126209 | seg_1613 | 75828600 | 75830000 | M | chrX | 37208552 | 373301473 | + | 37207651 | 37209173 | XK |
| 75726052 | 75829121 | + | ENSMUST00000126994 | seg_1613 | 75725050 | 75728900 | M | chrX | 37285442 | 37293306 | + | 37285442 | 37294050 | XK |
| 75726052 | 75829121 | + | ENSMUST00000126994 | seg_1613 | 75828600 | 75830000 | M | chrX | 37208635 | 37293306 | + | 37207651 | 37209173 | XK |
| 75762644 | 75829230 | + | ENSMUST00000148345 | seg_1613 | 75828600 | 75830000 | M | chrX | 37208533 | 37269301 | + | 37207651 | 37209173 | XK |
| 78316009 | 78316663 | + | CUFF.14419.1 | seg_1627 | 78315700 | 78317600 | M | chrX | 34645190 | 34675419 | - | 34673892 | 34675817 | XK |
| 78316009 | 78343211 | + | CUFF.14508.1 | seg_1627 | 78315700 | 78317600 | M | chrX | 34645190 | 34675419 | - | 34673892 | 34675817 | XK |
| 78316009 | 78343211 | + | CUFF.14508.1 | seg_1628 | 78342250 | 78344000 | M | chrX | 34645190 | 34675419 | - | 34644751 | 34646161 | XK |
| 78316037 | 78340115 | + | ENSMUST00000150052 | seg_1627 | 78315700 | 78317600 | M | chrX | 34648380 | 34675385 | - | 34673892 | 34675817 | XK |
| 82819228 | 82867039 | + | CUFF.14513.1 | seg_1719 | 82818550 | 82821050 | M | chrX | 30845559 | 30907504 | - | 30905718 | 30908242 | DAX1 = NROB1 |
| 82819228 | 82879808 | + | CUFF.14513.2 | seg_1719 | 82818550 | 82821050 | M | chrX | 30845559 | 30907504 | - | 30905718 | 30908242 | DAX1 = NROB1 |
| 82819378 | 82820964 | + | ENSMUST00000152880 | seg_1719 | 82818550 | 82821050 | M | chrX | 30905799 | 30907361 | - | 30905718 | 30908242 | DAX1 = NROB1 |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 82961777 | 82962362 | + | ENSMUST00000121559 | seg_1723 | 82962000 | 82963000 | M | other | 0 | 0 | + | 0 | 0 | OA1 = GPR143 |
| 82961777 | 82962362 | + | ENSMUST00000121559 | seg_1723 | 82962000 | 82963000 | M | other | 0 | 0 | + | 0 | 0 | OA1 = GPR143 |
| 83561422 | 83564035 | + | ENSMUST00000119460 | seg_1743 | 83560850 | 83562500 | M | other | 0 | 0 | + | 0 | 0 | OA1 = GPR143 |
| 83561422 | 83564035 | + | ENSMUST00000119460 | seg_1743 | 83560850 | 83562500 | M | other | 0 | 0 | + | 0 | 0 | OA1 = GPR143 |
| 83591184 | 83591184 | − | ENSMUST00000116183 | seg_1745 | 83591000 | 83592600 | M | chrX | 30260253 | 30261290 | + | 30260067 | 30260445 | DAX1 = NROB1 |
| 83658987 | 83659063 | − | CUFF.14521.1 | seg_1747 | 83657500 | 83660550 | M | other | 0 | 0 | + | 30223407 | 30223935 | OA1 = GPR143 |
| 91077474 | 91077950 | + | CUFF.14448.1 | seg_1867 | 91076600 | 91079100 | M | chrX | 24482937 | 24483410 | − | 24481558 | 24484296 | SAT = SAT1 |
| 91780815 | 91787329 | + | ENSMUST00000153386 | seg_1916 | 91786200 | 91788100 | M | chrX | 51636754 | 51645448 | + | 51635991 | 51637836 | MRX1 = IQSEC2 |
| 91784323 | 91787522 | − | CUFF.14462.8 | seg_1915 | 91782700 | 91784350 | M | chrX | 51636562 | 51639796 | + | 51639769 | 51641672 | MRX1 = IQSEC2 |
| 91784323 | 91787522 | − | CUFF.14462.8 | seg_1916 | 91786200 | 91788100 | M | chrX | 51636562 | 51639796 | + | 51635991 | 51637836 | MRX1 = IQSEC2 |
| 91792302 | 91792908 | − | ENSMUST00000119908 | seg_1917 | 91791500 | 91792700 | M | other | 0 | 0 | + | 0 | 0 | OA1 = GPR143 |
| 91792302 | 91792908 | − | ENSMUST00000119908 | seg_1917 | 91791500 | 91792700 | M | other | 0 | 0 | + | 0 | 0 | OA1 = GPR143 |
| 91881387 | 91888583 | + | CUFF.14550.1 | seg_1921 | 91880500 | 91882850 | M | chrX | 51486509 | 51491404 | + | 51485472 | 51487965 | CLCN5 |
| 91881387 | 91888583 | + | CUFF.14550.1 | seg_65 | 91881050 | 91882300 | S | chrX | 51486509 | 51491404 | + | 51485154 | 51487415 | CLCN5 |
| 91881415 | 91888583 | + | ENSMUST00000137033 | seg_1921 | 91880500 | 91882850 | M | chrX | 51486537 | 51491404 | + | 51485472 | 51487965 | CLCN5 |
| 91881415 | 91888583 | + | ENSMUST00000137033 | seg_65 | 91881050 | 91882300 | S | chrX | 51486537 | 51491404 | + | 51486154 | 51487415 | CLCN5 |
| 91916842 | 91918459 | − | ENSMUST00000119588 | seg_1926 | 91916750 | 91920300 | M | other | 0 | 0 | + | 0 | 0 | OA1 = GPR143 |
| 91916842 | 91918459 | − | ENSMUST00000119588 | seg_1926 | 91916750 | 91920300 | M | other | 0 | 0 | + | 0 | 0 | OA1 = GPR143 |
| 92017958 | 92019373 | − | ENSMUST00000118127 | seg_1931 | 92019100 | 92020400 | M | other | 0 | 0 | + | 0 | 0 | OA1 = GPR143 |
| 92017958 | 92019373 | − | ENSMUST00000118127 | seg_1931 | 92019100 | 92020400 | M | other | 0 | 0 | + | 0 | 0 | OA1 = GPR143 |
| 92020317 | 92021016 | − | ENSMUST00000121899 | seg_1931 | 92019100 | 92020400 | M | other | 0 | 0 | + | 0 | 0 | OA1 = GPR143 |
| 92020317 | 92021016 | − | ENSMUST00000121899 | seg_1931 | 92019100 | 92020400 | M | other | 0 | 0 | + | 0 | 0 | OA1 = GPR143 |
| 92035056 | 92035685 | + | ENSMUST00000117813 | seg_1932 | 92035250 | 92039800 | M | other | 0 | 0 | + | 0 | 0 | OA1 = GPR143 |
| 92035056 | 92035685 | + | ENSMUST00000117813 | seg_1932 | 92035250 | 92039800 | M | other | 0 | 0 | + | 0 | 0 | OA1 = GPR143 |
| 92038442 | 92043576 | + | ENSMUST00000057963 | seg_1932 | 92035250 | 92039800 | M | chrX | 57931970 | 57936908 | + | 0 | 0 | ALAS2 |
| 92907017 | 93120097 | + | ENSMUST00000150123 | seg_1970 | 92906500 | 92907900 | M | other | 0 | 0 | + | 64253522 | 64255559 | OA1 = GPR143 |
| 92907017 | 93120097 | + | ENSMUST00000150123 | seg_1970 | 92905500 | 92907900 | M | other | 0 | 0 | + | 64253522 | 64255559 | OA1 = GPR143 |
| 93291330 | 93363894 | + | CUFF.14565.1 | seg_1985 | 93291150 | 93293200 | M | chrX | 64887470 | 64961795 | + | 64887278 | 64888973 | AR |
| 93291330 | 93363894 | + | CUFF.14565.2 | seg_1985 | 93291150 | 93293200 | M | chrX | 64887470 | 64961795 | + | 64887278 | 64888973 | AR |
| 96132488 | 96144356 | + | CUFF.14576.2 | seg_2066 | 96130800 | 96134100 | M | chrX | 67718666 | 67757125 | + | 67717473 | 67719790 | AR |
| 96132695 | 96144356 | + | CUFF.14576.5 | seg_2066 | 96130800 | 96134100 | M | chrX | 67718666 | 67757125 | + | 67717473 | 67719790 | AR |
| 96133100 | 96140245 | + | ENSMUST00000149082 | seg_2066 | 96130800 | 96134100 | M | chrX | 67718666 | 67751756 | + | 67717473 | 67719790 | AR |
| 96237920 | 96270067 | + | CUFF.14578.2 | seg_2070 | 96236650 | 96240350 | M | chrX | 67913429 | 67945678 | − | 67911949 | 67915944 | ED1 = EDA |
| 96237920 | 96265783 | + | CUFF.14486.3 | seg_2070 | 96236650 | 96240350 | M | chrX | 67913429 | 67942045 | − | 67911949 | 67915944 | ED1 = EDA |
| 96331411 | 96344330 | + | CUFF.14577.2 | seg_2076 | 96329150 | 96335250 | M | chrX | 68048806 | 68061977 | − | 68046540 | 68052833 | ED1 = EDA |
| 96331411 | 96344330 | + | CUFF.14577.1 | seg_2076 | 96329150 | 96335250 | M | chrX | 68048806 | 68061977 | − | 68046540 | 68052833 | ED1 = EDA |
| 96509316 | 96509440 | + | CUFF.14581.1 | seg_2092 | 96508650 | 96510100 | M | chrX | 68233310 | 68233735 | − | 68232377 | 68234110 | ED1 = EDA |
| 96600670 | 96639136 | + | CUFF.14585.1 | seg_2105 | 96638050 | 96640450 | M | chrX | 68316315 | 68357637 | − | 68356517 | 68358498 | ED1 = EDA |
| 96600670 | 96639136 | − | ENSMUST00000156494 | seg_69 | 96638500 | 96639900 | S | chrX | 68316315 | 68357637 | − | 68356970 | 68359344 | ED1 = EDA |
| 96600670 | 96639136 | − | ENSMUST00000156494 | seg_2105 | 96638050 | 96640450 | M | chrX | 68316315 | 68357637 | − | 68356517 | 68358498 | ED1 = EDA |
| 96600670 | 96639136 | − | ENSMUST00000156494 | seg_69 | 96638500 | 96639900 | S | chrX | 68316315 | 68357637 | − | 68356970 | 68359344 | ED1 = EDA |
| 97015446 | 97015868 | + | CUFF.14585.1 | seg_2130 | 97013850 | 97018550 | M | chrX | 68724170 | 68724592 | − | 68722532 | 68727304 | ED1 = EDA |
| 97015934 | 97016205 | + | CUFF.14494.1 | seg_2130 | 97013850 | 97018550 | M | chrX | 68724653 | 68724923 | − | 68722532 | 68727304 | ED1 = EDA |
| 97016120 | 97016273 | + | CUFF.14493.1 | seg_2130 | 97013850 | 97018550 | M | chrX | 68724838 | 68724991 | + | 68722532 | 68727304 | ED1 = EDA |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 97170822 | 97506638 | + | CUFF.14505.2 | seg_2136 | 97168850 | 97172800 | M | chrX | 68835853 | 69179424 | + | 68833901 | 68837825 | ED1 = EDA |
| 97170822 | 97596101 | + | CUFF.14505.1 | seg_2136 | 97168850 | 97172800 | M | chrX | 68835853 | 69259315 | + | 68833901 | 68837825 | ED1 = EDA |
| 97170904 | 97596101 | + | CUFF.14597.1 | seg_2136 | 97168850 | 97172800 | M | chrX | 68835936 | 69259315 | + | 68833901 | 68837825 | ED1 = EDA |
| 97170904 | 97596101 | + | CUFF.14597.1 | seg_71 | 97170850 | 97172350 | S | chrX | 68835936 | 69259315 | + | 68835881 | 68837401 | ED1 = EDA |
| 97925212 | 97927787 | + | ENSMUST00000144912 | seg_2169 | 97927300 | 97928500 | M | chrX | 69642906 | 69645256 | + | 69644718 | 69645993 | GJB1 |
| 97925212 | 97927787 | + | ENSMUST00000144912 | seg_2169 | 97927300 | 97928500 | M | chrX | 69642906 | 69645256 | + | 69644718 | 69645993 | GJB1 |
| 97962972 | 97982921 | − | CUFF.14507.1 | seg_2171 | 97962150 | 97963800 | M | chrX | 69664586 | 69686006 | − | 69663824 | 69665432 | GJB1 |
| 97962972 | 97972554 | − | CUFF.14507.2 | seg_2171 | 97962150 | 97963800 | M | chrX | 69664586 | 69674956 | − | 69663824 | 69665432 | GJB1 |
| 97968278 | 97968379 | − | CUFF.14599.1 | seg_2172 | 97964500 | 97968300 | M | chrX | 69670135 | 69670233 | − | 69968211 | 69670157 | GJB1 |
| 98254344 | 98254631 | − | ENSMUST00000119001 | seg_2185 | 98253850 | 98256950 | M | other | 0 | 0 | + | 0 | 0 | OA1 = GPR143 |
| 98449812 | 98456212 | + | CUFF.14512.1 | seg_2194 | 98449350 | 98457550 | M | chrX | 70316012 | 70323383 | + | 70315553 | 70324518 | GJB1 |
| 98835383 | 98849934 | + | CUFF.14619.1 | seg_2212 | 98834700 | 98836650 | M | chrX | 70752905 | 70766816 | + | 70751717 | 70753489 | GJB1 |
| 98835383 | 98849934 | + | CUFF.14619.1 | seg_74 | 98834700 | 98835950 | S | chrX | 70752905 | 70766816 | + | 70752200 | 70754177 | GJB1 |
| 98835399 | 98849983 | + | CUFF.14523.2 | seg_2212 | 98834700 | 98836650 | M | chrX | 70752921 | 70766864 | + | 70751717 | 70753489 | GJB1 |
| 98835399 | 98849983 | + | CUFF.14523.2 | seg_74 | 98834700 | 98835950 | S | chrX | 70752921 | 70766864 | + | 70752200 | 70754177 | GJB1 |
| 98835952 | 98836294 | + | CUFF.14620.1 | seg_2212 | 98834700 | 98836650 | M | chrX | 70753491 | 70753847 | + | 70751717 | 70754177 | GJB1 |
| 98866564 | 98988647 | − | ENSMUST00000056225 | seg_2222 | 98983950 | 98987350 | M | chrX | 70883692 | 70885694 | − | 70883129 | 70884479 | GJB1 |
| 98986564 | 98988647 | − | ENSMUST00000056225 | seg_2222 | 98985950 | 98987350 | M | chrX | 70883692 | 70885694 | − | 70883129 | 70884479 | GJB1 |
| 99044721 | 99287394 | + | CUFF.14621.1 | seg_2226 | 99040300 | 99051650 | M | chrX | 71130717 | 71373136 | + | 71125932 | 71136845 | GJB1 |
| 99044721 | 99287394 | + | CUFF.14621.1 | seg_2245 | 99286300 | 99288050 | M | chrX | 71130717 | 71373136 | + | 71372238 | 71373440 | GJB1 |
| 99044721 | 99287394 | + | CUFF.14621.1 | seg_77 | 99044000 | 99047000 | S | chrX | 71130717 | 71373136 | + | 71129999 | 71133070 | GJB1 |
| 99044724 | 99144974 | + | ENSMUST00000125115 | seg_2226 | 99040300 | 99051650 | M | chrX | 71130720 | 71230692 | + | 71125932 | 71136845 | GJB1 |
| 99044724 | 99144974 | + | ENSMUST00000125115 | seg_77 | 99044000 | 99047000 | S | chrX | 71130720 | 71230692 | + | 71129999 | 71133070 | GJB1 |
| 99044724 | 99358449 | + | ENSMUST00000133472 | seg_77 | 99044000 | 99047000 | S | chrX | 71130720 | 71230692 | + | 71129999 | 71133070 | GJB1 |
| 99337055 | 99352453 | − | CUFF.14618.1 | seg_2248 | 99352000 | 99354000 | M | chrX | 71423283 | 71458939 | − | 71458371 | 71460230 | GJB1 |
| 99337055 | 99352458 | − | CUFF.14618.2 | seg_2248 | 99352000 | 99354000 | M | chrX | 71423238 | 71458939 | − | 71458371 | 71460230 | GJB1 |
| 99709314 | 99839595 | − | CUFF.14533.2 | seg_2272 | 99838800 | 99841900 | M | chrX | 71798692 | 71934148 | − | 71933638 | 71937216 | GJB1 |
| 99750118 | 99839585 | − | CUFF.14637.7 | seg_2272 | 99838800 | 99841900 | M | chrX | 71838498 | 71934132 | − | 71933638 | 71937216 | GJB1 |
| 100355529 | 100360903 | + | CUFF.14548.1 | seg_2304 | 100359250 | 100361100 | M | other | 0 | 0 | + | 0 | 0 | OA1 = GPR143 |
| 100358233 | 100360766 | − | ENSMUST00000087891 | seg_2304 | 100359250 | 100361100 | M | other | 0 | 0 | + | 0 | 0 | OA1 = GPR143 |
| 100358233 | 100360766 | − | ENSMUST00000087891 | seg_2304 | 100359250 | 100361100 | M | other | 0 | 0 | + | 0 | 0 | OA1 = GPR143 |
| 100358449 | 100360746 | − | ENSMUST00000125115 | seg_2304 | 100359250 | 100361100 | M | other | 0 | 0 | + | 0 | 0 | OA1 = GPR143 |
| 100618468 | 100618584 | + | CUFF.14618.1 | seg_2317 | 100617500 | 100619350 | M | other | 0 | 0 | + | 0 | 0 | OA1 = GPR143 |
| 100724822 | 100725046 | − | ENSMUST00000117673 | seg_2323 | 100724000 | 100725850 | M | other | 0 | 0 | + | 0 | 0 | OA1 = GPR143 |
| 100891328 | 100891351 | + | CUFF.14559.1 | seg_2326 | 100885800 | 100893650 | M | chrX | 73755234 | 73755237 | − | 73752844 | 73758155 | ABCB7 |
| 101162901 | 101176626 | − | CUFF.14563.3 | seg_2349 | 101177750 | 101177750 | M | chrX | 73816770 | 73834464 | − | 73822504 | 73835755 | ABCB7 |
| 101162901 | 101176626 | − | CUFF.14563.3 | seg_86 | 101175150 | 101176300 | S | chrX | 73816770 | 73834464 | − | 73832957 | 73834636 | ABCB7 |
| 101272773 | 101396532 | + | CUFF.14564.2 | seg_2362 | 101392900 | 101398450 | M | chrX | 73953408 | 74145290 | + | 74141968 | 74147202 | ABCB7 |
| 101272773 | 101396549 | + | CUFF.14668.2 | seg_2362 | 101392900 | 101398450 | M | chrX | 73953408 | 74145305 | + | 74141968 | 74147202 | ABCB7 |
| 101396608 | 101396824 | − | CUFF.14673.1 | seg_2362 | 101392900 | 101398450 | M | chrX | 74145376 | 74145592 | − | 74141968 | 74147202 | ABCB7 |
| 101531844 | 101543844 | − | CUFF.14676.1 | seg_2367 | 101528100 | 101532450 | M | other | 0 | 0 | + | 0 | 0 | OA1 = GPR143 |
| 101531844 | 101543844 | − | CUFF.14676.1 | seg_2368 | 101541300 | 101544300 | M | other | 0 | 0 | + | 0 | 0 | OA1 = GPR143 |
| 101543168 | 101543573 | − | ENSMUST00000120233 | seg_2368 | 101541300 | 101544300 | M | other | 0 | 0 | + | 0 | 0 | OA1 = GPR143 |
| 101941821 | 101942111 | − | ENSMUST00000122247 | seg_2393 | 101941250 | 101943000 | M | other | 0 | 0 | + | 0 | 0 | OA1 = GPR143 |
| 101941821 | 101942111 | + | ENSMUST00000122247 | seg_2393 | 101941250 | 101943000 | M | other | 0 | 0 | + | 0 | 0 | OA1 = GPR143 |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 102143124 | 102143621 | + | ENSMUST00000122012 | seg_2402 | 102141200 | 102143500 | M | other | 0 | 0 | + | 0 | 0 | OA1 = GPR143 |
| 102143124 | 102143621 | + | ENSMUST00000122012 | seg_2402 | 102141200 | 102143500 | M | other | 0 | 0 | + | 0 | 0 | OA1 = GPR143 |
| 102227925 | 102228705 | + | ENSMUST00000119287 | seg_2410 | 102228100 | 102229200 | M | other | 0 | 0 | + | 0 | 0 | OA1 = GPR143 |
| 102227925 | 102228705 | + | ENSMUST00000119287 | seg_2410 | 102228100 | 102229200 | M | other | 0 | 0 | + | 0 | 0 | OA1 = GPR143 |
| 102920467 | 102920853 | − | ENSMUST00000071515 | seg_2434 | 102920350 | 102921650 | M | other | 0 | 0 | + | 0 | 0 | OA1 = GPR143 |
| 102920467 | 102920853 | − | ENSMUST00000071515 | seg_2434 | 102920350 | 102921650 | M | other | 0 | 0 | + | 0 | 0 | OA1 = GPR143 |
| 103106842 | 103124685 | + | ENSMUST00000126345 | seg_2443 | 103106750 | 103108550 | M | chrX | 76995795 | 77041698 | − | 76995713 | 77031704 | ATRX |
| 103555795 | 103579410 | − | ENSMUST00000122015 | seg_2457 | 103554800 | 103556200 | M | chrX | 77422903 | 77428610 | + | 0 | 0 | PGK1 |
| 103828136 | 103828642 | + | ENSMUST00000117308 | seg_2469 | 103326550 | 103828400 | M | other | 0 | 0 | + | 0 | 0 | OA1 = GPR143 |
| 106030003 | 106034841 | + | ENSMUST00000145250 | seg_2523 | 106034050 | 106035400 | M | chrX | 80065639 | 80068874 | + | 0 | 0 | PGK1 |
| 106030003 | 106034841 | + | ENSMUST00000145250 | seg_2523 | 106034050 | 106035400 | M | chrX | 80065639 | 80068874 | + | 0 | 0 | PGK1 |
| 106196824 | 106197635 | + | ENSMUST00000120648 | seg_2527 | 106195700 | 106197350 | M | other | 0 | 0 | − | 0 | 0 | OA1 = GPR143 |
| 106196824 | 106197635 | + | ENSMUST00000120648 | seg_2527 | 106195700 | 106197350 | M | other | 0 | 0 | − | 0 | 0 | OA1 = GPR143 |
| 109008832 | 109008863 | − | CUFF.14605.1 | seg_2583 | 109005500 | 109010500 | M | other | 0 | 0 | + | 0 | 0 | OA1 = GPR143 |
| 109714135 | 109739682 | + | ENSMUST00000151972 | seg_2608 | 109707900 | 109717600 | M | chrX | 84498794 | 84521473 | − | 84495478 | 84502272 | CHM |
| 109935831 | 109936305 | − | ENSMUST00000117144 | seg_2615 | 109934350 | 109936000 | M | other | 0 | 0 | + | 0 | 0 | OA1 = GPR143 |
| 110411861 | 110869443 | + | ENSMUST00000146539 | seg_2622 | 110410900 | 110414150 | M | chrX | 85403464 | 85999861 | + | 85402511 | 85405628 | CHM |
| 123984075 | 123984154 | + | CUFF.14747.1 | seg_2699 | 123983400 | 123985350 | M | other | 0 | 0 | + | 0 | 0 | OA1 = GPR143 |
| 126284278 | 126577066 | + | CUFF.14645.2 | seg_2714 | 126283350 | 126285600 | M | chrX | 95939805 | 96319018 | + | 95938881 | 95941157 | BTK |
| 126284278 | 126577066 | + | CUFF.14645.2 | seg_95 | 126283950 | 126284950 | S | chrX | 95939805 | 96319018 | + | 95939522 | 95940514 | BTK |
| 126284278 | 126284832 | + | CUFF.14757.2 | seg_2714 | 126283350 | 126285600 | M | chrX | 95939805 | 95940396 | + | 95938881 | 95941157 | BTK |
| 126284278 | 126284832 | + | CUFF.14757.2 | seg_95 | 126283950 | 126284950 | S | chrX | 95939805 | 95940396 | + | 95939522 | 95940514 | BTK |
| 126284360 | 126863066 | + | ENSMUST00000155333 | seg_2714 | 126283350 | 126285600 | M | chrX | 95939886 | 96685244 | + | 95938881 | 95941157 | BTK |
| 126284360 | 126863066 | + | ENSMUST00000155333 | seg_95 | 126283950 | 126284950 | S | chrX | 95939886 | 96685244 | + | 95939522 | 95940514 | BTK |
| 130117402 | 130223532 | + | CUFF.14649.2 | seg_2793 | 130215450 | 130229700 | M | chrX | 99546628 | 99665277 | − | 99657327 | 99671435 | BTK |
| 130117402 | 130223532 | + | CUFF.14649.2 | seg_96 | 130218250 | 130227050 | S | chrX | 99546628 | 99665277 | − | 99660156 | 99668596 | BTK |
| 130155559 | 130223532 | − | CUFF.14760.5 | seg_2793 | 130215450 | 130229700 | M | chrX | 99657457 | 99665277 | − | 99657457 | 99671435 | BTK |
| 130155559 | 130223532 | − | CUFF.14760.5 | seg_96 | 130218250 | 130227050 | S | chrX | 99657457 | 99665277 | − | 99660156 | 99668596 | BTK |
| 130470924 | 130516351 | + | CUFF.14761.3 | seg_2806 | 130514450 | 130517050 | M | chrX | 99929475 | 99987138 | + | 99985303 | 99987553 | BTK |
| 130470924 | 130516351 | + | CUFF.14761.3 | seg_97 | 130515100 | 130516400 | S | chrX | 99929475 | 99987138 | + | 99985954 | 99987187 | BTK |
| 131004413 | 131009527 | + | ENSMUST00000170828 | seg_2826 | 131008100 | 131010000 | M | chrX | 100536586 | 100543536 | + | 100543536 | 100546418 | BTK |
| 131120171 | 131122601 | − | ENSMUST00000117957 | seg_2832 | 131119150 | 131121200 | M | chrX | 100643947 | 100646314 | + | 100644952 | 100646916 | BTK |
| 131120229 | 131122601 | − | ENSMUST00000117957 | seg_2832 | 131119150 | 131121200 | M | chrX | 100646005 | 100646543 | + | 100644952 | 100646916 | BTK |
| 131216059 | 131216416 | + | ENSMUST00000117957 | seg_2837 | 131214300 | 131216200 | M | chrX | 100646005 | 100650827 | + | 0 | 0 | BTK |
| 131216059 | 131216416 | + | ENSMUST00000117957 | seg_2837 | 131214300 | 131216200 | M | other | 0 | 0 | + | 0 | 0 | OA1 = GPR143 |
| 131223346 | 131231296 | + | CUFF.14776.1 | seg_2838 | 131220750 | 131223850 | M | chrX | 100742982 | 100750790 | + | 100740062 | 100743543 | GLA |
| 131282994 | 131285982 | − | CUFF.14778.2 | seg_2844 | 131283700 | 131286250 | M | chrX | 100870107 | 100872989 | + | 100870694 | 100873309 | GLA |
| 131291106 | 131295994 | + | CUFF.14779.1 | seg_2845 | 131290750 | 131295500 | M | chrX | 100878100 | 100882831 | + | 100877742 | 100882345 | GLA |
| 132277243 | 132332177 | + | CUFF.14679.2 | seg_2894 | 132276800 | 132278550 | M | chrX | 101854484 | 101907684 | + | 101853975 | 101855890 | GLA |
| 132277243 | 132336941 | + | CUFF.14679.1 | seg_2894 | 132276800 | 132278550 | M | chrX | 101854484 | 101912334 | + | 101853975 | 101855890 | GLA |
| 132330954 | 132331138 | + | CUFF.14680.1 | seg_2897 | 132330100 | 132331650 | M | chrX | 101906632 | 101906814 | + | 101905772 | 101907266 | GLA |
| 132331073 | 132331146 | + | CUFF.14836.1 | seg_2897 | 132330100 | 132331650 | M | chrX | 101906746 | 101906822 | + | 101905772 | 101907266 | GLA |
| 132673507 | 132674982 | + | CUFF.14803.1 | seg_2913 | 132672500 | 132674100 | M | chrX | 102469998 | 102471683 | + | 102469706 | 102470657 | GLA |
| 133243165 | 133246017 | + | CUFF.14802.2 | seg_2936 | 133242550 | 133244400 | M | chrX | 102884653 | 102887080 | + | 102883877 | 102885870 | GLA |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 133535557 | 133572844 | - | CUFF.14810.7 | seg_2948 | 133571250 | 133573150 | M | chrX | 103373884 | 103402391 | - | 0 | 103402391 | TBG = SERPINA7 |
| 133535594 | 133572841 | - | ENSMUST00000145842 | seg_2948 | 133571250 | 133573150 | M | chrX | 103373384 | 0 | - | 0 | 0 | OA1 = GPR143 |
| 133549811 | 133572838 | - | ENSMUST00000148253 | seg_2948 | 133571250 | 133573150 | M | chrX | 103381078 | 103402391 | - | 0 | 0 | TBG = SERPINA7 |
| 133566334 | 133572841 | + | ENSMUST00000132171 | seg_2948 | 133571250 | 133573150 | S | other | 0 | 0 | + | 0 | 0 | OA1 = GPR143 |
| 133634055 | 133634641 | + | ENSMUST00000119317 | seg_101 | 133633550 | 133635650 | M | other | 0 | 0 | + | 0 | 0 | OA1 = GPR143 |
| 133634055 | 133634641 | + | ENSMUST00000119317 | seg_101 | 133633550 | 133635650 | S | other | 0 | 0 | + | 0 | 0 | OA1 = GPR143 |
| 133634055 | 133634641 | + | ENSMUST00000119317 | seg_2950 | 133632500 | 133641950 | M | other | 0 | 0 | + | 0 | 0 | OA1 = GPR143 |
| 133638428 | 133639261 | + | ENSMUST00000119238 | seg_102 | 133638950 | 133640150 | S | other | 0 | 0 | + | 48779300 | 48780883 | OA1 = GPR143 |
| 133638428 | 133639261 | + | ENSMUST00000119238 | seg_102 | 133638950 | 133640150 | M | other | 0 | 0 | + | 0 | 0 | OA1 = GPR143 |
| 133638428 | 133639261 | + | ENSMUST00000119238 | seg_2950 | 133632500 | 133641950 | S | other | 0 | 0 | + | 48779300 | 48780883 | OA1 = GPR143 |
| 133638428 | 133639261 | + | ENSMUST00000119238 | seg_2950 | 133632500 | 133641950 | M | other | 0 | 0 | + | 0 | 0 | OA1 = GPR143 |
| 133641785 | 133642659 | + | ENSMUST00000118914 | seg_2950 | 133632500 | 133641950 | M | other | 0 | 0 | + | 0 | 0 | OA1 = GPR143 |
| 133641785 | 133642659 | + | ENSMUST00000118914 | seg_2950 | 133632500 | 133641950 | M | chrX | 0 | 0 | + | 0 | 0 | OA1 = GPR143 |
| 133645879 | 133647421 | + | ENSMUST00000118843 | seg_2951 | 133646250 | 133647850 | M | other | 0 | 0 | + | 0 | 0 | OA1 = GPR143 |
| 133645879 | 133647421 | + | ENSMUST00000118843 | seg_2951 | 133646250 | 133647850 | M | chrX | 0 | 0 | + | 0 | 0 | OA1 = GPR143 |
| 133662649 | 133664374 | + | ENSMUST00000118561 | seg_2953 | 133661400 | 133663150 | M | other | 0 | 0 | + | 0 | 0 | OA1 = GPR143 |
| 133810152 | 133810286 | - | CUFF.14819.1 | seg_2959 | 133809900 | 133811050 | M | other | 0 | 0 | + | 0 | 0 | OA1 = GPR143 |
| 134105558 | 135040850 | + | ENSMUST00000130879 | seg_104 | 134103900 | 134107150 | S | chrX | 103811122 | 104731475 | + | 103809534 | 103812755 | TBG = SERPINA7 |
| 134105558 | 135040850 | + | ENSMUST00000130879 | seg_104 | 134103900 | 134107150 | M | chrX | 103811122 | 104731475 | + | 103808956 | 103813140 | TBG = SERPINA7 |
| 134105558 | 135040850 | + | ENSMUST00000130879 | seg_2967 | 134103350 | 134107500 | S | chrX | 103811122 | 104731475 | + | 103809534 | 103812755 | TBG = SERPINA7 |
| 134105558 | 135040850 | + | ENSMUST00000130879 | seg_2967 | 134103350 | 134107500 | M | chrX | 103811122 | 104731475 | + | 103808956 | 103813140 | TBG = SERPINA7 |
| 134966460 | 134966551 | - | CUFF.14828.1 | seg_2993 | 134966500 | 134967950 | M | other | 0 | 0 | + | 104662179 | 104663764 | OA1 = GPR143 |
| 135448948 | 155545071 | + | CUFF.14822.1 | seg_3007 | 155446400 | 155451500 | M | chrX | 105066516 | 105202602 | + | 105063912 | 105069173 | TBG = SERPINA7 |
| 135448948 | 155524317 | + | CUFF.14822.2 | seg_3007 | 155446400 | 155451500 | M | chrX | 105066516 | 105178759 | + | 105063912 | 105069173 | TBG = SERPINA7 |
| 135448953 | 155545071 | + | CUFF.14710.1 | seg_3007 | 155446400 | 155451500 | M | chrX | 105066521 | 105202502 | + | 105063912 | 105069173 | TBG = SERPINA7 |
| 135882030 | 135892277 | - | ENSMUST00000126591 | seg_3021 | 135891400 | 135893050 | M | chrX | 105625325 | 105639361 | - | 105638898 | 105639361 | TBG = SERPINA7 |
| 135882030 | 135892277 | - | ENSMUST00000126591 | seg_3021 | 135891400 | 135893050 | M | chrX | 105625325 | 105639361 | + | 105638898 | 105639361 | TBG = SERPINA7 |
| 135893007 | 135893796 | + | ENSMUST00000122380 | seg_3021 | 135891400 | 135893050 | M | other | 0 | 0 | + | 105638898 | 105639361 | OA1 = GPR143 |
| 136144963 | 136145837 | + | ENSMUST00000113029 | seg_3030 | 136144350 | 136147100 | S | chrX | 105970772 | 105970636 | + | 105969146 | 105971877 | TBG = SERPINA7 |
| 136145906 | 136206280 | + | ENSMUST00000113029 | seg_3030 | 136144350 | 136147100 | M | chrX | 105970704 | 106003816 | + | 105969146 | 105971877 | TBG = SERPINA7 |
| 136219520 | 136287944 | - | CUFF.14832.1 | seg_3034 | 136218150 | 136224400 | M | chrX | 106045891 | 106118691 | - | 106044392 | 106050619 | TBG = SERPINA7 |
| 136224009 | 136224144 | + | CUFF.14834.1 | seg_3034 | 136218150 | 136224400 | M | other | 0 | 0 | + | 106044392 | 106050619 | OA1 = GPR143 |
| 136541344 | 136597251 | - | CUFF.14340.2 | seg_107 | 136594950 | 136598150 | S | chrX | 106366669 | 106449677 | - | 48661090 | 43663232 | PRPS1 |
| 136541344 | 136597251 | - | CUFF.14840.2 | seg_3049 | 136592300 | 136602000 | M | chrX | 106366669 | 106449677 | - | 106445400 | 106454986 | PRPS1 |
| 136991152 | 136999981 | + | ENSMUST00000155235 | seg_3081 | 136989950 | 136993450 | M | chrX | 106871733 | 106882715 | + | 106870757 | 106873713 | PRPS1 |
| 136991152 | 136999981 | + | ENSMUST00000155235 | seg_3081 | 136989950 | 136993450 | M | chrX | 106871733 | 106882715 | + | 106870757 | 106873713 | PRPS1 |
| 137074067 | 137077207 | + | ENSMUST00000112995 | seg_3088 | 137074650 | 137078000 | M | chrX | 106956451 | 106959745 | + | 106956989 | 106960573 | PRPS1 |
| 137074067 | 137133980 | - | CUFF.14847.2 | seg_109 | 137131450 | 137137100 | S | chrX | 106956451 | 107019412 | - | 107017134 | 107022121 | PRPS1 |
| 137074067 | 137133980 | - | CUFF.14847.2 | seg_3092 | 137131200 | 137137750 | M | chrX | 106956451 | 107019412 | - | 107016847 | 107022121 | PRPS1 |
| 137077642 | 137083068 | + | ENSMUST00000152048 | seg_3088 | 137074650 | 137078000 | M | chrX | 106960212 | 106965429 | + | 106956989 | 106960573 | PRPS1 |
| 137199310 | 137330254 | + | CUFF.14734.2 | seg_3098 | 137198450 | 137202100 | M | chrX | 107069159 | 107174866 | + | 107068335 | 107072988 | PRPS1 |
| 137199472 | 137330254 | + | CUFF.14852.2 | seg_3098 | 137198450 | 137202100 | M | chrX | 107069322 | 107174866 | + | 107068335 | 107072988 | PRPS1 |
| 137356477 | 137357062 | - | ENSMUST00000116438 | seg_3111 | 137353950 | 137357900 | M | other | 0 | 0 | + | 0 | 0 | OA1 = GPR143 |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 137356477 | 137357062 | − | ENSMUST00000116438 | seg_3111 | 137353950 | 137357900 | M | other | 0 | 0 | | 0 | 0 | OA1 = GPR143 |
| 137599946 | 137764377 | − | CUFF.14856.2 | seg_3124 | 137598500 | 137600100 | M | chrX | 107398844 | 107554980 | + | 107397620 | 107399000 | COL4A5 |
| 137599946 | 137642145 | − | CUFF.14856.4 | seg_3124 | 137598500 | 137600100 | M | chrX | 107398844 | 107438474 | − | 107397620 | 107399000 | COL4A5 |
| 137599946 | 137908628 | − | CUFF.14856.3 | seg_3124 | 137598500 | 137600100 | M | chrX | 107398844 | 107681685 | − | 107397620 | 107399000 | COL4A5 |
| 137909928 | 138123778 | + | CUFF.14860.3 | seg_3145 | 137909200 | 137911500 | M | chrX | 107683031 | 107940825 | + | 107682283 | 107684615 | COL4A5 |
| 137909928 | 138123778 | + | CUFF.14860.2 | seg_3145 | 137909200 | 137911500 | M | chrX | 107683031 | 107940825 | + | 107682283 | 107684615 | COL4A5 |
| 137909928 | 138123778 | + | CUFF.14737.2 | seg_3145 | 137909200 | 137911500 | M | chrX | 107683031 | 107940825 | + | 107682283 | 107684615 | COL4A5 |
| 137909928 | 138123778 | + | CUFF.14860.6 | seg_3145 | 137909200 | 137911500 | M | chrX | 107683031 | 107940825 | + | 107682283 | 107684615 | COL4A5 |
| 137910111 | 138063011 | + | ENSMUST00000118845 | seg_3145 | 138061650 | 138063400 | M | other | 0 | 0 | | 0 | 0 | OA1 = GPR143 |
| 138062502 | 138304675 | + | ENSMUST00000074490 | seg_3158 | 138304550 | 138305700 | M | other | 0 | 0 | | 0 | 0 | OA1 = GPR143 |
| 138304947 | 138733073 | + | ENSMUST00000117081 | seg_3177 | 138732100 | 138734000 | M | other | 0 | 0 | | 0 | 0 | OA1 = GPR143 |
| 138732108 | 138733073 | + | ENSMUST00000117081 | seg_3195 | 138732100 | 138734000 | M | other | 0 | 0 | | 0 | 0 | OA1 = GPR143 |
| 138732108 | 138821158 | + | CUFF.14867.1 | seg_3195 | 138820350 | 138822000 | M | chrX | 108973213 | 108973350 | − | 108972909 | 108973901 | COL4A5 |
| 138820850 | 139057445 | − | ENSMUST00000118547 | seg_3202 | 139057050 | 139058750 | M | other | 0 | 0 | | 0 | 0 | OA1 = GPR143 |
| 139057035 | 139057445 | − | ENSMUST00000118547 | seg_3217 | 139057050 | 139058750 | M | other | 0 | 0 | | 0 | 0 | OA1 = GPR143 |
| 139057035 | 139068558 | − | CUFF.14862.1 | seg_3217 | 139065800 | 139069750 | M | other | 0 | 0 | | 0 | 0 | OA1 = GPR143 |
| 139065646 | 139068558 | − | ENSMUST00000155951 | seg_3219 | 139065800 | 139069750 | M | other | 0 | 0 | | 0 | 0 | OA1 = GPR143 |
| 139066026 | 139401362 | − | CUFF.14750.2 | seg_3219 | 139399350 | 139403250 | M | chrX | 109437413 | 109561405 | − | 109559439 | 109563236 | COL4A5 |
| 139285689 | 139401386 | − | CUFF.14865.1 | seg_3235 | 139399350 | 139403250 | M | chrX | 109437413 | 109561427 | − | 109559439 | 109563236 | COL4A5 |
| 139285689 | 139830157 | − | CUFF.14869.1 | seg_3254 | 139827450 | 139830300 | M | chrX | 110040716 | 110040731 | − | 110038100 | 110040925 | COL4A5 |
| 139830092 | 140232335 | + | CUFF.14876.1 | seg_3262 | 139952800 | 139955200 | M | chrX | 110187602 | 110470586 | + | 110187318 | 110189585 | COL4A5 |
| 139955067 | 140100407 | − | CUFF.14876.6 | seg_3267 | 140099200 | 140101150 | M | chrX | 110339366 | 110340933 | + | 110339683 | 110341701 | COL4A5 |
| 140098882 | 141122546 | − | ENSMUST00000148240 | seg_117 | 141121300 | 141125200 | M | chrX | 111039581 | 111325310 | − | 111324058 | 111328035 | COL4A5 |
| 140853218 | 141122546 | − | ENSMUST00000148240 | seg_3309 | 141119500 | 141127700 | M | chrX | 111089581 | 111325310 | + | 111322217 | 111330457 | COL4A5 |
| 140989754 | 140990880 | − | ENSMUST00000117991 | seg_3304 | 140990450 | 140992200 | M | chrX | 35820375 | 35821357 | + | 0 | 0 | XK |
| 141880968 | 141939813 | − | CUFF.14766.4 | seg_3343 | 141938500 | 141942750 | M | chrX | 112018106 | 112084182 | − | 112083066 | 112087861 | COL4A5 |
| 143904918 | 143988678 | − | CUFF.14892.1 | seg_3386 | 143988000 | 143989850 | M | chrX | 114345174 | 114468689 | + | 114468015 | 114469855 | COL4A5 |
| 143919223 | 143988699 | − | CUFF.14773.9 | seg_3386 | 143988000 | 143989850 | M | chrX | 114361317 | 114468712 | + | 114468015 | 114469855 | COL4A5 |
| 143943353 | 143988678 | − | CUFF.14892.10 | seg_3386 | 143988000 | 143989850 | M | chrX | 114400113 | 114468689 | + | 114468015 | 114469855 | COL4A5 |
| 147079847 | 147091979 | + | CUFF.14799.4 | seg_3402 | 147079250 | 147080800 | M | chrX | 54947223 | 54957868 | + | 54957123 | 54958355 | ALAS2 |
| 147242402 | 147242529 | − | ENSMUST00000116932 | seg_3412 | 147242050 | 147243450 | M | chrX | 54840803 | 54840922 | + | 54839796 | 54841282 | ALAS2 |
| 147359163 | 147360702 | − | ENSMUST00000117716 | seg_3417 | 147358550 | 147360350 | M | other | 0 | 0 | | 0 | 0 | OA1 = GPR143 |
| 147417684 | 147442281 | − | CUFF.14800.3 | seg_3419 | 147442200 | 147443900 | M | chrX | 54561410 | 54591707 | + | 54560615 | 54561460 | FGD1 |
| 147481431 | 147502847 | + | CUFF.14802.3 | seg_3422 | 147478700 | 147483450 | M | chrX | 54475005 | 54522668 | − | 54520506 | 54525870 | FGD1 |
| 147481431 | 147521724 | + | CUFF.14907.2 | seg_3422 | 147478700 | 147483450 | M | chrX | 54475005 | 54522668 | − | 54520506 | 54525870 | FGD1 |
| 147481431 | 147521724 | + | CUFF.14802.2 | seg_3422 | 147478700 | 147483450 | M | chrX | 54475005 | 54522668 | − | 54520506 | 54525870 | FGD1 |
| 147778718 | 147779728 | + | CUFF.14910.3 | seg_3431 | 147779150 | 147780400 | M | chrX | 54208636 | 54209706 | − | 54207956 | 54209262 | PHF8 |
| 147955198 | 147991026 | + | CUFF.14809.2 | seg_3434 | 147954450 | 147956800 | M | chrX | 53963676 | 54070922 | − | 54069348 | 54071788 | PHF8 |
| 147955198 | 148067814 | + | CUFF.14809.1 | seg_3434 | 147954450 | 147956800 | M | chrX | 53963676 | 54070908 | − | 54069348 | 54071788 | PHF8 |
| 147955208 | 148067814 | + | CUFF.14914.1 | seg_3434 | 147954450 | 147956800 | M | chrX | 53963676 | 54070908 | − | 54069348 | 54071788 | PHF8 |
| 147955471 | 147955656 | + | CUFF.14808.1 | seg_3434 | 147954450 | 147956800 | M | chrX | 54070443 | 54070616 | − | 54069348 | 54071788 | PHF8 |
| 148089731 | 148090645 | + | CUFF.14808.1 | seg_3440 | 148088650 | 148090350 | M | other | 0 | 0 | | 0 | 0 | OA1 = GPR143 |
| 148090645 | 148090645 | + | ENSMUST00000121650 | seg_3440 | 148088650 | 148090350 | M | other | 0 | 0 | | 0 | 0 | OA1 = GPR143 |
| 148355350 | 148352209 | + | CUFF.14830.1 | seg_3449 | 148351400 | 148352950 | M | chrX | 53577614 | 53713695 | − | 53576440 | 53578410 | MRX1 = IQSEC2 |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 148436388 | 148438986 | + | CUFF.14916.3 | seg_3452 | 148436000 | 148437150 | M | chrX | 53458207 | 53461346 | − | 53460581 | 53461739 | MRX1 = IQSEC2 |
| 148444127 | 148450813 | − | ENSMUST00000133517 | seg_3453 | 148448100 | 148452250 | M | chrX | 53449811 | 53453282 | + | 53448362 | 53451724 | MRX1 = IQSEC2 |
| 148444127 | 148450813 | − | ENSMUST00000133517 | seg_3453 | 148448100 | 148452250 | M | chrX | 53449811 | 53453282 | + | 53448362 | 53451724 | MRX1 = IQSEC2 |
| 148450971 | 148470755 | + | ENSMUST00000145518 | seg_3453 | 148448100 | 148452250 | M | chrX | 53405849 | 53449660 | − | 53448362 | 53451724 | MRX1 = IQSEC2 |
| 148450971 | 148497237 | + | CUFF.14814.3 | seg_3453 | 148448100 | 148452250 | M | chrX | 53405849 | 53449660 | − | 53448362 | 53451724 | MRX1 = IQSEC2 |
| 148451804 | 148451804 | + | CUFF.14921.1 | seg_3453 | 148448100 | 148452250 | M | chrX | 53448837 | 53449093 | − | 53448362 | 53451724 | MRX1 = IQSEC2 |
| 148477431 | 148478058 | − | CUFF.14920.1 | seg_3455 | 148476800 | 148478500 | M | other | 0 | 0 | + | 0 | 0 | OA1 = GPR143 |
| 148477592 | 148478055 | − | ENSMUST00000120888 | seg_3455 | 148476800 | 148478500 | M | other | 0 | 0 | + | 0 | 0 | OA1 = GPR143 |
| 148477592 | 148478055 | − | ENSMUST00000120888 | seg_3455 | 148476800 | 148478500 | M | other | 0 | 0 | + | 0 | 0 | OA1 = GPR143 |
| 148578768 | 148639178 | + | CUFF.14816.1 | seg_119 | 148578700 | 148580800 | S | chrX | 53283545 | 53350548 | − | 53334817 | 53350616 | MRX1 = IQSEC2 |
| 148578768 | 148639178 | + | CUFF.14816.1 | seg_3460 | 148578400 | 148581050 | M | chrX | 53283545 | 53350548 | − | 53348024 | 53350934 | MRX1 = IQSEC2 |
| 148771395 | 148776968 | + | ENSMUST00000138918 | seg_3470 | 148775450 | 148777250 | M | chrX | 53111515 | 53117727 | − | 53111285 | 53113158 | MRX1 = IQSEC2 |
| 148771395 | 148777019 | − | CUFF.14927.4 | seg_3470 | 148775450 | 148777250 | M | chrX | 53111515 | 53117727 | − | 53111285 | 53113158 | MRX1 = IQSEC2 |
| 148771395 | 148777019 | − | CUFF.14927.3 | seg_3470 | 148775450 | 148777250 | M | chrX | 53111515 | 53117727 | − | 53111285 | 53113158 | MRX1 = IQSEC2 |
| 148978796 | 148979698 | − | ENSMUST00000120079 | seg_3479 | 148977250 | 148978900 | M | other | 0 | 0 | + | 0 | 0 | OA1 = GPR143 |
| 149044052 | 149204222 | + | CUFF.14826.2 | seg_3484 | 149203250 | 149205000 | M | chrX | 9754409 | 9917528 | + | 9753597 | 9755295 | OA1 = GPR143 |
| 149057511 | 149204219 | + | CUFF.14936.7 | seg_3484 | 149203250 | 149205000 | M | chrX | 9754412 | 9901148 | + | 9753597 | 9755295 | OA1 = GPR143 |
| 149441009 | 149444230 | + | CUFF.14939.1 | seg_3497 | 149440700 | 149441900 | M | chrX | 55513030 | 55516285 | − | 55515320 | 55516529 | ALAS2 |
| 149655713 | 149655986 | + | ENSMUST00000119867 | seg_3510 | 149655250 | 149657200 | M | other | 0 | 0 | + | 0 | 0 | OA1 = GPR143 |
| 149794275 | 149830825 | + | CUFF.14942.5 | seg_3517 | 149794050 | 149795950 | M | chrX | 56259009 | 56314850 | − | 56258774 | 56260707 | ALAS2 |
| 150266767 | 150268786 | + | CUFF.14947.1 | seg_3533 | 150266350 | 150268050 | M | chrX | 57095072 | 57097138 | + | 57095795 | 57097544 | ALAS2 |
| 151696962 | 151731456 | + | CUFF.14845.1 | seg_3550 | 151696250 | 151698050 | M | chrX | 23722764 | 23761432 | − | 23760757 | 23761726 | SAT = SAT1 |
| 151696978 | 151697427 | − | CUFF.14962.1 | seg_3550 | 151696250 | 151698050 | M | chrX | 23761017 | 23761415 | − | 23760757 | 23761726 | SAT = SAT1 |
| 151696986 | 151698125 | + | ENSMUST00000134662 | seg_3550 | 151696250 | 151698050 | M | chrX | 23760757 | 23761407 | − | 23760757 | 23761726 | SAT = SAT1 |
| 151738742 | 151740292 | − | ENSMUST00000144428 | seg_3551 | 151740100 | 151741400 | M | other | 0 | 0 | + | 0 | 0 | OA1 = GPR143 |
| 153915277 | 153915525 | − | CUFF.14971.1 | seg_3603 | 153914450 | 153916200 | M | chrX | 21975056 | 21975269 | + | 21974127 | 21976977 | PHEX |
| 154588028 | 154589111 | + | ENSMUST00000120024 | seg_3616 | 154587400 | 154588700 | M | other | 0 | 0 | + | 0 | 0 | OA1 = GPR143 |
| 154588028 | 154589111 | + | ENSMUST00000120024 | seg_3616 | 154587400 | 154588700 | M | other | 0 | 0 | + | 0 | 0 | OA1 = GPR143 |
| 155693729 | 155693827 | + | CUFF.14862.1 | seg_3654 | 155693500 | 155698350 | M | chrX | 20039469 | 20137382 | − | 20280720 | 20285259 | OA1 = GPR143 |
| 155834188 | 155924555 | + | CUFF.14861.1 | seg_3658 | 155833950 | 155835450 | M | chrX | 0 | 0 | + | 0 | 0 | OA1 = GPR143 |
| 155848179 | 155848442 | − | ENSMUST00000122329 | seg_3659 | 155847650 | 155849300 | M | other | 0 | 0 | + | 0 | 0 | OA1 = GPR143 |
| 155848232 | 155848371 | + | CUFF.14983.1 | seg_3659 | 155847650 | 155849300 | M | other | 0 | 0 | + | 0 | 0 | OA1 = GPR143 |
| 155964620 | 155998280 | + | CUFF.14989.2 | seg_3664 | 155964400 | 155968450 | M | chrX | 19968429 | 20009740 | − | 20008178 | 20009479 | PHKA2 |
| 155970597 | 156031013 | + | CUFF.14989.3 | seg_3665 | 155970350 | 155971650 | M | chrX | 19934359 | 20009176 | − | 19933931 | 19934963 | PHKA2 |
| 155970597 | 156031013 | + | CUFF.14989.3 | seg_3666 | 156030450 | 156031650 | M | chrX | 19934359 | 20009176 | − | 19903899 | 19905883 | PHKA2 |
| 156065166 | 156416001 | + | CUFF.14994.1 | seg_3667 | 156065150 | 156067100 | M | chrX | 19550319 | 19905867 | − | 19552603 | 19554763 | PHKA2 |
| 156380844 | 156412099 | + | ENSMUST00000142426 | seg_3681 | 156410850 | 156413050 | M | chrX | 19553529 | 19587588 | − | 19552603 | 19554763 | PHKA2 |
| 157027663 | 157036207 | + | CUFF.15003.1 | seg_3707 | 157034600 | 157036250 | M | chrX | 18907129 | 18912800 | − | 18906778 | 18908445 | PHKA2 |
| 157241673 | 157241983 | + | CUFF.15005.1 | seg_3718 | 157241550 | 157242700 | M | chrX | 18651084 | 18651384 | − | 18650361 | 18651566 | RS1 |
| 157246270 | 157432634 | − | CUFF.15001.3 | seg_3729 | 157431550 | 157434400 | M | chrX | 18443703 | 18446844 | + | 18441881 | 18444760 | CDKL5 |
| 157573079 | 157573160 | + | CUFF.14875.1 | seg_3735 | 157571600 | 157573100 | M | other | 0 | 0 | + | 0 | 0 | OA1 = GPR143 |
| 158346155 | 158346709 | + | ENSMUST00000154188 | seg_134 | 158344900 | 158348950 | S | chrX | 17673951 | 17674501 | − | 17672667 | 17674599 | CC = NHS |
| 158346155 | 158346709 | + | ENSMUST00000154188 | seg_3781 | 158344900 | 158348950 | M | chrX | 17673951 | 17674501 | − | 17671634 | 17675750 | CC = NHS |
| 158346155 | 158346709 | + | ENSMUST00000154188 | seg_134 | 158346050 | 158347950 | S | chrX | 17673951 | 17674501 | − | 17672667 | 17674599 | CC = NHS |

TABLE VII-continued

Table VII presents 230 distinct lncRNAs with XCI-associated PRC2 sites (640 entries). This table is laid out in a similar manner to Table VI and lists all of the lncRNAs associated with strong and moderate sites on the X chromosome, irrespective of proximity to disease gene of interest. A strong or moderate site located >100 kb away from a gene of interest may be involved in repressing the gene a long range.

| Start | Stop | Str | Transcript_ID | Ezh2_ID | Ezh2_start | Ezh2_stop | Ezh2 type | h_Chr | hg19_Start | hg19_Stop | hg19-strand | ezh2_hg19_start | ezh2_hg19_stop | disease_gene |
|---|---|---|---|---|---|---|---|---|---|---|---|---|---|---|
| 158346155 | 158346709 | + | ENSMUST00000154188 | seg_3781 | 158344900 | 158348950 | M | chrX | 17673951 | 17674501 | − | 17671634 | 17675750 | CC = NHS |
| 158789528 | 158791808 | + | ENSMUST00000119454 | seg_3809 | 158789950 | 158792150 | M | other | 0 | 0 | + | 0 | 0 | OA1 = GPR143 |
| 158789528 | 158791808 | + | ENSMUST00000119454 | seg_3809 | 158789950 | 158792150 | M | other | 0 | 0 | + | 0 | 0 | OA1 = GPR143 |
| 159294918 | 159326390 | − | CUFF.15022.1 | seg_3824 | 159325300 | 159326500 | M | chrX | 16737682 | 16754364 | + | 16737654 | 16738513 | CC = NHS |
| 160198169 | 160198915 | − | ENSMUST00000119583 | seg_137 | 160197550 | 160199400 | S | other | 0 | 0 | + | 0 | 0 | OA1 = GPR143 |
| 160198169 | 160198915 | − | ENSMUST00000119583 | seg_3857 | 160194600 | 160201150 | S | other | 0 | 0 | + | 0 | 0 | OA1 = GPR143 |
| 160198169 | 160198915 | − | ENSMUST00000119583 | seg_137 | 160197550 | 160199400 | S | other | 0 | 0 | + | 0 | 0 | OA1 = GPR143 |
| 160198169 | 160198915 | − | ENSMUST00000119583 | seg_3857 | 160194600 | 160201150 | M | other | 0 | 0 | + | 0 | 0 | OA1 = GPR143 |
| 160346915 | 160347226 | + | CUFF.15036.1 | seg_138 | 160345550 | 160347000 | S | chrX | 15872785 | 15873088 | − | 15873004 | 15874466 | PIGA |
| 160346915 | 160347226 | + | CUFF.15036.1 | seg_3862 | 160345250 | 160347350 | M | chrX | 15872785 | 15873088 | − | 15872655 | 15874788 | PIGA |
| 160346922 | 160367478 | + | CUFF.14888.1 | seg_138 | 160345550 | 160347000 | S | chrX | 15848182 | 15873081 | − | 15873004 | 15874466 | PIGA |
| 160346922 | 160367478 | + | CUFF.14888.1 | seg_3862 | 160345250 | 160347350 | M | chrX | 15848182 | 15873081 | − | 15872655 | 15874788 | PIGA |
| 160391523 | 160396094 | − | ENSMUST00000139166 | seg_3865 | 160394650 | 160396700 | M | chrX | 15808883 | 15822299 | + | 15808199 | 15811430 | PIGA |
| 161381302 | 161418307 | − | CUFF.15049.4 | seg_3910 | 161380550 | 161381550 | M | chrX | 14891501 | 14934512 | + | 14934264 | 14935279 | PIGA |
| 162827965 | 162878637 | − | CUFF.15054.2 | seg_3948 | 162877500 | 162879500 | M | chrX | 13752890 | 13788174 | + | 13750751 | 13753578 | OFD1 |
| 162948132 | 162948265 | + | CUFF.14908.1 | seg_3951 | 162946950 | 162949350 | M | chrX | 13671391 | 13671542 | − | 13670689 | 13672284 | SEDL = TRAPPC2 |
| 163292134 | 163292985 | + | ENSMUST00000087025 | seg_3964 | 163290550 | 163292150 | M | other | 0 | 0 | + | 13351903 | 13352110 | OA1 = GPR143 |
| 163292134 | 163292985 | + | ENSMUST00000087025 | seg_3964 | 163290550 | 163292150 | M | other | 0 | 0 | + | 13351903 | 13352110 | OA1 = GPR143 |
| 163292143 | 163292943 | + | ENSMUST00000118791 | seg_3964 | 163290550 | 163292150 | M | chrX | 0 | 0 | + | 13351903 | 13352110 | OA1 = GPR143 |
| 163292143 | 163292943 | + | ENSMUST00000118791 | seg_3964 | 163290550 | 163292150 | M | other | 0 | 0 | + | 13351903 | 13352110 | OA1 = GPR143 |
| 163784254 | 163820681 | − | CUFF.15069.2 | seg_3980 | 163818250 | 163825700 | M | chrX | 12809471 | 12837836 | + | 12804546 | 12811334 | SEDL = TRAPPC2 |
| 163790030 | 163820681 | − | CUFF.15069.3 | seg_3980 | 163818250 | 163825700 | M | chrX | 12809471 | 12837836 | + | 12804546 | 12811334 | SEDL = TRAPPC2 |
| 163810341 | 163820642 | − | ENSMUST00000145456 | seg_3979 | 163818250 | 163812250 | M | chrX | 12809525 | 12818878 | + | 12817304 | 12818971 | SEDL = TRAPPC2 |
| 163810341 | 163820642 | − | ENSMUST00000145456 | seg_3980 | 163818250 | 163825700 | M | chrX | 12809525 | 12818878 | + | 12804546 | 12811334 | SEDL = TRAPPC2 |
| 164214193 | 164215488 | + | CUFF.14919.1 | seg_3997 | 164214300 | 164216150 | M | other | 0 | 0 | + | 0 | 0 | OA1 = GPR143 |
| 164214193 | 164215488 | + | ENSMUST00000119938 | seg_3997 | 164214300 | 164216150 | M | other | 0 | 0 | + | 0 | 0 | OA1 = GPR143 |

To obtain human paralogues, the mouse lncRNAs were lifted over (using uesc batch liftOver software genome.ucsc.edu/cgi-bin/hgLiftOver) to the February 2009 (CRCh37/hg19) human genome assembly.

Tables VIII and IX set forth the SEQ ID NOs. for the mouse and human lncRNAs from Table VII. Coordinates are in reference to genome assembly mm9 and hg19, respectively.

TABLE VIII lncRNAs for Mouse Ezh2 binding sites

| Start | Finish | Strand | Disease Gene | Mod/Strong | SEQ ID NO: |
|---|---|---|---|---|---|
| 100355529 | 100360903 | − | OA1 = GPR143 | moderate | 227 |
| 100358233 | 100360766 | − | OA1 = GPR143 | moderate | 228 |
| 100358233 | 100360766 | − | OA1 = GPR143 | moderate | 229 |
| 100358449 | 100360746 | − | OA1 = GPR143 | moderate | 230 |
| 10062235 | 10173613 | + | OTC | moderate | 231 |
| 10062248 | 10173731 | + | OTC | moderate | 232 |
| 100724822 | 100725046 | + | OA1 = GPR143 | moderate | 233 |
| 100891328 | 100891361 | + | ABCB7 | moderate | 234 |
| 101396608 | 101396824 | − | ABCB7 | moderate | 235 |
| 101941821 | 101942111 | + | OA1 = CPR143 | moderate | 236 |
| 101941821 | 101942111 | + | OA1 = CPR143 | moderate | 237 |
| 102143124 | 102143621 | + | OA1 = CPR143 | moderate | 238 |
| 102143124 | 102143621 | + | OA1 = CPR143 | moderate | 239 |
| 102227925 | 102228705 | + | OA1 = CPR143 | moderate | 240 |
| 102227925 | 102228705 | + | OA1 = CPR143 | moderate | 241 |
| 10284302 | 10295947 | − | OTC | moderate | 242 |
| 10284302 | 10295947 | − | OTC | strong | 243 |
| 102920467 | 102920853 | − | OA1 = CPR143 | moderate | 244 |
| 102920467 | 102920853 | − | OA1 = CPR143 | moderate | 245 |
| 103555795 | 103579410 | − | PGK1 | moderate | 246 |
| 103828136 | 103828642 | − | OA1 = CPR143 | moderate | 247 |
| 106030003 | 106034841 | + | PGK1 | moderate | 248 |
| 106030003 | 106034841 | + | PGK1 | moderate | 249 |
| 106196824 | 106197635 | + | OA1 = CPR143 | moderate | 250 |
| 106196824 | 106197635 | + | OA1 = CPR143 | moderate | 251 |
| 109008832 | 109008863 | − | OA1 = CPR143 | moderate | 252 |
| 109714135 | 109739682 | + | CHM | moderate | 253 |
| 109935831 | 109936305 | − | OA1 = CPR143 | moderate | 254 |
| 11241367 | 11241392 | − | OTC | moderate | 255 |
| 11421805 | 11421826 | − | OA1 = CPR143 | moderate | 256 |
| 11490217 | 11490415 | − | OTC | moderate | 257 |
| 11490217 | 11490415 | − | OTC | moderate | 258 |
| 12339404 | 12398618 | + | CSNB1 = NYX | strong | 259 |
| 12339404 | 12398618 | + | CSNB1 = NYX | moderate | 260 |
| 123984075 | 123984154 | − | OA1 = CPR143 | moderate | 261 |
| 12513998 | 12515254 | + | OA1 = CPR143 | moderate | 262 |
| 12513998 | 12515254 | + | OA1 = CPR143 | moderate | 263 |
| 126284278 | 126284832 | + | BTK | moderate | 264 |
| 126284278 | 126284832 | + | BTK | strong | 265 |
| 126284278 | 126577066 | + | BTK | moderate | 266 |
| 126284278 | 126577066 | + | BTK | strong | 267 |
| 12648548 | 12650070 | + | CSNB1 = NYX | moderate | 268 |
| 12658599 | 12738071 | + | CSNB1 = NYX | moderate | 269 |
| 12658599 | 12743898 | + | CSNB1 = NYX | moderate | 270 |
| 12658599 | 12768156 | + | CSNB1 = NYX | moderate | 271 |
| 131120171 | 131120713 | + | BTK | moderate | 272 |
| 131216059 | 131216416 | + | OA1 = CPR143 | moderate | 273 |
| 131216059 | 131216416 | + | OA1 = CPR143 | moderate | 274 |
| 131291106 | 131295994 | + | GLA | moderate | 275 |
| 132277243 | 132332177 | + | GLA | moderate | 276 |
| 132277243 | 132336941 | + | GLA | moderate | 277 |
| 132673507 | 132674982 | + | GLA | moderate | 278 |
| 133634055 | 133634641 | + | OA1 = CPR143 | strong | 279 |
| 133634055 | 133634641 | + | OA1 = CPR143 | moderate | 280 |
| 133634055 | 133634641 | + | OA1 = CPR143 | strong | 281 |
| 133634055 | 133634641 | + | OA1 = CPR143 | moderate | 282 |
| 133638428 | 133639261 | − | OA1 = CPR143 | strong | 283 |
| 133638428 | 133639261 | − | OA1 = CPR143 | moderate | 284 |
| 133638428 | 133639261 | − | OA1 = CPR143 | strong | 285 |
| 133638428 | 133639261 | − | OA1 = CPR143 | moderate | 286 |
| 133641785 | 133642659 | + | OA1 = CPR143 | moderate | 287 |
| 133641785 | 133642659 | + | OA1 = CPR143 | moderate | 288 |
| 133645879 | 133647421 | + | OA1 = CPR143 | moderate | 289 |

TABLE VIII-continued lncRNAs for Mouse Ezh2 binding sites

| Start | Finish | Strand | Disease Gene | Mod/Strong | SEQ ID NO: |
|---|---|---|---|---|---|
| 133645879 | 133647421 | + | OA1 = CPR143 | moderate | 290 |
| 133662649 | 133664374 | + | OA1 = CPR143 | moderate | 291 |
| 133810152 | 133810286 | − | OA1 = CPR143 | moderate | 292 |
| 134966460 | 134966551 | − | OA1 = CPR143 | moderate | 293 |
| 135448948 | 135524317 | + | TBG = SERPINA7 | moderate | 294 |
| 135448948 | 135545071 | + | TBG = SERPINA7 | moderate | 295 |
| 135448953 | 135545071 | + | TBG = SERPINA7 | moderate | 296 |
| 135882030 | 135892277 | − | TBG = SERPINA7 | moderate | 297 |
| 135882030 | 135892277 | − | TBG = SERPINA7 | moderate | 298 |
| 135893007 | 135893796 | + | OA1 = CPR143 | moderate | 299 |
| 136219520 | 136287944 | + | PRPS1 | moderate | 300 |
| 136991152 | 136999981 | + | PRPS1 | moderate | 301 |
| 136991152 | 136999981 | + | PRPS1 | moderate | 302 |
| 137074067 | 137077207 | − | PRPS1 | moderate | 303 |
| 137356477 | 137357062 | − | OA1 = GPR143 | moderate | 304 |
| 137356477 | 137357062 | − | OA1 = GPR143 | moderate | 305 |
| 137599946 | 137642145 | − | COL4A5 | moderate | 306 |
| 137599946 | 137764377 | − | COL4A5 | moderate | 307 |
| 138304675 | 138304947 | − | OA1 = GPR143 | moderate | 308 |
| 138732108 | 138733073 | + | OA1 = GPR143 | moderate | 309 |
| 138732108 | 138733073 | + | OA1 = GPR143 | moderate | 310 |
| 139057035 | 139057445 | − | OA1 = GPP143 | moderate | 311 |
| 139057035 | 139057445 | − | OA1 = CPR143 | moderate | 312 |
| 139065646 | 139068558 | − | OA1 = CPR143 | moderate | 313 |
| 139066026 | 139068558 | − | OA1 = GPR143 | moderate | 314 |
| 139830092 | 139830157 | − | COL4A5 | moderate | 315 |
| 139953067 | 140232335 | + | COL4A5 | moderate | 316 |
| 147359163 | 147360702 | − | OA1 = CPR143 | moderate | 317 |
| 147417684 | 147442281 | − | FGD1 | moderate | 318 |
| 147778718 | 147779728 | + | PHF8 | moderate | 319 |
| 147955198 | 147991026 | + | PHF8 | moderate | 320 |
| 147955198 | 148067814 | + | PHF8 | moderate | 321 |
| 147955208 | 148067814 | + | PHF8 | moderate | 322 |
| 147955471 | 147955656 | − | PHF8 | moderate | 323 |
| 148089731 | 148090645 | + | OA1 = GPR143 | moderate | 324 |
| 148089731 | 148090645 | + | OA1 = GPP143 | moderate | 325 |
| 148235350 | 148352209 | + | MRX1 = IQSEC2 | moderate | 326 |
| 148450971 | 148470755 | + | MRX1 = IQSEC2 | moderate | 327 |
| 148450971 | 148497237 | + | MRX1 = IQSEC2 | moderate | 328 |
| 148477431 | 148478058 | − | OA1 = GFR143 | moderate | 329 |
| 148477592 | 148478055 | − | OA1 = GPR143 | moderate | 330 |
| 148477592 | 148478055 | − | OA1 = GPR143 | moderate | 331 |
| 148578768 | 148639178 | + | MRX1 = IQSEC2 | strong | 332 |
| 148573768 | 148639178 | + | MRX1 = IQSEC2 | moderate | 333 |
| 148771395 | 148776968 | − | MRX1 = IQSEC2 | moderate | 334 |
| 148771395 | 148777019 | − | MRX1 = IQSEC2 | moderate | 335 |
| 148771395 | 148777019 | − | MRX1 = IQSEC2 | moderate | 336 |
| 148978796 | 148979698 | − | OA1 = GPR143 | moderate | 337 |
| 149441009 | 149444230 | + | ALAS2 | moderate | 338 |
| 149655713 | 149655986 | + | OA1 = GPR143 | moderate | 339 |
| 150266767 | 150268786 | + | ALAS2 | moderate | 340 |
| 151696962 | 151731456 | + | SAT = SAT1 | moderate | 341 |
| 151696978 | 151697427 | + | SAT = SAT1 | moderate | 342 |
| 151696986 | 151658125 | + | SAT = SAT1 | moderate | 343 |
| 151738742 | 151740292 | − | OA1 = GPR143 | moderate | 344 |
| 154588028 | 154589111 | + | OA1 = GPP143 | moderate | 345 |
| 154588028 | 154589111 | + | OA1 = GPR143 | moderate | 346 |
| 155693729 | 155693827 | − | OA1 = GPR143 | moderate | 347 |
| 155834188 | 155924555 | + | PHKA2 | moderate | 348 |
| 155848179 | 155848442 | − | OA1 = GPR143 | moderate | 349 |
| 155843232 | 155848371 | + | OA1 = GPR143 | moderate | 350 |
| 156065166 | 156416001 | + | PHKA2 | moderate | 351 |
| 158346155 | 158346705 | + | CC = NHS | strong | 352 |
| 158346155 | 158346709 | + | CC = NHS | moderate | 353 |
| 158346155 | 158346709 | + | CC = NHS | strong | 354 |
| 158346155 | 158346709 | + | CC = NHS | moderate | 355 |
| 158789528 | 158791808 | + | GA = CPR143 | moderate | 356 |
| 158739528 | 158791808 | + | OA1 = GPR143 | moderate | 357 |
| 159294918 | 159326390 | − | CC = NHS | moderate | 358 |
| 160198169 | 160198915 | − | OA1 = GPR143 | strong | 359 |
| 160198169 | 160198915 | − | OA1 = GPR143 | moderate | 360 |
| 160159169 | 160198915 | − | OA1 = GPR143 | strong | 361 |
| 160198169 | 160198915 | − | OA1 = GPR143 | moderate | 362 |
| 160346915 | 160347226 | + | PIGA | strong | 363 |

TABLE VIII-continued lncRNAs for Mouse Ezh2 binding sites

| Start | Finish | Strand | Disease Gene | Mod/Strong | SEQ ID NO: |
|---|---|---|---|---|---|
| 160346915 | 160347226 | + | PIGA | moderate | 364 |
| 160346922 | 160367478 | + | PIGA | strong | 365 |
| 160346922 | 160367478 | + | PICA | moderate | 366 |
| 16195654 | 16195958 | + | NDP | moderate | 367 |
| 16196824 | 16254723 | + | NDP | moderate | 368 |
| 162948132 | 162948265 | + | SEDL = TRAPPC2 | moderate | 369 |
| 163292134 | 163292985 | + | OA1 = GPR143 | moderate | 370 |
| 163292134 | 163292985 | + | OA1 = GPR143 | moderate | 371 |
| 163292143 | 163292943 | + | OA1 = GPR143 | moderate | 372 |
| 163292143 | 163292943 | + | OA1 = GPR143 | moderate | 373 |
| 163784254 | 163820681 | − | SEDL = TRAPPC2 | moderate | 374 |
| 164214193 | 164215488 | + | OA1 = GPR143 | moderate | 375 |
| 164214193 | 164215488 | + | OA1 = GPR143 | moderate | 376 |
| 19636666 | 19638395 | + | UBA1 | strong | 377 |
| 19636666 | 19638395 | + | UBA1 | moderate | 378 |
| 19636666 | 19674647 | + | UBA1 | strong | 379 |
| 13636666 | 19674647 | + | UBA1 | moderate | 380 |
| 20002814 | 20003061 | + | UBA1 | moderate | 381 |
| 20194399 | 20225033 | + | UBA1 | strong | 382 |
| 20194399 | 20225033 | + | UBA1 | moderate | 383 |
| 20281032 | 20294944 | + | UBA1 | moderate | 384 |
| 20539240 | 20563863 | + | OA1 = GPR143 | moderate | 385 |
| 20937991 | 20941748 | + | OA1 = GPR143 | moderate | 386 |
| 20938066 | 20940148 | + | OA1 = GPR143 | moderate | 387 |
| 20938066 | 20940148 | + | OA1 = GPR143 | moderate | 388 |
| 33428645 | 33616557 | + | COL4A5 | moderate | 389 |
| 33428660 | 33523834 | + | COL4A5 | moderate | 390 |
| 33428660 | 33616557 | + | COL4A5 | moderate | 391 |
| 33868348 | 33882606 | + | COL4A5 | strong | 392 |
| 33868348 | 33882606 | + | COL4A5 | moderate | 393 |
| 34138199 | 34138634 | + | OCRL | moderate | 394 |
| 34190337 | 34208188 | − | OCRL | moderate | 395 |
| 34208212 | 34209008 | + | OA1 = GPR143 | moderate | 396 |
| 34208212 | 34209008 | + | OA1 = GPR143 | moderate | 397 |
| 34354766 | 34357180 | − | OCRL | moderate | 398 |
| 34354766 | 34357180 | − | OCRL | moderate | 399 |
| 34414316 | 34414834 | + | OCRL | moderate | 400 |
| 34414316 | 34415329 | + | OCRL | moderate | 401 |
| 34414323 | 34414681 | + | OCRL | moderate | 402 |
| 34442912 | 34442959 | + | OCRL | moderate | 403 |
| 34443059 | 34443464 | − | OCRL | moderate | 404 |
| 34443156 | 34443320 | − | OCRL | moderate | 405 |
| 35180050 | 35183034 | + | OA1 = GPR143 | moderate | 406 |
| 35180050 | 35183034 | + | OA1 = GFR143 | moderate | 407 |
| 35533905 | 35534803 | + | OA1 = GPR143 | strong | 408 |
| 35533905 | 35534803 | + | OA1 = GPR143 | moderate | 409 |
| 35533905 | 35534803 | + | OA1 = GPR143 | strong | 410 |
| 35533905 | 35534803 | + | OA1 = GPR143 | moderate | 411 |
| 35542915 | 35550223 | + | OCRL | moderate | 412 |
| 35542935 | 35550223 | + | OCRL | moderate | 413 |
| 38754031 | 38966276 | + | OCRL | strong | 414 |
| 38754031 | 38966276 | + | OCRL | moderate | 415 |
| 40677132 | 40782180 | − | OCRL | strong | 416 |
| 40677132 | 40782180 | − | OCRL | moderate | 417 |
| 40677132 | 40782180 | − | OCRL | strong | 418 |
| 40677132 | 40782180 | − | OCRL | moderate | 419 |
| 45363158 | 45363341 | + | OA1 = GPR143 | moderate | 420 |
| 45363178 | 45363342 | + | OA1 = GPR143 | moderate | 421 |
| 45694175 | 45694423 | − | OCRL | strong | 422 |
| 45694175 | 45694423 | − | OCRL | moderate | 423 |
| 45694535 | 45755264 | − | OCRL | strong | 424 |
| 45694535 | 45755264 | + | OCRL | moderate | 425 |
| 45976590 | 46015471 | + | OCRL | moderate | 426 |
| 47726321 | 47727201 | + | OA1 = GPR143 | moderate | 427 |
| 47726321 | 47727201 | + | OA1 = GPP143 | moderate | 428 |
| 47908921 | 47988433 | − | OA1 = GPR143 | moderate | 429 |
| 47930580 | 47930887 | − | OA1 = GPR143 | moderate | 430 |
| 47948607 | 47988499 | − | NYS1 = FRMD7 | moderate | 431 |
| 47968572 | 47988498 | − | NYS1 = FRMD7 | moderate | 432 |
| 47983977 | 47988499 | − | NYS1 = FRMD7 | moderate | 433 |
| 48371324 | 48371616 | − | NYS1 = FRMD7 | moderate | 434 |
| 48371476 | 48371850 | + | NYS1 = FRMD7 | moderate | 435 |
| 49106697 | 49154410 | − | NYS1 = FRMD7 | moderate | 436 |
| 49404740 | 49405157 | − | HPRT1 = HPRT | moderate | 437 |
| 49405289 | 49405837 | − | HPRT1 = HPRT | moderate | 438 |
| 50095234 | 50098237 | − | HPRT1 = HPRT | moderate | 439 |
| 50095740 | 50097770 | − | HPRT1 = HPRT | moderate | 440 |
| 50095740 | 50097770 | − | HPRT1 = HPRT | moderate | 441 |
| 50095740 | 50097770 | − | HPRT1 = HPRT | moderate | 442 |
| 50095740 | 50097770 | − | HPRT1 = HPRT | moderate | 443 |
| 50095740 | 50097770 | − | HPRT1 = HPRT | moderate | 444 |
| 50265421 | 50310120 | + | HPRT1 = HPRT | moderate | 445 |
| 50341229 | 50374836 | + | HPRT1 = HPRT | moderate | 446 |
| 50341250 | 50341769 | + | HPRT1 = HPRT | moderate | 447 |
| 50407432 | 50407526 | − | HPRT1 = HPRT | moderate | 448 |
| 50408223 | 50410367 | − | HPRT1 = HPRT | moderate | 449 |
| 50408223 | 50410367 | − | HPRT1 = HPRT | strong | 450 |
| 50408947 | 50410413 | − | HPRT1 = HPRT | moderate | 451 |
| 50408947 | 50410413 | − | HPRT1 = HPRT | strong | 452 |
| 50409370 | 50410367 | − | HPRT1 = HPRT | moderate | 453 |
| 50409370 | 50410367 | − | HPRT1 = HPRT | strong | 454 |
| 50409370 | 50410367 | − | HPRT1 = HPRT | moderate | 455 |
| 50409370 | 50410367 | − | HPRT1 = HPRT | strong | 456 |
| 51076013 | 51076305 | + | GA1 = GPR143 | moderate | 457 |
| 51272614 | 51278177 | − | OA1 = GPR143 | moderate | 458 |
| 51272614 | 51278177 | − | OA1 = GPR143 | strong | 459 |
| 53599576 | 53618851 | + | HPRT1 = HPRT | moderate | 460 |
| 53984857 | 54043843 | + | HPRT1 = HPRT | moderate | 461 |
| 53984936 | 54043843 | + | HPRT1 = HPRT | moderate | 462 |
| 54484662 | 54494066 | − | HPRT1 = HPRT | moderate | 463 |
| 54989724 | 54991732 | + | OA1 = GPR143 | moderate | 464 |
| 55175146 | 55175209 | + | F9 | moderate | 465 |
| 55175146 | 55175209 | + | F9 | strong | 466 |
| 55291586 | 55291918 | − | HPRT1 = HPRT | moderate | 467 |
| 57657230 | 57657464 | + | F9 | moderate | 468 |
| 57657681 | 57657808 | + | F9 | moderate | 469 |
| 57801194 | 57802024 | + | F9 | moderate | 470 |
| 57801194 | 57802024 | + | F9 | moderate | 471 |
| 58146828 | 58151242 | + | F9 | moderate | 472 |
| 58146828 | 58151242 | + | F9 | strong | 473 |
| 6356106 | 6474704 | + | CLCN5 | strong | 474 |
| 6356106 | 6474704 | + | CLCN5 | moderate | 475 |
| 65920689 | 65931574 | − | FMR1 | moderate | 476 |
| 65931716 | 65951510 | + | FMR1 | moderate | 477 |
| 65931716 | 65970681 | + | FMR1 | moderate | 478 |
| 65931716 | 65970681 | + | FMR1 | moderate | 479 |
| 66858632 | 66859428 | − | OA1 = GPR143 | moderate | 480 |
| 66858632 | 66859428 | − | OA1 = GPR143 | moderate | 481 |
| 66858671 | 66859420 | − | OA1 = GPR143 | moderate | 482 |
| 67712928 | 67730355 | − | MTM1 | moderate | 483 |
| 68291015 | 68303292 | − | MTM1 | moderate | 484 |
| 68291015 | 68303292 | − | MTM1 | strong | 485 |
| 68809081 | 68812693 | + | MTM1 | moderate | 486 |
| 68809092 | 68812471 | + | HPRT1 = HPRT | moderate | 487 |
| 6948402 | 6952952 | − | CLCN5 | moderate | 488 |
| 6953051 | 6955168 | + | CLCN5 | moderate | 489 |
| 70232678 | 70261234 | + | ABCD1 | moderate | 490 |
| 70748725 | 70748751 | − | ABCD1 | moderate | 491 |
| 70884707 | 70887453 | + | ABCD1 | moderate | 492 |
| 70884707 | 70887453 | + | ABCD1 | strong | 493 |
| 70918489 | 70919425 | + | ABCD1 | moderate | 494 |
| 71038698 | 71070106 | − | L1CAM | moderate | 495 |
| 71212129 | 71212322 | − | AVPR2 | moderate | 496 |
| 71252041 | 71252841 | + | OA1 = GPR143 | moderate | 497 |
| 71252041 | 71252841 | + | OA1 = GPR143 | moderate | 498 |
| 71500026 | 71500436 | + | EMD | moderate | 499 |
| 71527251 | 71528204 | + | EMD | moderate | 500 |
| 71527251 | 71528254 | + | EMD | moderate | 501 |
| 71527980 | 71535490 | + | EMD | moderate | 502 |
| 71550319 | 71553622 | + | OA1 = GPR143 | moderate | 503 |
| 71550319 | 71557201 | + | MTM1 | moderate | 504 |
| 71550337 | 71553623 | + | EMD | moderate | 505 |
| 71574384 | 71590028 | + | IKBKG | moderate | 506 |
| 71574384 | 71597045 | + | IKBKG | moderate | 507 |
| 71574404 | 71588866 | + | IKBKG | moderate | 508 |
| 72388763 | 72388969 | + | OA1 = GPR143 | moderate | 509 |
| 72388763 | 72388969 | + | OA1 = GPR143 | moderate | 510 |
| 72389027 | 72389809 | + | OA1 = GPR143 | moderate | 511 |

TABLE VIII-continued lncRNAs for Mouse Ezh2 binding sites

| Start | Finish | Strand | Disease Gene | Mod/Strong | SEQ ID NO: |
|---|---|---|---|---|---|
| 72389027 | 72389809 | + | OA1 = GPR143 | moderate | 512 |
| 72759615 | 72762429 | + | F8 | moderate | 513 |
| 7329256 | 7329540 | + | COL4A5 | moderate | 514 |
| 7329256 | 7329540 | + | COL4A5 | moderate | 515 |
| 7418487 | 7449418 | + | PQBP1 | moderate | 516 |
| 7418957 | 7449384 | + | PQBP1 | moderate | 517 |
| 7476440 | 7483890 | + | PQBP1 | moderate | 518 |
| 7476463 | 7497358 | + | PQBP1 | moderate | 519 |
| 7476463 | 7497358 | + | PQBP1 | moderate | 520 |
| 7476501 | 7476531 | − | PQBP1 | moderate | 521 |
| 7527282 | 7527994 | − | OA1 = GPR143 | moderate | 522 |
| 7624355 | 7624525 | + | OA1 = GPR143 | moderate | 523 |
| 7624355 | 7624525 | + | OA1 = GPR143 | moderate | 524 |
| 7682420 | 7683239 | + | OA1 = GPR143 | moderate | 525 |
| 7682420 | 7683239 | + | OA1 = GPR143 | moderate | 526 |
| 7770971 | 7783651 | − | WAS | moderate | 527 |
| 7770971 | 7783651 | − | WAS | moderate | 528 |
| 78316009 | 78316663 | + | XK | moderate | 529 |
| 78316009 | 78343211 | + | XK | moderate | 530 |
| 78316009 | 78343211 | + | XK | moderate | 531 |
| 78316037 | 78340115 | + | XK | moderate | 532 |
| 82819228 | 82867039 | + | DAX1 = NR0B1 | moderate | 533 |
| 82819228 | 82879808 | + | DAX1 = NR0B1 | moderate | 534 |
| 82961777 | 82962362 | + | OA1 = GPR143 | moderate | 535 |
| 82961777 | 82962362 | + | OA1 = GPR143 | moderate | 536 |
| 83561422 | 83564035 | + | OA1 = GPR143 | moderate | 537 |
| 83561422 | 83564035 | + | OA1 = GPR143 | moderate | 538 |
| 83590162 | 83591184 | − | DAX1 = NR0B1 | moderate | 539 |
| 83658987 | 83659063 | − | OA1 = GPR143 | moderate | 540 |
| 8776971 | 8792653 | + | XK | moderate | 541 |
| 8903530 | 8904209 | − | OA1 = GPR143 | moderate | 542 |
| 8904262 | 8904575 | − | OA1 = GPR143 | moderate | 543 |
| 91077474 | 91077950 | + | SAT = SAT1 | moderate | 544 |
| 91792302 | 91792908 | − | OA1 = GPR143 | moderate | 545 |
| 91792302 | 91792908 | − | OA1 = GPR143 | moderate | 546 |
| 91881387 | 91888583 | + | CLCN5 | moderate | 547 |
| 91881387 | 91888583 | + | CLCN5 | strong | 548 |
| 91916842 | 91918459 | − | OA1 = GPR143 | moderate | 549 |
| 91916842 | 91918459 | − | OA1 = GPR143 | moderate | 550 |
| 92017958 | 92019373 | − | OA1 = GPR143 | moderate | 551 |
| 92017958 | 92019373 | − | OA1 = GPR143 | moderate | 552 |
| 92020317 | 92021016 | − | OA1 = GPR143 | moderate | 553 |
| 92020317 | 92021016 | − | OA1 = GPR143 | moderate | 554 |
| 92035056 | 92035685 | + | OA1 = GPR143 | moderate | 555 |
| 92035056 | 92035685 | + | OA1 = GPR143 | moderate | 556 |
| 92038442 | 92043576 | + | ALAS2 | moderate | 557 |
| 92907017 | 93120097 | + | OA1 = GFR143 | moderate | 558 |
| 92907017 | 93120097 | + | OA1 = GPR143 | moderate | 559 |
| 93291330 | 93363894 | + | AR | moderate | 560 |
| 93291330 | 93363894 | + | AR | moderate | 561 |
| 96331411 | 96344330 | + | ED1 = EDA | moderate | 562 |
| 96331411 | 96344330 | + | ED1 = EDA | moderate | 563 |
| 96509316 | 96509440 | + | ED1 = EDA | moderate | 564 |
| 96600670 | 96639136 | − | ED1 = EDA | moderate | 565 |
| 96600670 | 96639136 | − | ED1 = EDA | strong | 566 |
| 96600670 | 96639136 | − | ED1 = EDA | moderate | 567 |
| 96600670 | 36639136 | − | ED1 = EDA | strong | 568 |
| 97015446 | 97015868 | + | ED1 = EDA | moderate | 569 |
| 97015934 | 97016205 | − | ED1 = EDA | moderate | 570 |
| 97016120 | 97016273 | + | ED1 = EDA | moderate | 571 |
| 97170822 | 97506638 | + | ED1 = EDA | moderate | 572 |
| 97170822 | 97596101 | + | ED1 = EDA | moderate | 573 |
| 97170904 | 97596101 | + | ED1 = EDA | moderate | 574 |
| 97170904 | 97596101 | + | ED1 = EDA | strong | 575 |
| 97925212 | 97927787 | + | GJB1 | moderate | 576 |
| 97925212 | 97927787 | + | GJB1 | moderate | 577 |
| 97962972 | 97972554 | − | GJB1 | moderate | 578 |
| 97962972 | 97982921 | − | GJB1 | moderate | 579 |
| 97968278 | 97968379 | − | GJB1 | moderate | 580 |
| 98254349 | 98254631 | + | OA1 = GPR143 | moderate | 581 |
| 98449812 | 98456212 | + | GJB1 | moderate | 582 |
| 98835383 | 98849934 | + | GJB1 | moderate | 583 |
| 98835383 | 98849934 | + | GJB1 | strong | 584 |
| 98835399 | 98849983 | + | GJB1 | moderate | 585 |
| 98835399 | 98849983 | + | GJB1 | strong | 586 |
| 98986564 | 98988647 | − | GJB1 | moderate | 587 |
| 98986564 | 98988647 | − | GJB1 | moderate | 588 |
| 99044721 | 99287394 | + | GJB1 | moderate | 589 |
| 99044721 | 99287394 | + | GJB1 | moderate | 590 |
| 99044721 | 99287394 | + | GJB1 | strong | 591 |
| 99044724 | 99144974 | + | GJB1 | moderate | 592 |
| 99044724 | 99144974 | + | GJB1 | strong | 593 |
| 157246270 | 157432634 | − | CDKL5 | moderate | 594 |
| 137074067 | 137133980 | − | PRPS1 | strong | 595 |
| 137074067 | 137133980 | − | PRPS1 | moderate | 596 |
| 55283804 | 55294913 | + | F9 | moderate | 597 |
| 55283804 | 55294913 | + | F9 | moderate | 598 |
| 55283804 | 55294913 | + | F9 | strong | 599 |
| 137199310 | 137302254 | + | PRPS1 | moderate | 600 |
| 137199472 | 137302254 | + | PRPS1 | moderate | 601 |
| 47148122 | 47150912 | − | NYS1 = FRMD7 | moderate | 602 |
| 157027663 | 157036207 | + | PHKA2 | moderate | 603 |
| 55283804 | 55286873 | + | F9 | moderate | 604 |
| 55283804 | 55286873 | + | F9 | strong | 605 |
| 155970597 | 156031013 | + | PHKA2 | moderate | 606 |
| 155970597 | 156031013 | + | PHKA2 | moderate | 607 |
| 91881415 | 91888583 | + | CLCN5 | moderate | 608 |
| 91881415 | 91888583 | + | CLCN5 | strong | 609 |
| 11613866 | 11737559 | − | CSNB1 = NYX | strong | 610 |
| 11613866 | 11737559 | − | CSNB1 = NYX | moderate | 611 |
| 47135713 | 47150926 | − | NYS1 = FRMD7 | moderate | 612 |
| 57377877 | 57431535 | − | F9 | moderate | 613 |
| 12256875 | 12339199 | − | CSNB1 = NYX | strong | 614 |
| 12256875 | 12339199 | − | CSNB1 = NYX | moderate | 615 |
| 11613866 | 11705532 | − | CSNB1 = NYX | strong | 616 |
| 11613866 | 11705532 | − | CSNB1 = NYX | moderate | 617 |
| 143904918 | 143988678 | − | COL4A5 | moderate | 618 |
| 53863012 | 53908257 | + | HPRT1 = HPR7 | moderate | 619 |
| 57309131 | 57432445 | − | F9 | moderate | 620 |
| 96132695 | 96144356 | + | AR | moderate | 621 |
| 96132488 | 96144356 | + | AR | moderate | 622 |
| 40250312 | 40782303 | − | OCRL | strong | 623 |
| 40250312 | 40782303 | − | OCRL | moderate | 624 |
| 96237920 | 96270067 | + | ED1 = EDA | moderate | 625 |
| 10292145 | 10296816 | + | OTC | moderate | 626 |
| 131282994 | 131285982 | − | GLA | moderate | 627 |
| 155964620 | 155998280 | + | PHKA2 | moderate | 628 |
| 40177535 | 40782180 | − | OCRL | strong | 629 |
| 40177535 | 40782180 | − | OCRL | moderate | 630 |
| 7367144 | 7397082 | + | PQBP1 | moderate | 631 |
| 7367144 | 7397082 | + | PQBP1 | moderate | 632 |
| 7770974 | 7787507 | − | WAS | moderate | 633 |
| 7770974 | 7787507 | − | WAS | moderate | 634 |
| 147079847 | 147091979 | − | ALAS2 | moderate | 635 |
| 96133100 | 96140245 | + | AR | moderate | 636 |
| 96237920 | 96265783 | + | ED1 = EDA | moderate | 637 |
| 7134422 | 7154618 | − | PQBP1 | moderate | 638 |
| 45806529 | 45807451 | − | OCRL | strong | 639 |
| 45806529 | 45807451 | − | OCRL | moderate | 640 |
| 12338584 | 12339240 | − | CSNB1 = NYX | strong | 641 |
| 12338584 | 12339240 | − | CSNB1 = NYX | moderate | 642 |
| 45764223 | 45810380 | − | OCRL | moderate | 643 |
| 7476797 | 7483890 | + | PQBP1 | moderate | 644 |
| 48368108 | 48371354 | − | NYS1 = FRMD7 | moderate | 645 |
| 137077642 | 137083063 | − | PRPS1 | moderate | 646 |
| 156380844 | 156412099 | + | PHKA2 | moderate | 647 |
| 71598672 | 71598963 | − | IKBKG | moderate | 648 |
| 71598672 | 71598963 | − | IKBKG | strong | 649 |
| 34427535 | 34443093 | − | OCRL | moderate | 650 |
| 5976972 | 6214566 | + | CLCN5 | moderate | 651 |
| 71188131 | 71212039 | − | AVPR2 | moderate | 652 |
| 7419731 | 7452410 | + | PQBP1 | moderate | 653 |
| 7419731 | 7452410 | + | PQBP1 | moderate | 654 |
| 91784323 | 91787522 | − | MRX1 = IQSEC2 | moderate | 655 |
| 9178432 | 91787522 | − | MRX1 = IQSEC2 | moderate | 656 |
| 101162901 | 101176626 | − | ABCB7 | moderate | 657 |
| 101162901 | 101176626 | − | ABCB7 | strong | 658 |
| 101272773 | 101396532 | − | ABCB7 | moderate | 659 |

TABLE VIII-continued lncRNAs for Mouse Ezh2 binding sites

| Start | Finish | Strand | Disease Gene | Mod/Strong | SEQ ID NO: |
|---|---|---|---|---|---|
| 101272773 | 101396549 | − | ABCB7 | moderate | 660 |
| 103106842 | 103124685 | − | ATRX | moderate | 661 |
| 11623972 | 11657682 | − | CSNB1 = NYX | strong | 662 |
| 11623972 | 11657682 | − | CSNB1 = NYX | moderate | 663 |
| 11625208 | 11657693 | − | CSNB1 = NYX | strong | 664 |
| 11625208 | 11657693 | − | CSNB1 = NYX | moderate | 665 |
| 12254777 | 12339238 | − | CSNB1 = NYX | strong | 666 |
| 12254777 | 12339238 | − | CSNB1 = NYX | moderate | 667 |
| 130215559 | 130223532 | − | BTK | moderate | 668 |
| 130215559 | 130223532 | − | BTK | strong | 669 |
| 130470924 | 130516351 | − | BTK | moderate | 670 |
| 130470924 | 130516351 | − | BTK | strong | 671 |
| 13094206 | 13423886 | − | CSNB1 = NYX | moderate | 672 |
| 131120229 | 131122601 | + | BTK | moderate | 673 |
| 13129411 | 13423886 | − | CSNB1 = NYX | moderate | 674 |
| 13131747 | 13423893 | − | CSNB1 = NYX | moderate | 675 |
| 133535557 | 133572844 | − | TBG = SERPINA7 | moderate | 676 |
| 133535594 | 133572841 | − | OA1 = GPR143 | moderate | 677 |
| 133549811 | 133572838 | − | TBG = SERPINA7 | moderate | 678 |
| 133566334 | 133572841 | − | OA1 = GPR143 | moderate | 679 |
| 136541344 | 136597251 | − | PRPS1 | strong | 680 |
| 136541344 | 136597251 | − | PRPS1 | moderate | 681 |
| 137599946 | 137908628 | − | COL4A5 | moderate | 682 |
| 137909928 | 138123778 | + | COL4A5 | moderate | 683 |
| 137909928 | 138123778 | + | COL4A5 | moderate | 684 |
| 137909929 | 138123778 | + | COL4A5 | moderate | 685 |
| 137910111 | 138123773 | + | COL4A5 | moderate | 686 |
| 139285689 | 139401362 | − | COL4A5 | moderate | 687 |
| 139285689 | 139401386 | − | COL4A5 | moderate | 688 |
| 141880968 | 141939813 | − | COL4A5 | moderate | 689 |
| 143919223 | 143988699 | − | COL4A5 | moderate | 690 |
| 143943353 | 143988678 | − | COL4A5 | moderate | 691 |
| 148436388 | 148438986 | + | MPX1 = IQSEC2 | moderate | 692 |
| 149044052 | 149204222 | − | OA1 = GPR143 | moderate | 693 |
| 149057511 | 149204219 | − | OA1 = GPR143 | moderate | 694 |
| 149794275 | 149830825 | + | ALAS2 | moderate | 695 |
| 161381302 | 161418307 | − | PIGA | moderate | 696 |
| 162827965 | 162878637 | − | OFD1 | moderate | 697 |
| 19772151 | 19868953 | − | UBA1 | moderate | 698 |
| 20194629 | 20228027 | + | UBA1 | strong | 699 |
| 20194629 | 20228027 | + | UBA1 | moderate | 700 |
| 33735899 | 33739153 | + | COL4A5 | moderate | 701 |
| 34148309 | 34185415 | − | OCRL | moderate | 702 |
| 34148309 | 34185417 | − | OCRL | moderate | 703 |
| 34391130 | 34404168 | − | OCRL | moderate | 704 |
| 34631673 | 34650335 | − | OCRL | moderate | 705 |
| 34648901 | 34650347 | − | OCRL | moderate | 706 |
| 38754659 | 39031778 | + | OCRL | strong | 707 |
| 38754659 | 39031778 | + | OCRL | moderate | 708 |
| 39155509 | 39265102 | − | OCRL | moderate | 709 |
| 39166391 | 39265102 | − | OCRL | moderate | 710 |
| 45162547 | 45245729 | − | OCRL | moderate | 711 |
| 47139524 | 47150928 | − | NYS1 = FRMD7 | moderate | 712 |
| 50265390 | 50265600 | + | HPRT1 = HPRT | moderate | 713 |
| 57488638 | 57657223 | − | F9 | moderate | 714 |
| 57488638 | 57657479 | − | F9 | moderate | 715 |
| 58144545 | 58146615 | − | HPRT1 = HPRT | moderate | 716 |
| 58144545 | 58146615 | − | HPRT1 = HPRT | strong | 717 |
| 70682654 | 70704414 | − | ABCD1 | moderate | 718 |
| 71675010 | 71699193 | + | G6PD = G6PDX | moderate | 719 |
| 73030993 | 73120555 | − | COL4A5 | moderate | 720 |
| 7708468 | 7709984 | − | WAS | moderate | 721 |
| 7780134 | 7783651 | − | WAS | moderate | 722 |
| 99337055 | 99352458 | − | GJB1 | moderate | 723 |
| 99337055 | 99352453 | − | GJB1 | moderate | 724 |
| 99709314 | 99839595 | − | GJB1 | moderate | 725 |
| 100618468 | 100618584 | − | OA1 = GPR143 | moderate | 726 |
| 101531844 | 101543844 | − | OA1 = GPR143 | moderate | 727 |
| 101531844 | 101543844 | − | OA1 = GPR143 | moderate | 728 |
| 101541168 | 101543573 | − | OA1 = GPR143 | moderate | 729 |
| 10294443 | 10294862 | + | OTC | moderate | 730 |
| 110411861 | 110869443 | + | CHM | moderate | 731 |
| 126284360 | 126863066 | + | BTK | moderate | 732 |
| 126284360 | 126863066 | + | BTK | strong | 733 |
| 12648884 | 12649225 | + | CSNB1 = NYX | moderate | 734 |
| 12650018 | 12650277 | + | CSNB1 = NYX | moderate | 735 |
| 12655982 | 12656311 | + | CSNB1 = NYX | moderate | 736 |
| 130117402 | 130223532 | − | BTK | moderate | 737 |
| 130117402 | 130223532 | − | BTK | strong | 738 |
| 131004413 | 131009527 | − | BTK | moderate | 739 |
| 131223346 | 131231296 | + | GLA | moderate | 740 |
| 132330954 | 132331138 | + | GLA | moderate | 741 |
| 132331073 | 132331146 | + | GLA | moderate | 742 |
| 13290060 | 13290192 | − | OA1 = GPR143 | moderate | 743 |
| 133243165 | 133246017 | − | GLA | moderate | 744 |
| 134105558 | 135040850 | + | TBG = SERPINA7 | strong | 745 |
| 134105558 | 135040850 | + | TBG = SERPINA7 | moderate | 746 |
| 134105558 | 135040850 | + | TBG = SERPINA7 | strong | 747 |
| 134105558 | 135040850 | + | TBG = SERPINA7 | moderate | 748 |
| 136144963 | 136145837 | + | TBG = SERPINA7 | moderate | 749 |
| 136145906 | 136206280 | + | TBG = SERPINA7 | moderate | 750 |
| 136224009 | 136224144 | + | OA1 = GPR143 | moderate | 751 |
| 138062502 | 138063011 | + | OA1 = GPR143 | moderate | 752 |
| 138820850 | 138821158 | − | COL4A5 | moderate | 753 |
| 140098882 | 140100407 | + | COL4A5 | moderate | 754 |
| 140853218 | 141122546 | − | COL4A5 | strong | 755 |
| 140853218 | 141122546 | − | COL4A5 | moderate | 756 |
| 140989754 | 140990880 | − | XK | moderate | 757 |
| 147242402 | 147242529 | − | ALAS2 | moderate | 758 |
| 147481431 | 147502847 | + | FDG1 | moderate | 759 |
| 147481431 | 147521724 | + | FDG1 | moderate | 760 |
| 147481431 | 147521724 | + | FDG1 | moderate | 761 |
| 148444127 | 148450813 | − | MRX1 = IQSEC2 | moderate | 762 |
| 148444127 | 148450813 | − | MRX1 = IQSEC2 | moderate | 763 |
| 148451529 | 148451804 | + | MRX1 = IQSEC2 | moderate | 764 |
| 153915277 | 153915525 | − | PHEX | moderate | 765 |
| 157241673 | 157241983 | − | RS1 | moderate | 766 |
| 157573079 | 157573160 | + | OA1 = GPR143 | moderate | 767 |
| 160391523 | 160396094 | − | PIGA | moderate | 768 |
| 163790030 | 163820681 | − | SEDL = RAPPC2 | moderate | 769 |
| 163810341 | 163820642 | − | SEDL = RAPPC2 | moderate | 770 |
| 163810341 | 163820642 | − | SEDL = RAPPC2 | moderate | 771 |
| 17135024 | 17148750 | − | NDP | moderate | 772 |
| 20003237 | 20003672 | − | UBA1 | moderate | 773 |
| 20194911 | 20226322 | + | UBA1 | strong | 774 |
| 20194911 | 20226322 | + | UBA1 | moderate | 775 |
| 20194911 | 20226322 | + | UBA1 | strong | 776 |
| 20194911 | 20226322 | + | UBA1 | moderate | 777 |
| 33868348 | 33902336 | + | COL4A5 | strong | 778 |
| 33868348 | 33902336 | + | COL4A5 | moderate | 779 |
| 33868348 | 33902336 | + | COL4A5 | strong | 780 |
| 33868348 | 33902336 | + | COL4A5 | moderate | 781 |
| 34139837 | 34139989 | + | OCRL | moderate | 782 |
| 35600278 | 35604805 | − | OCRL | strong | 783 |
| 35600278 | 35604805 | − | OCRL | moderate | 784 |
| 35897792 | 35917936 | − | OCRL | moderate | 785 |
| 35961900 | 35966603 | + | OCRL | moderate | 786 |
| 38754659 | 38966731 | + | OCRL | strong | 787 |
| 38754659 | 38966731 | + | OCRL | moderate | 788 |
| 39264775 | 39265078 | − | OCRL | moderate | 789 |
| 45227508 | 45245609 | − | OCRL | moderate | 790 |
| 45694535 | 45761226 | + | OCRL | strong | 791 |
| 45694535 | 45761226 | + | OCRL | moderate | 792 |
| 45695238 | 45746514 | + | OCRL | strong | 793 |
| 45695238 | 45746514 | + | OCRL | moderate | 794 |
| 45696947 | 45761226 | + | OCRL | strong | 795 |
| 45696947 | 45761226 | + | OCRL | moderate | 796 |
| 45697574 | 45698600 | + | OCRL | strong | 797 |
| 45697574 | 45698600 | + | OCRL | moderate | 798 |
| 45976926 | 46005231 | + | OCRL | moderate | 799 |
| 46838852 | 46848439 | + | NYS1 = FRMD7 | moderate | 800 |
| 46838852 | 46848438 | + | NYS1 = FRMD7 | moderate | 801 |
| 49029960 | 49034525 | − | NYS1 = FRMD7 | strong | 802 |
| 49029960 | 49034525 | − | NYS1 = FRMD7 | moderate | 803 |
| 49033169 | 49033742 | − | NYS1 = FRMD7 | strong | 804 |
| 49033169 | 49033742 | − | NYS1 = FRMD7 | moderate | 805 |
| 49033355 | 49034263 | − | NYS1 = FRMD7 | strong | 806 |
| 49033355 | 49034263 | − | NYS1 = FRMD7 | moderate | 807 |

TABLE VIII-continued lncRNAs for Mouse Ezh2 binding sites

| Start | Finish | Strand | Disease Gene | Mod/Strong | SEQ ID NO: |
|---|---|---|---|---|---|
| 49775584 | 49775692 | − | HPRT1 = HPRT | moderate | 808 |
| 53838689 | 53851246 | − | HPRT1 = HPRT | moderate | 809 |
| 54644626 | 54644698 | − | HPRT1 = HPRT | moderate | 810 |
| 54644626 | 54644698 | − | HPRT1 = HPRT | moderate | 811 |
| 56316667 | 56386391 | − | F9 | moderate | 812 |
| 56421226 | 56421304 | − | F9 | moderate | 813 |
| 57392756 | 57392833 | − | OA1 = GPR143 | moderate | 814 |
| 57761975 | 57762010 | − | OA1 = GPR143 | moderate | 815 |
| 5977553 | 5977692 | + | CLCN5 | moderate | 816 |
| 65932068 | 65932563 | + | FMR1 | moderate | 817 |
| 65932227 | 65932774 | + | FMR1 | moderate | 818 |
| 67712928 | 67730355 | − | MTM1 | moderate | 819 |
| 67716098 | 67730317 | − | MTM1 | moderate | 820 |
| 68809408 | 68809659 | + | MTM1 | moderate | 821 |
| 68809643 | 68809983 | + | MTM1 | moderate | 822 |
| 68809715 | 68813851 | + | MTM1 | moderate | 823 |
| 68917141 | 68920567 | + | MTM1 | moderate | 824 |
| 68917141 | 68920567 | + | MTM1 | strong | 825 |
| 68917141 | 68920567 | + | MTM1 | moderate | 826 |
| 68917141 | 68920567 | + | MTM1 | strong | 827 |
| 69062152 | 69066323 | + | MTM1 | moderate | 828 |
| 69062152 | 69066323 | + | MTM1 | moderate | 829 |
| 69514307 | 69520142 | − | MTM1 | moderate | 830 |
| 69519852 | 69520142 | − | MTM1 | moderate | 831 |
| 70232678 | 70276882 | + | ABCD1 | moderate | 832 |
| 70232678 | 70276882 | + | ABCD1 | moderate | 833 |
| 70232678 | 70276882 | + | ABCD1 | moderate | 834 |
| 70232678 | 70276882 | + | ABCD1 | moderate | 835 |
| 70659581 | 70659693 | + | OA1 = GPR143 | moderate | 836 |
| 71167461 | 71171740 | − | AVPR2 | moderate | 837 |
| 71209543 | 71210333 | − | AVPR2 | moderate | 838 |
| 71491032 | 71491211 | − | EMD | moderate | 839 |
| 71491144 | 71491278 | − | EMD | moderate | 840 |
| 71500100 | 71501024 | + | EMD | moderate | 841 |
| 71528089 | 71533374 | + | EMD | moderate | 842 |
| 71528089 | 71535487 | + | EMD | moderate | 843 |
| 71528090 | 71535488 | + | EMD | moderate | 844 |
| 7215764 | 7224495 | + | PQBP1 | moderate | 845 |
| 72759656 | 72767094 | + | F8 | moderate | 846 |
| 73120309 | 73120521 | − | COL4A5 | moderate | 847 |
| 7418957 | 7453752 | + | PQBP1 | moderate | 848 |
| 75715283 | 75829194 | − | XK | moderate | 849 |
| 75715283 | 75829194 | − | XK | moderate | 850 |
| 75726052 | 75829121 | − | XK | moderate | 851 |
| 75726052 | 75829121 | − | XK | moderate | 852 |
| 75762644 | 75829230 | − | XK | moderate | 853 |
| 7706844 | 7709637 | − | WAS | moderate | 854 |
| 7731609 | 7753084 | − | WAS | moderate | 855 |
| 7731609 | 7753084 | − | WAS | moderate | 856 |
| 7731617 | 7753017 | − | WAS | moderate | 857 |
| 7767001 | 7770024 | − | WAS | moderate | 858 |
| 7767001 | 7770024 | − | WAS | moderate | 859 |
| 7770979 | 7783623 | − | WAS | moderate | 860 |
| 7770979 | 7783623 | − | WAS | moderate | 861 |
| 82819378 | 82820964 | + | DAX1 = NR0B1 | moderate | 862 |
| 91780815 | 91787329 | − | MRX1 = IQSEC2 | moderate | 863 |
| 9233402 | 9240129 | − | CYBB | moderate | 864 |
| 98835952 | 98836294 | + | GJB1 | moderate | 865 |
| 99750118 | 99839585 | − | GJB1 | moderate | 866 |

TABLE IX

Human LiftOver Ezh2 binding sites

| Start | Finish | Strand | Disease Gene | Mod/Strong | SEQ ID NO: |
|---|---|---|---|---|---|
| 38420746 | 38548056 | + | OTC | moderate | 867 |
| 38420761 | 38548175 | + | OTC | moderate | 868 |
| 73755234 | 73755237 | − | ABCB7 | moderate | 869 |
| 74145376 | 74145592 | − | ABCB7 | moderate | 870 |
| 38652969 | 38664787 | − | OTC | moderate | 871 |
| 38652969 | 38664787 | − | OTC | strong | 872 |
| 77422903 | 77423610 | − | PGK1 | moderate | 873 |
| 80065639 | 80068874 | + | PGK1 | moderate | 874 |
| 80065639 | 80068874 | + | PGK1 | moderate | 875 |
| 84498794 | 84521473 | + | CHM | moderate | 876 |
| 39547664 | 39547694 | − | OTC | moderate | 877 |
| 39646386 | 39646595 | − | OTC | moderate | 878 |
| 39646386 | 39646595 | − | OTC | moderate | 879 |
| 40595745 | 40649934 | + | CSNB1 = NYX | strong | 880 |
| 40595245 | 40649934 | + | CSNB1 = NYX | moderate | 881 |
| 95939805 | 95940396 | + | BTK | moderate | 882 |
| 95939805 | 95940396 | + | BTK | strong | 883 |
| 95939805 | 96319018 | + | BTK | moderate | 884 |
| 95939805 | 96319018 | + | BTK | strong | 885 |
| 40944519 | 40945909 | + | CSNB1 = NYX | moderate | 886 |
| 40944564 | 41082678 | + | CSNB1 = NYX | moderate | 887 |
| 40944564 | 41089870 | + | CSNB1 = NYX | moderate | 888 |
| 40944564 | 41100156 | + | CSNB1 = NYX | moderate | 889 |
| 1.01E+08 | 1.01E+08 | + | BTK | moderate | 890 |
| 1.01E+08 | 1.01E+08 | + | GLA | moderate | 891 |
| 1.02E+08 | 1.02E+08 | + | GLA | moderate | 892 |
| 1.02E+08 | 1.02E+08 | + | GLA | moderate | 893 |
| 1.02E+08 | 1.02E+08 | + | GLA | moderate | 894 |
| 1.05E+08 | 1.05E+08 | + | TBG = SERPINA7 | moderate | 895 |
| 1.05E+08 | 1.05E+08 | + | TBG = SERPINA7 | moderate | 896 |
| 1.05E+08 | 1.05E+08 | + | TBG = SERPINA7 | moderate | 897 |
| 1.06E+08 | 1.06E+08 | − | TBG = SERPINA7 | moderate | 898 |
| 1.06E+08 | 1.06E+08 | − | TBG = SERPINA7 | moderate | 899 |
| 1.06E+08 | 1.06E+08 | + | PRPS1 | moderate | 900 |
| 1.07E+08 | 1.07E+08 | + | PRPS1 | moderate | 901 |
| 1.07E+08 | 1.07E+08 | + | PRPS1 | moderate | 902 |
| 1.07E+08 | 1.07E+08 | − | PRPS1 | moderate | 903 |
| 1.07E+08 | 1.07E+08 | − | COL4A5 | moderate | 904 |
| 1.07E+08 | 1.08E+08 | − | COL4A5 | moderate | 905 |
| 1.1E+08 | 1.1E+08 | − | COL4A5 | moderate | 906 |
| 1.1E+08 | 1.1E+08 | + | COL4A5 | moderate | 907 |
| 54561410 | 54591707 | + | FGD1 | moderate | 908 |
| 54208636 | 54209706 | − | PHF8 | moderate | 909 |
| 53963676 | 54070922 | − | PHF8 | moderate | 910 |
| 53963676 | 54070908 | − | PHF8 | moderate | 911 |
| 53963676 | 54070908 | − | PHF8 | moderate | 912 |
| 54070048 | 54070616 | + | PHF8 | moderate | 913 |
| 53577614 | 53713695 | − | MRX1 = IQSEC2 | moderate | 914 |
| 53405849 | 53449660 | − | MRX1 = IQSEC2 | moderate | 915 |
| 53405849 | 53449660 | − | MRX1 = IQSEC2 | moderate | 916 |
| 53283545 | 53350548 | − | MRX1 = IQSEC2 | strong | 917 |
| 53283545 | 53350548 | − | MRX1 = IQSEC2 | moderate | 918 |
| 53111515 | 53117727 | + | MRX1 = IQSEC2 | moderate | 919 |
| 53111515 | 53117727 | + | MRX1 = IQSEC2 | moderate | 920 |
| 53111515 | 53117777 | + | MRX1 = IQSEC2 | moderate | 921 |
| 55513030 | 55516285 | − | ALAS2 | moderate | 922 |
| 57095072 | 57097138 | − | ALAS2 | moderate | 923 |
| 23722764 | 23761432 | − | SAT = SAT1 | moderate | 924 |
| 23761017 | 23761415 | − | SAT = SAT1 | moderate | 925 |
| 23760757 | 23761407 | − | SAT = SAT1 | moderate | 926 |
| 20039469 | 20137382 | − | PHKA2 | moderate | 927 |
| 19550319 | 19905867 | − | PHKA2 | moderate | 928 |
| 17673951 | 17674501 | − | CC = NHS | strong | 929 |
| 17673951 | 17674501 | − | CC = NHS | moderate | 930 |
| 17673951 | 17674501 | − | CC = NHS | strong | 931 |
| 17673951 | 17674501 | − | CC = NHS | moderate | 932 |
| 16737682 | 16754364 | + | CC = NHS | moderate | 933 |
| 15872785 | 15873088 | − | PIGA | strong | 934 |
| 15872785 | 15873088 | − | PIGA | moderate | 935 |
| 15848182 | 15873081 | − | PIGA | strong | 936 |
| 15848182 | 15873081 | − | PIGA | moderate | 937 |
| 43514157 | 43514486 | − | NDP | moderate | 938 |
| 43515447 | 43595516 | + | NDP | moderate | 939 |
| 13671391 | 13671542 | − | SEDL = TRAPPC2 | moderate | 940 |
| 12809471 | 12837836 | + | SEDL = TRAPPC2 | moderate | 941 |
| 46433208 | 46434914 | + | UBA1 | strong | 942 |
| 46433208 | 46434914 | + | UBA1 | moderate | 943 |

TABLE IX-continued

Human LiftOver Ezh2 binding sites

| Start | Finish | Strand | Disease Gene | Mod/Strong | SEQ ID NO: |
|---|---|---|---|---|---|
| 46433208 | 46457778 | + | UBA1 | strong | 944 |
| 46433208 | 46457778 | − | UBA1 | moderate | 945 |
| 46772015 | 46772258 | + | UBA1 | moderate | 946 |
| 47004091 | 47041189 | + | UBA1 | strong | 947 |
| 47004091 | 47041189 | + | UBA1 | moderate | 948 |
| 47092379 | 47103954 | + | UBA1 | moderate | 949 |
| 1.18E+08 | 1.18E+08 | + | COL4A5 | moderate | 950 |
| 1.18E+08 | 1.18E+08 | + | COL4A5 | moderate | 951 |
| 1.18E+08 | 1.18E+08 | − | COL4A5 | moderate | 952 |
| 1.18E+08 | 1.18E+08 | + | COL4A5 | strong | 953 |
| 1.18E+08 | 1.18E+08 | + | COL4A5 | moderate | 954 |
| 1.18E+08 | 1.18E+08 | + | OCRL | moderate | 955 |
| 1.18E+08 | 1.18E+08 | − | OCRL | moderate | 956 |
| 1.19E+08 | 1.19E+08 | − | OCRL | moderate | 957 |
| 1.19E+08 | 1.19E+08 | − | OCRL | moderate | 958 |
| 1.19E+08 | 1.19E+08 | + | OCRL | moderate | 959 |
| 1.19E+08 | 1.19E+08 | + | OCRL | moderate | 960 |
| 1.19E+08 | 1.19E+08 | + | OCRL | moderate | 961 |
| 1.19E+08 | 1.19E+08 | + | OCRL | moderate | 962 |
| 1.19E+08 | 1.19E+08 | − | OCRL | moderate | 963 |
| 1.19E+08 | 1.19E+08 | − | OCRL | moderate | 964 |
| 1.18E+08 | 1.19E+08 | + | OCRL | moderate | 965 |
| 1.19E+08 | 1.19E+08 | + | OCRL | moderate | 966 |
| 1.22E+08 | 1.23E+08 | + | OCRL | strong | 967 |
| 1.22E+08 | 1.23E+08 | + | OCRL | moderate | 968 |
| 1.24E+08 | 1.24E+08 | − | OCRL | strong | 969 |
| 1.24E+08 | 1.24E+08 | − | OCRL | moderate | 970 |
| 1.24E+08 | 1.24E+08 | − | OCRL | strong | 971 |
| 1.24E+08 | 1.24E+08 | − | OCRL | moderate | 972 |
| 1.29E+08 | 1.29E+08 | − | OCRL | strong | 973 |
| 1.29E+08 | 1.29E+08 | − | OCRL | moderate | 974 |
| 1.29E+08 | 1.29E+08 | + | OCRL | strong | 975 |
| 1.29E+08 | 1.29E+08 | + | OCRL | moderate | 976 |
| 1.29E+08 | 1.31E+08 | + | OCRL | moderate | 977 |
| 1.31E+08 | 1.31E+08 | − | NYS1 = FRMD7 | moderate | 978 |
| 1.31E+08 | 1.31E+08 | − | NYS1 = FRMD7 | moderate | 979 |
| 1.31E+08 | 1.31E+08 | − | NYS1 = FRMD7 | moderate | 980 |
| 1.31E+08 | 1.31E+08 | − | NYS1 = FRMD7 | moderate | 981 |
| 1.31E+08 | 1.31E+08 | + | NYS1 = FRMD7 | moderate | 982 |
| 1.32E+08 | 1.32E+08 | − | NYS1 = FRMD7 | moderate | 983 |
| 1.32E+08 | 1.32E+08 | − | HPRT1 = HPRT | moderate | 984 |
| 1.32E+08 | 1.32E+08 | − | HPRT1 = HPRT | moderate | 985 |
| 1.33E+08 | 1.33E+08 | − | HPRT1 = HPRT | moderate | 986 |
| 1.33E+08 | 1.33E+08 | − | HPRT1 = HPRT | moderate | 987 |
| 1.33E+08 | 1.33E+08 | − | HPRT1 = HPRT | moderate | 988 |
| 1.33E+08 | 1.33E+08 | − | HPRT1 = HPRT | moderate | 989 |
| 1.33E+08 | 1.33E+38 | − | HPRT1 = HPRT | moderate | 990 |
| 1.33E+08 | 1.33E+08 | − | HPRT1 = HPRT | moderate | 991 |
| 1.34E+08 | 1.34E+08 | + | HPRT1 = HPRT | moderate | 992 |
| 1.34E+08 | 1.34E+08 | + | HPRT1 = HPRT | moderate | 993 |
| 1.34E+08 | 1.34E+08 | + | HPRT1 = HPRT | moderate | 994 |
| 1.34E+08 | 1.34E+08 | − | HPRT1 = HPRT | moderate | 995 |
| 1.34E+08 | 1.34E+08 | − | HPRT1 = HPRT | moderate | 996 |
| 1.34E+08 | 1.34E+08 | − | HPRT1 = HPRT | strong | 997 |
| 1.34E+08 | 1.34E+08 | − | HPRT1 = HPRT | moderate | 998 |
| 1.34E+08 | 1.34E+08 | − | HPRT1 = HPRT | strong | 999 |
| 1.34E+08 | 1.34E+08 | − | HPRT1 = HPRT | moderate | 1000 |
| 1.34E+08 | 1.34E+08 | − | HPRT1 = HPRT | strong | 1001 |
| 1.34E+08 | 1.34E+08 | − | HPRT1 = HPRT | moderate | 1002 |
| 1.34E+08 | 1.34E+08 | − | HPRT1 = HPRT | strong | 1003 |
| 1.34E+08 | 1.34E+08 | + | HPRT1 = HPRT | moderate | 1004 |
| 1.35E+08 | 1.35E+08 | + | HPRT1 = HPRT | moderate | 1005 |
| 1.35E+08 | 1.35E+08 | + | HPRT1 = HPRT | moderate | 1006 |
| 1.36E+08 | 1.36E+08 | − | HPRT1 = HPRT | moderate | 1007 |
| 1.37E+08 | 1.37E+08 | + | F9 | moderate | 1008 |
| 1.37E+08 | 1.37E+08 | + | F9 | strong | 1009 |
| 1.32E+08 | 1.32E+08 | − | HPRT1 = HPRT | moderate | 1010 |
| 1.39E+08 | 1.39E+08 | + | F9 | moderate | 1011 |
| 1.39E+08 | 1.39E+08 | + | F9 | moderate | 1012 |
| 1.39E+08 | 1.39E+08 | + | F9 | moderate | 1013 |
| 1.39E+08 | 1.39E+08 | + | F9 | moderate | 1014 |
| 1.4E+08 | 1.4E+08 | + | F9 | moderate | 1015 |
| 1.4E+08 | 1.4E+08 | + | F9 | strong | 1016 |
| 50143999 | 50213570 | − | CLCN5 | strong | 1017 |
| 50143999 | 50213570 | − | CLCN5 | moderate | 1018 |
| 1.47E+08 | 1.47E+08 | − | FMR1 | moderate | 1019 |
| 1.47E+08 | 1.47E+08 | + | FMR1 | moderate | 1020 |
| 1.47E+08 | 1.47E+08 | + | FMR1 | moderate | 1021 |
| 1.47E+08 | 1.47E+08 | + | FMR1 | moderate | 1022 |
| 1.49E+08 | 1.49E+08 | − | MTM1 | moderate | 1023 |
| 1.5E+08 | 1.5E+08 | − | MTM1 | moderate | 1024 |
| 1.5E+08 | 1.5E+08 | − | MTM1 | strong | 1025 |
| 1.5E+08 | 1.5E+08 | + | MTM1 | moderate | 1026 |
| 1.34E+08 | 1.34E+08 | + | HPRT1 = HPRT | moderate | 1027 |
| 49644159 | 49648485 | + | CLCN5 | moderate | 1028 |
| 49641851 | 49644052 | − | CLCN5 | moderate | 1029 |
| 1.52E+08 | 1.52E+08 | + | ABCD1 | moderate | 1030 |
| 1.53E+08 | 1.53E+08 | − | ABCD1 | moderate | 1031 |
| 1.53E+08 | 1.53E+08 | − | ABCD1 | moderate | 1032 |
| 1.53E+08 | 1.53E+08 | + | ABCD1 | strong | 1033 |
| 1.53E+08 | 1.53E+08 | + | ABCD1 | moderate | 1034 |
| 1.53E+08 | 1.53E+08 | − | L1CAM | moderate | 1035 |
| 1.53E+08 | 1.53E+08 | − | AVPR2 | moderate | 1036 |
| 1.54E+08 | 1.54E+08 | + | EMD | moderate | 1037 |
| 1.54E+08 | 1.54E+08 | + | EMD | moderate | 1038 |
| 1.54E+08 | 1.54E+08 | + | EMD | moderate | 1039 |
| 1.54E+08 | 1.54E+08 | + | EMD | moderate | 1040 |
| 1.49E+08 | −1.5E+08 | − | OA1 = GPR143 | moderate | 1041 |
| 1.49E+08 | 1.49E+08 | − | MTM1 | moderate | 1042 |
| 1.54E+08 | 1.54E+08 | + | EMD | moderate | 1043 |
| 1.54E+08 | 1.54E+08 | + | IKBKG | moderate | 1044 |
| 1.54E+08 | 1.54E+08 | + | IKBKG | moderate | 1045 |
| 1.54E+08 | 1.54E+08 | + | IKBKG | moderate | 1046 |
| 1.54E+08 | 1.54E+08 | + | F8 | moderate | 1047 |
| 1.15E+08 | 1.15E+08 | − | COL4A5 | moderate | 1048 |
| 1.15E+08 | 1.15E+08 | − | COL4A5 | moderate | 1049 |
| 48783029 | 48815641 | − | PQBP1 | moderate | 1050 |
| 48778055 | 48815149 | − | PQBP1 | moderate | 1051 |
| 48750837 | 48754815 | − | PQBP1 | moderate | 1052 |
| 48693572 | 48755112 | − | PQBP1 | moderate | 1053 |
| 48693572 | 48755112 | − | PQBP1 | moderate | 1054 |
| 48755060 | 48755074 | + | PQBP1 | moderate | 1055 |
| 48367347 | 48371257 | + | WAS | moderate | 1056 |
| 48367347 | 48371257 | − | WAS | moderate | 1057 |
| 34645190 | 34675419 | − | XK | moderate | 1058 |
| 34645190 | 34675419 | − | XK | moderate | 1059 |
| 34645190 | 34675419 | − | XK | moderate | 1060 |
| 34648788 | 34675385 | − | XK | moderate | 1061 |
| 30845559 | 30907504 | − | DAX1 = NR0B1 | moderate | 1062 |
| 30845559 | 30907504 | − | DAX1 = NR0B1 | moderate | 1063 |
| 30260253 | 30261290 | + | DAX1 = NR0B1 | moderate | 1064 |
| 37430765 | 37481482 | − | XK | moderate | 1065 |
| 24482937 | 24483410 | − | SAT = SAT1 | moderate. | 1066 |
| 51486509 | 51491404 | + | CLCN5 | moderate | 1067 |
| 51486509 | 51491404 | + | CLCN5 | strong | 1068 |
| 57931970 | 57936908 | + | ALAS2 | moderate | 1069 |
| 64887470 | 64961793 | + | AR | moderate | 1070 |
| 64887470 | 64961795 | + | AR | moderate | 1071 |
| 68048806 | 68061977 | + | ED1 = EDA | moderate | 1072 |
| 68048806 | 68061977 | + | ED1 = EDA | moderate | 1073 |
| 68233310 | 68233735 | + | ED1 = EDA | moderate | 1074 |
| 68316315 | 68357637 | − | ED1 = EDA | moderate | 1075 |
| 68316315 | 68351637 | − | ED1 = EDA | strong | 1076 |
| 68316315 | 68357637 | − | ED1 = EDA | moderate | 1077 |
| 68316315 | 68357637 | − | ED1 = EDA | strong | 1078 |
| 68724170 | 68724592 | + | ED1 = EDA | moderate | 1079 |
| 68724653 | 68724923 | − | ED1 = EDA | moderate | 1080 |
| 68724838 | 68724991 | + | ED1 = EDA | moderate | 1081 |
| 68835853 | 69179424 | + | ED1 = EDA | moderate | 1032 |
| 68835353 | 69259315 | + | ED1 = EDA | moderate | 1083 |
| 68835936 | 69259315 | + | ED1 = EDA | moderate | 1084 |
| 68835936 | 69259315 | + | ED1 = EDA | strong | 1085 |
| 69642906 | 69645256 | + | GJB1 | moderate | 1086 |
| 69642906 | 69645256 | + | GJB1 | moderate | 1087 |
| 69664586 | 69674956 | − | GJB1 | moderate | 1088 |
| 69664586 | 69686006 | − | GJB1 | moderate | 1089 |
| 69670135 | 69670233 | − | GJB1 | moderate | 1090 |
| 70316012 | 70323383 | + | GJB1 | moderate | 1091 |

TABLE IX-continued

Human LiftOver Ezh2 binding sites

| Start | Finish | Strand | Disease Gene | Mod/Strong | SEQ ID NO: |
|---|---|---|---|---|---|
| 70752905 | 70766316 | + | GJB1 | moderate | 1092 |
| 70152905 | 70766816 | + | GJB1 | strong | 1093 |
| 70752921 | 70766864 | + | GJB1 | moderate | 1094 |
| 70752921 | 70766864 | + | GJB1 | strong | 1095 |
| 70883692 | 70885694 | − | GJB1 | moderate | 1096 |
| 70883692 | 70885694 | − | GJB1 | moderate | 1097 |
| 71130717 | 71373136 | + | GJB1 | moderate | 1098 |
| 71130717 | 71373136 | + | GJB1 | moderate | 1099 |
| 71130717 | 71373136 | + | GJB1 | strong | 1100 |
| 71130720 | 71230692 | + | GJB1 | moderate | 1101 |
| 71130720 | 71230692 | + | GJB1 | strong | 1102 |
| 18443703 | 18646844 | + | CDKL5 | moderate | 1103 |
| 1.07E+08 | 1.07E+08 | − | PRPS1 | strong | 1104 |
| 1.07E+08 | 1.07E+08 | − | PRPS1 | moderate | 1105 |
| 1.37E+08 | 1.37E+08 | + | F9 | moderate | 1106 |
| 1.37E+08 | 1.37E+08 | + | F9 | moderate | 1107 |
| 1.37E+08 | 1.37E+08 | + | F9 | strong | 1108 |
| 1.07E+08 | 1.07E+08 | − | PRPS1 | moderate | 1109 |
| 1.07E+08 | 1.07E+08 | − | PRPS1 | moderate | 1110 |
| 1.3E+08 | 1.3E+08 | − | NYS1 = FRMD7 | moderate | 1111 |
| 18907129 | 18912300 | − | PHKA2 | moderate | 1112 |
| 1.37E+08 | 1.37E+08 | + | F9 | moderate | 1113 |
| 1.37E+08 | 1.37E+08 | + | F9 | strong | 1114 |
| 19934359 | 20009176 | − | PHKA2 | moderate | 1115 |
| 19934359 | 20009176 | − | PHKA2 | moderate | 1116 |
| 51486531 | 51491404 | + | CLCN5 | moderate | 1117 |
| 51486537 | 51491404 | + | CLCN5 | strong | 1118 |
| 39910507 | 40036404 | − | CSNB1 = NYX | strong | 1119 |
| 39910507 | 40036404 | − | CSNB1 = NYX | moderate | 1120 |
| 1.3E+08 | 1.3E+08 | − | NYS1 = FRMD7 | moderate | 1121 |
| 1.39E+08 | 1.39E+08 | − | F9 | moderate | 1122 |
| 40513127 | 40595044 | − | CSNB1 = NYX | strong | 1123 |
| 40513127 | 40595044 | − | CSNB1 = NYX | moderate | 1124 |
| 39910507 | 40005885 | − | CSNB1 = NYX | strong | 1125 |
| 39910507 | 40005885 | − | CSNB1 = NYX | moderate | 1126 |
| 1.14E+08 | 1.14E+08 | − | COL4A5 | moderate | 1127 |
| 1.35E+08 | 1.35E+08 | + | HPRT1 = HPRT | moderate | 1128 |
| 1.39E+08 | 1.39E+08 | − | F9 | moderate | 1129 |
| 61718666 | 61157125 | + | AR | moderate | 1130 |
| 67718666 | 67757125 | + | AR | moderate | 1131 |
| 1.24E+08 | 1.24E+08 | − | OCRL | strong | 1132 |
| 1.24E+08 | 1.24E+08 | − | OCRL | moderate | 1133 |
| 67913429 | 67945678 | + | ED1 = EDA | moderate | 1134 |
| 38660685 | 38665692 | − | OTC | moderate | 1135 |
| 1.01E+08 | 1.01E+08 | − | GLA | moderate | 1136 |
| 19968429 | 20009740 | − | PHKA2 | moderate | 1137 |
| 1.24E+08 | 1.24E+08 | − | OCRL | strong | 1138 |
| 1.24E+08 | 1.24E+08 | − | OCRL | moderate | 1139 |
| 48830738 | 48858649 | − | PQBP1 | moderate | 1140 |
| 48830738 | 48853649 | − | PQBP1 | moderate | 1141 |
| 48363330 | 48379198 | + | WAS | moderate | 1142 |
| 48363330 | 48379198 | + | WAS | moderate | 1143 |
| 54947223 | 54957868 | + | ALAS2 | moderate | 1144 |
| 67718666 | 67751756 | + | AR | moderate | 1145 |
| 67913429 | 67942045 | + | ED1 = EDA | moderate | 1146 |
| 49123140 | 49146158 | + | PQBP1 | moderate | 1147 |
| 1.29E+08 | 1.29E+08 | − | OCRL | strong | 1148 |
| 1.29E+08 | 1.29E+08 | − | OCRL | moderate | 1149 |
| 40594441 | 40595080 | − | CSNB1 = NYX | strong | 1150 |
| 40594441 | 40595080 | − | CSNB1 = NYX | moderate | 1151 |
| 1.29E+08 | 1.29E+08 | − | OCRL | moderate | 1152 |
| 48750337 | 48754315 | − | PQBP1 | moderate | 1153 |
| 1.31E+08 | 1.31E+08 | − | NYS1 = FRMD7 | moderate | 1154 |
| 1.07E+08 | 1.07E+08 | − | PRPS1 | moderate | 1155 |
| 19553529 | 19587588 | − | PHKA2 | moderate | 1156 |
| 1.54E+08 | 1.54E+08 | − | IKBKG | moderate | 1157 |
| 1.34E+08 | 1.54E+08 | − | IKBKG | strong | 1158 |
| 1.19E+08 | 1.19E+08 | − | OCRL | moderate | 1159 |
| 50336570 | 50551310 | − | CLCN5 | moderate | 1160 |
| 1.53E+08 | 1.53E+08 | − | AVPR2 | moderate | 1161 |
| 48779439 | 48814344 | − | PQBP1 | moderate | 1162 |
| 48779489 | 48814344 | − | PQBP1 | moderate | 1163 |
| 51636562 | 51639796 | + | MRX1 = IQSEC2 | moderate | 1164 |
| 51636562 | 51639796 | + | MRX1 = IQSEC2 | moderate | 1165 |
| 73816770 | 73834464 | − | ABCB7 | moderate | 1166 |
| 73816770 | 73834464 | − | ABCB7 | strong | 1167 |
| 73953408 | 74145290 | − | ABCB7 | moderate | 1168 |
| 73953408 | 74145305 | − | ABCB7 | moderate | 1169 |
| 76995795 | 77041698 | − | ATRX | moderate | 1170 |
| 39921386 | 39957214 | − | CSNB1 = NYX | strong | 1171 |
| 39921386 | 39957214 | − | CSNB1= NYX. | moderate | 1172 |
| 39922665 | 39957225 | − | CSNB1 = NYX | strong | 1173 |
| 39922665 | 39957225 | − | CSNB1 = NYX | moderate | 1174 |
| 40511131 | 40595078 | − | CSNB1 = NYX | strong | 1175 |
| 40511131 | 40595078 | − | CSNB1 = NYX | moderate | 1176 |
| 99657457 | 99665277 | − | BTK | moderate | 1177 |
| 99657457 | 99665277 | − | BTK | strong | 1178 |
| 99929475 | 99987138 | − | BTK | moderate | 1179 |
| 99929475 | 99987138 | − | BTK | strong | 1180 |
| 41374187 | 41782933 | − | CSNB1 = NYX | moderate | 1181 |
| 1.01E+08 | 1.01E+08 | + | BTK | moderate | 1182 |
| 41416196 | 41782933 | − | CSNB1 = NYX | moderate | 1183 |
| 41418781 | 41782940 | − | CSNB1 = NYX | moderate | 1184 |
| 1.03E+08 | 1.03E+08 | − | TBG = SERPINA7 | moderate | 1185 |
| 1.03E+08 | 0 | − | OA1 = GPR143 | moderate | 1186 |
| 1.03E+08 | 1.03E+08 | − | TBG = SERPINA7 | moderate | 1187 |
| 1.06E+08 | 1.06E+08 | − | PRPS1 | strong | 1188 |
| 1.06E+08 | 1.06E+08 | − | PRPS1 | moderate | 1189 |
| 1.07E+08 | 1.08E+08 | − | COL4A5 | moderate | 1190 |
| 1.08E+08 | 1.08E+08 | − | COL4A5 | moderate | 1191 |
| 1.08E+08 | 1.08E+08 | + | COL4A5 | moderate | 1192 |
| 1.08E+08 | 1.08E+08 | + | COL4A5 | moderate | 1193 |
| 1.08E+08 | 1.08E+08 | + | COL4A5 | moderate | 1194 |
| 1.09E+08 | 1.1E+08 | − | COL4A5 | moderate | 1195 |
| 1.09E+08 | 1.1E+08 | − | COL4A5 | moderate | 1196 |
| 1.12E+08 | 1.12E+08 | − | COL4A5 | moderate | 1197 |
| 1.14E+08 | 1.14E+08 | − | COL4A5 | moderate | 1198 |
| 1.14E+08 | 1.14E+08 | − | COL4A5 | moderate | 1199 |
| 53458207 | 53461346 | − | MRX1 = IQSEC2 | moderate | 1200 |
| 9754409 | 9917528 | + | OA1 = GPR143 | moderate | 1201 |
| 9754412 | 9901148 | + | OA1 = GPR143 | moderate | 1202 |
| 56259009 | 56314850 | − | ALAS2 | moderate | 1203 |
| 14891501 | 14934512 | + | PIGA | moderate | 1204 |
| 13752890 | 13788174 | + | OFD1 | moderate | 1205 |
| 46533672 | 46613615 | − | UBA1 | moderate | 1206 |
| 47004307 | 47046225 | + | UBA1 | strong | 1207 |
| 47004307 | 47046225 | + | UBA1 | moderate | 1208 |
| 1.18E+08 | 1.18E+08 | − | COL4A5 | moderate | 1209 |
| 1.18E+08 | 1.18E+08 | − | OCRL | moderate | 1210 |
| 1.13E+08 | 1.18E+08 | − | OCRL | moderate | 1211 |
| 1.19E+08 | 1.19E+08 | − | OCRL | moderate | 1212 |
| 1.19E+08 | 1.19E+08 | − | OCRL | moderate | 1213 |
| 1.19E+08 | 1.19E+08 | − | OCRL | moderate | 1214 |
| 1.22E+03 | 1.23E+08 | + | OCRL | strong | 1715 |
| 1.22E+08 | 1.23E+08 | + | OCRL | moderate | 1216 |
| 1.23E+08 | 1.23E+08 | − | OCRL | moderate | 1217 |
| 1.23E+08 | 1.23E+08 | − | OCRL | moderate | 1218 |
| 1.29E+08 | 1.29E+08 | − | OCRL | moderate | 1219 |
| 1.3E+08 | 1.3E+08 | − | NYS1 = FRMD7 | moderate | 1220 |
| 1.34E+08 | 1.34E+08 | + | HPRT1 = HPRT | moderate | 1221 |
| 1.39E+08 | 1.39E+08 | − | F9 | moderate | 1222 |
| 1.39E+08 | 1.39E+08 | − | F9 | moderate | 1223 |
| 1.34E+08 | 1.34E+08 | + | HPRT1 = HPRT | moderate | 1224 |
| 1.34E+08 | 1.34E+08 | + | HPRT1 = HPRT | strong | 1225 |
| 1.53E+08 | 1.53E+08 | − | ABCD1 | moderate | 1226 |
| 1.54E+08 | 1.54E+08 | + | G6PD = G6PDX | moderate | 1227 |
| 1.15E+08 | 1.15E+08 | + | COL4A5 | moderate | 1228 |
| 48455856 | 48457390 | + | WAS | moderate | 1229 |
| 48367347 | 48371257 | + | WAS | moderate | 1230 |
| 71423288 | 71458939 | − | GJB1 | moderate | 1231 |
| 71423288 | 71458939 | − | GJB1 | moderate | 1232 |
| 71798692 | 71934148 | − | GJB1 | moderate | 1233 |
| 38663247 | 38663699 | + | OTC | moderate | 1234 |
| 85403464 | 85999361 | + | CHM | moderate | 1235 |
| 95939886 | 96685244 | + | BTK | moderate | 1236 |
| 95939336 | 96635244 | + | BTK | strong | 1237 |
| 40944807 | 40945143 | + | CSNB1 = NYX | moderate | 1238 |
| 40945858 | 40946083 | + | CSNB1 = NYX | moderate | 1239 |

TABLE IX-continued

Human LiftOver Ezh2 binding sites

| Start | Finish | Strand | Disease Gene | Mod/Strong | SEQ ID NO: |
|---|---|---|---|---|---|
| 40950911 | 40950974 | + | CSNB1 = NYX | moderate | 1240 |
| 99546628 | 99665277 | − | BTK | moderate | 1241 |
| 99546628 | 99665277 | − | BTK | strong | 1242 |
| 1.01E+08 | 1.01E+08 | − | BTK | moderate | 1243 |
| 1.01E+08 | 1.01E+08 | + | GLA | moderate | 1244 |
| 1.02E+08 | 1.02E+08 | + | GLA | moderate | 1245 |
| 1.02E+08 | 1.02E+08 | + | GLA | moderate | 1246 |
| 1.03E+08 | 1.03E+08 | + | GLA | moderate | 1247 |
| 1.04E+08 | 1.05E+08 | + | TBG = SERPINA7 | strong | 1248 |
| 1.04E+08 | 1.05E+08 | + | TBG = SERPINA7 | moderate | 1249 |
| 1.04E+08 | 1.05E+08 | + | TBG = SERPINA7 | strong | 1250 |
| 1.04E+08 | 1.05E+08 | + | TBG = SERPINA7 | moderate | 1251 |
| 1.06E+08 | 1.06E+08 | + | TBG = SERPINA7 | moderate | 1252 |
| 1.06E+08 | 1.06E+08 | + | TBG = SERPINA7 | moderate | 1253 |
| 1.09E+08 | 1.09E+08 | − | COL4A5 | moderate | 1254 |
| 1.1E+08 | 1.1E+08 | + | COL4A5 | moderate | 1255 |
| 1.11E+08 | 1.11E+08 | − | COL4A5 | strong | 1256 |
| 1.11E+08 | 1.11E+08 | − | COL4A5 | moderate | 1257 |
| 35820375 | 35821357 | + | XK | moderate | 1258 |
| 54840303 | 54840922 | + | ALAS2 | moderate | 1259 |
| 54475005 | 54522668 | − | FGD1 | moderate | 1260 |
| 54475005 | 54527668 | − | FGD1 | moderate | 1261 |
| 54475005 | 54522668 | − | FGD1 | moderate | 1262 |
| 53449811 | 53453282 | + | MRX1 = IQSEC2 | moderate | 1263 |
| 53449811 | 53453282 | + | MRX1 = IQSEC2 | moderate | 1264 |
| 53448837 | 53449093 | − | MRX1 = IQSEC2 | moderate | 1265 |
| 21975056 | 21975269 | + | PHEX | moderate | 1266 |
| 18651084 | 18651384 | + | RS1 | moderate | 1267 |
| 15808383 | 15822299 | + | PIGA | moderate | 1268 |
| 12809471 | 12837836 | + | SEDL = TRAPPC2 | moderate | 1269 |
| 12809525 | 12818878 | + | SEDL = TRAPPC2 | moderate | 1270 |
| 12809525 | 12818818 | + | SEDL = TRAPPC2 | moderate | 1271 |
| 44383408 | 44401509 | − | NDP | moderate | 1272 |
| 46772434 | 46772364 | + | UBA1 | moderate | 1273 |
| 47004623 | 47044505 | + | UBA1 | strong | 1274 |
| 47004623 | 47044506 | + | UBA1 | moderate | 1275 |
| 47004623 | 47044506 | + | UBA1 | strong | 1276 |
| 47004623 | 47044506 | + | UBA1 | moderate | 1277 |
| 1.18E+08 | 1.18E+08 | + | COL4A5 | strong | 1278 |
| 1.18E+08 | 1.18E+08 | + | COL4A5 | moderate | 1279 |
| 1.18E+08 | 1.18E+08 | + | COL4A5 | strong | 1280 |
| 1.18E+08 | 1.18E+08 | + | COL4A5 | moderate | 1281 |
| 1.18E+08 | 1.18E+08 | + | OCRL | moderate | 1282 |
| 1.19E+08 | 1.19E+08 | − | OCRL | strong | 1283 |
| 1.19E+08 | 1.19E+08 | − | OCRL | moderate | 1284 |
| 1.2E+08 | 1.2E+08 | − | OCRL | moderate | 1285 |
| 1.2E+08 | 1.2E+08 | + | OCRL | moderate | 1286 |
| 1.22E+08 | 1.23E+08 | + | OCRL | strong | 1287 |
| 1.22E+08 | 1.23E+08 | + | OCRL | moderate | 1288 |
| 1.23E+08 | 1.23E+08 | − | OCRL | moderate | 1289 |
| 1.29E+08 | 1.29E+08 | − | OCRL | moderate | 1290 |
| 1.29E+08 | 1.29E+08 | + | OCRL | strong | 1291 |
| 1.29E+08 | 1.29E+08 | + | OCRL | moderate | 1292 |
| 1.29E+08 | 1.29E+08 | + | OCRL | strong | 1293 |
| 1.29E+08 | 1.29E+08 | + | OCRL | moderate | 1294 |
| 1.29E+08 | 1.29E+08 | + | OCRL | strong | 1295 |
| 1.29E+08 | 1.29E+08 | + | OCRL | moderate | 1296 |
| 1.29E+08 | 1.29E+08 | + | OCRL | strong | 1297 |
| 1.29E+08 | 1.29E+08 | + | OCRL | moderate | 1298 |
| 1.29E+08 | 1.29E+08 | + | OCRL | moderate | 1299 |
| 1.3E+08 | 1.3E+08 | + | NYS1 = FRMD7 | moderate | 1300 |
| 1.3E+08 | 1.3E+08 | + | NYS1 = FRMD7 | moderate | 1301 |
| 1.32E+08 | 1.32E+08 | − | NYS1 = FRMD7 | strong | 1302 |
| 1.32E+08 | 1.32E+08 | − | NYS1 = FRMD7 | moderate | 1303 |
| 1.32E+08 | 1.32E+08 | − | NYS1 = FRMD7 | strong | 1304 |
| 1.32E+08 | 1.32E+08 | − | NYS1 = FRMD7 | moderate | 1305 |
| 1.32E+08 | 1.32E+08 | − | NYS1 = FRMD7 | strong | 1306 |
| 1.32E+08 | 1.32E+08 | − | NYS1 = FRMD7 | moderate | 1307 |
| 1.33E+08 | 1.38E+08 | − | HPRT1 = HPRT | moderate | 1308 |
| 1.35E+08 | 1.35E+08 | − | HPRT1 = HPRT | moderate | 1309 |
| 1.36E+08 | 1.36E+08 | − | HPRT1 = HPRT | moderate | 1310 |
| 1.36E+08 | 1.36E+08 | − | HPRT1 = HPRT | moderate | 1311 |
| 1.38E+08 | 1.38E+08 | − | F9 | moderate | 1312 |
| 1.38E+08 | 1.38E+08 | − | F9 | moderate | 1313 |
| 50556592 | 50556774 | − | CLCN5 | moderate | 1314 |
| 1.47E+08 | 1.47E+08 | + | FMR1 | moderate | 1315 |
| 1.47E+08 | 1.47E+08 | + | FMR1 | moderate | 1316 |
| 1.49E+08 | 1.49E+08 | − | MTM1 | moderate | 1317 |
| 1.49E+08 | 1.49E+08 | − | MTM1 | moderate | 1318 |
| 1.5E+08 | 1.5E+08 | + | MTM1 | moderate | 1319 |
| 1.5E+08 | 1.5E+08 | + | MTM1 | moderate | 1320 |
| 1.5E+08 | 1.5E+08 | + | MTM1 | moderate | 1321 |
| 1.5E+08 | 1.5E+08 | + | MTM1 | moderate | 1322 |
| 1.5E+08 | 1.5E+08 | + | MTM1 | strong | 1323 |
| 1.5E+08 | 1.5E+08 | + | MTM1 | moderate | 1324 |
| 1.5E+08 | 1.5E+08 | + | MTM1 | strong | 1325 |
| 1.51E+08 | 1.51E+08 | + | MTM1 | moderate | 1326 |
| 1.51E+08 | 1.51E+08 | + | MTM1 | moderate | 1327 |
| 1.51E+08 | 1.51E+08 | − | MTM1 | moderate | 1328 |
| 1.51E+08 | 1.51E+08 | − | MTM1 | moderate | 1329 |
| 1.52E+08 | 1.52E+08 | + | ABCD1 | moderate | 1330 |
| 1.52E+08 | 1.52E+08 | + | ABCD1 | moderate | 1331 |
| 1.32E+08 | 1.52E+08 | + | ABCD1 | moderate | 1332 |
| 1.52E+08 | 1.52E+08 | + | ABCD1 | moderate | 1333 |
| 1.53E+08 | 1.53E+08 | − | AVPR2 | moderate | 1334 |
| 1.53E+08 | 1.53E+08 | − | AVPR2 | moderate | 1335 |
| 1.54E+08 | 1.54E+08 | − | EMD | moderate | 1336 |
| 1.54E+08 | 1.54E+08 | − | EMD | moderate | 1337 |
| 1.54E+03 | 1.54E+08 | + | EMD | moderate | 1338 |
| 1.34E+08 | 1.54E+08 | + | EMD | moderate | 1339 |
| 1.54E+08 | 1.54E+08 | + | EMD | moderate | 1340 |
| 1.54E+08 | 1.54E+08 | + | EMD | moderate | 1341 |
| 49049104 | 49056698 | − | PQBP1 | moderate | 1342 |
| 1.54E+03 | 1.54E+08 | + | F8 | moderate | 1343 |
| 1.15E+08 | 1.15E+08 | + | COL4A5 | moderate | 1344 |
| 48778055 | 48815149 | − | PQBP1 | moderate | 1345 |
| 37208552 | 37301473 | + | XK | moderate | 1346 |
| 37208552 | 37301473 | + | XK | moderate | 1347 |
| 37208635 | 37293306 | + | XK | moderate | 1348 |
| 37208635 | 37293306 | + | XK | moderate | 1349 |
| 37208533 | 37269301 | + | XK | moderate | 1350 |
| 48436197 | 48458240 | + | WAS | moderate | 1351 |
| 48398062 | 48419602 | + | WAS | moderate | 1352 |
| 48398062 | 48419602 | + | WAS | moderate | 1353 |
| 48398130 | 48419594 | + | WAS | moderate | 1354 |
| 43330199 | 48382586 | + | WAS | moderate | 1355 |
| 48380199 | 48382586 | + | WAS | moderate | 1356 |
| 48367374 | 48379193 | + | WAS | moderate | 1357 |
| 48367374 | 48379193 | + | WAS | moderate | 1358 |
| 30905799 | 30907361 | − | DAX1 = NR0B1 | moderate | 1359 |
| 51636754 | 51645448 | + | MRX1 = IQSEC2 | moderate | 1360 |
| 37700168 | 37706872 | − | CYBB | moderate | 1361 |
| 70753491 | 70753347 | + | GJB1 | moderate | 1362 |
| 71838498 | 71934132 | − | GJB1 | moderate | 1363 |

Oligonucleotide drugs targeting the disease genes are designed using the reverse complement of the lncRNA sequence listed in the LncRNA Tables VI and VII.

Example 9

Targeting paRNAs to Treat X-linked Diseases

As described above, there are over 40 X-linked diseases associated with the presence of a mutation on the active X. These diseases would be treatable or even curable if the normal allele, present on the inactive X, could be reactivated. It would not be desirable to reactivate the entire X chromosome, as over-dosage could lead to other problems such as cancer. Thus, locus-specific reactivation is desirable, but the presence of many layers of heterochromatin may make this difficult using standard methods.

To determine whether locus-specific reactivation can be achieved by taking advantage of Polycomb spreading sites, reactivation of the Mecp2 gene was attempted.

Mecp2 mutations cause Rett syndrome, an autism spectrum disorder that is fatal in affected males and that results in autistic, progressive neurological symptoms, with regression of language and motor control, seizures, and respiratory diseases in females beginning at about 1-3 years of age. It is not a degenerative disease, and mouse models show that the condition is reversible if Mecp2 expression is restored postnatally, even after onset of symptoms (Guy et al., Science. 315(5815):1143-7 (2007)).

In mice, Mecp2 resides within a 5 mb gene-rich cluster. Using the methods described in Examples 1-8 above, strong and moderate PRC2 binding sites in the cluster were identified, There are 6 PRC2 strong sites or "spreading elements" for this gene cluster present in d0ES, d7 ES, and/or MEF, and over 170 PRC2 moderate sites. The PRC2 binding sites had paRNAs associated with them, as shown by methods outlined above in Tables VI and VII. Mecp2 has an antisense paRNA; the Mecp2 gene is on the − strand of the chromosome. See WO 2012/065143 and WO 2012/087983.

Three approaches were used to increase Mecp2 expression: first, targeting the Mecp2 antisense lncRNA; second, targeting the strong Polycomb binding sites in the region; and third, targeting both. Gapmer antisense oligos were designed to the small regions of interest. The selected regions for targeting the Polycomb sites were the transcripts crossing two strong binding sites closest to the Mecp2 gene, corresponding to seg_57 and seg_58 in Table IVA, above. For targeting the Mecp2 antisense, gapmers were designed against the antisense RNA that overlaps the gene body of Mecp2 region. The gapmers carried LNA bases at the ends and have full phosphorothioate backbone.

Mecp2-AS (antisense transcript)-targeting oligos were as shown in Table X; oligos targeting the PRC2 strong binding sites are shown in Table XL All sequences are shown 5'-3'.

TABLE X

| LNA | Sequence | SEQ ID NO: |
|---|---|---|
| LNA 17 | +AGA+TCA+GGA+TGT+AG+C-Phos | 1364 |
| LNA 22 | +T+C+AG*T*C*C*T*C*A*C+T+C+C-Phos | 1365 |

+indicates placement of LNA nucleotides;
*refers to phosphorothioate backbone

TABLE XI

| LNA | Sequence | SEQ ID NO: |
|---|---|---|
| | Segment 57 | |
| 57 plus-94-LNA A | CGGTGCCTAGCATGCA | 1366 |
| 57 minus-226-LNA B | GTTGATTGATAGGA | 1367 |
| 57 Plus-548-LNA E | TGGAAAGGAGGAGGTG | 1368 |
| 57 minus-857-LNA F | GTGTATGCGTGTGA | 1369 |
| | Segment 58 | |
| 58 Plus-614-LNA C | GAAAGGCACGAAGAG | 1370 |
| 58 minus-771-LNA D | GGATGCTTGAAACA | 1371 |

TABLE XI-continued

| LNA | Sequence | SEQ ID NO: |
|---|---|---|
| 58 Plus-549-LNA G | CCTTACCCCTCTAAAA | 1372 |
| 58 minus-381-LNA H | AGGAGCTTAAAGTGAG | 1373 |

To determine the ability of the selected oligos to reactivate Mecp2 from the inactive X chromosome, assays were carried out using genetically marked cells. An F1 mus/cas Mecp2:GFP reporter cell line was created as follows, Mecp2:GFP knock-in mice (M. musculus background [mus]) were crossed with wildtype Mus castancus [cas] male mice to generate F1 progeny in which the two X chromosomes can be distinguished by SNPs. Tail tip fibroblasts were outgrown and immortalized using SV40 large T antigen. Clones in which the Mecp2:GFP-bearing musculus X chromosome was inactivated were used for the X-reactivation assays.

Mecp2-GFP Xi cells derived from imortalized Tail tip Fibroblasts (as described above) were grown and passaged in standard Fibroblast HEPES buffered DMEM media with 10% Calf Serum and 1% Penicillin Streptomycin.

Each LNA from Exiqon A/S Vedbaek, Denmark was resuspended, from HPLC Purified Lyophilized powder, in DEPC treated water to make a 100 uM stock solution and a 10 uM working solution and both were stored at −20° C.

All transfections were done using Lipofectamine LTX and Plus reagent (Invitrogen Catalog #15338-100) in 24 well plates. Each transfection used a mix of three component mixtures that were made and then added to each well in the plate as follows:

1) Mix 1 consisted of: 50 ul of Optimem reduced Serum Medium (Gibco 31985-070)+3 ul of Lipofectamine LTX (Invitrogen Catalog #15338-100) and was added to and allowed to stand at room temperature for at least 5 minutes.

2) Mix 2 consisted of: 50 ul of Optimem LNA to 20-100 nM each +1.5 ul of Plus reagent from the Lipofectamine LTX kit. This mix was allowed to stand for 5 minutes at room temperature.

3) Mix 1 was added dropwise to Mix 2 and allowed to stand at room temperature for at least 5 minutes then 100 ul of this mixture was added dropwise to 400 ul DMEM FCS media containing $5 \times 10^4$ cells in suspension/well of a 24 well plate. Transfected plates of cells were in placed in the incubator, 37 C/5% CO2 for 24 hours.

Post transfection, cells from each well were harvested by trypsinization, spun into a pellet at 1000×g for 5 minutes and then lysed in 1 ml Trizol (Invitrogen 15596-026) to extract the RNA using reagent instructions. The RNA pellet was suspended in DEPC treated water and then DNA was removed using Ambion® TURBO™ DNase AM2238 which was inactivated using the inactivation beads supplied with the kit. RNA was converted to cDNA using SuperScript® Reverse Transcriptase from Invitrogen (Catalog #18080093). QPCR was performed in a 20 ul reaction volume using iQ™ SYBR® Green Supermix Catalog #170-8880 in Biorad CFX96 and CFX384 Real-Time PCR Detection System with the primers shown in Table XII below. All qPCR values are normalized to the housekeeping gene Gapdh.

TABLE XII

| Name | F/R | Sequence 5'-3' | SEQ ID NO: |
|---|---|---|---|
| GapdhBP1F | F | ATGAATACGGCTACAGCAACAGG | 1374 |
| GapdhBP1R | R | CTCTTGCTCAGTGTCCTTGCTG | 1375 |
| mMecp2 275852F AC-Mus | R | GCTTGCTACACAGCCATTAC | 1376 |
| mMecp2 275852F AT-Cast | R | GCTTGCTACACAGCCATTAT | 1377 |
| mMecp2 275852F | F | TAGAAGGCCCAGCACAAAGT | 1378 |

F, forward;
R, reverse

In the absence of any of the oligos, the Mecp2 allele of the active X was expressed at about 500 times the level of the allele on the inactive X.

FIG. 15A shows the results of treating the cells with each of the LNAs, singly or in combination. There was approximately 4-5× upregulation of expression after treating the cells pith LNA 22. Single oligos targeting the PRC2 binding site were also effective; see, e.g., C, D. The combination of oligos ABCD was also effective, oligos E, F, and G in combinations of two were mildly effective, but the EFG combination was exemplary, with approximately 41× upregulation. As shown in FIG. 15B, by comparison, expression of Mecp2 from the Castaneus X (active X) was less affected by the LNA transfections. Cas Xa may have some upregulation because the strong polycomb stations are also present on the Xa, Expression of a distant gene, GPC4 (which is about 20 Mb away from Mecp2) was also evaluated after treatment with the various oligos. Little to no upregulation was seen, providing evidence for the locus-specificity of the approach described herein.

To increase expression of mcp2 in human cells, e.g., cells in a living human, oligos are designed to target the human Mecp2-associated antisense lncRNA, the sequence of which is included herein as SEQ ID NO:10169. In some embodiments, oligos are designed that target a strong or moderate binding site in or near the MECP2 gene, e.g., as shown in table A.

Example 10

Human Allele-Specific ChIP-seq—Human paRNAs and PRC2 Binding Sites

Using the methods and criteria described above, PRC2 strong binding sites and their associated paRNAs were identified in two different human cell types cells by analysis of ChIP-scq data for SUZ12 and the catalytic subunit EZH2 in two cell lines, K562 (an erythroleukemia cell line) and GM12878 (a lymphoblastoid cell line). Accession numbers are:
SUZ12 in K562: wgEncodeEH00311:2(exp)/wgEncodeEH000052(input)
EZH2 in K562: wgEncodeEH002089 (exp)/wgEncodeEH000052(input),
EZH2 GM12878: wgEncodeE14003112 (exp)/wgEncodeEH000037(input))

In K562 cells, a total of 578 EZH2 strong sites were identified (Table XIII), and a total of 666 SUZ12 strong sites were found (Table XIV). In GM12878, 215 EZH2 strong sites were found (Table XV). These likely serve as spreading elements for silencing by PRC2 and by other chromatin modifiers. Shown in the Tables are (in column order): the start and end positions (base number on X-chromosome), segment number (name) for the strong EZH2 or SUZ12 site; and the sequence identifier (SEQ ID NO:). All coordinates refer to hg19. Table XIII sets forth the coordinates and SEQ NOs. for the EZH2 strong binding sites identified in K562 cells.

TABLE XIII

EZH2 in K562

| start | end | name | SEQ ID NO: |
|---|---|---|---|
| 372800 | 374450 | seg_1 | 1379 |
| 379550 | 383950 | seg_2 | 1380 |
| 387200 | 393050 | seg_3 | 1381 |
| 419950 | 421200 | seg_4 | 1382 |
| 425800 | 427350 | seg_5 | 1383 |
| 436400 | 439050 | seg_6 | 1384 |
| 458450 | 460500 | seg_7 | 1385 |
| 610100 | 614650 | seg_8 | 1386 |
| 631850 | 633750 | seg_9 | 1387 |
| 750450 | 752100 | seg_10 | 1388 |
| 920750 | 921950 | seg_11 | 1389 |
| 928850 | 930150 | seg_12 | 1390 |
| 961300 | 964500 | seg_13 | 1391 |
| 965950 | 967550 | seg_14 | 1392 |
| 977100 | 979150 | seg_15 | 1393 |
| 988950 | 996900 | seg_16 | 1394 |
| 1232150 | 1233250 | seg_17 | 1395 |
| 1235100 | 1236300 | seg_18 | 1396 |
| 1238350 | 1241400 | seg_19 | 1397 |
| 1324000 | 1325900 | seg_20 | 1398 |
| 1348200 | 1349900 | seg_21 | 1399 |
| 1392500 | 1394100 | seg_22 | 1400 |
| 1403850 | 1405100 | seg_23 | 1401 |
| 1460050 | 1461400 | seg_24 | 1402 |
| 1464650 | 1468000 | seg_25 | 1403 |
| 1672250 | 1674650 | seg_26 | 1404 |
| 1733950 | 1735600 | seg_27 | 1405 |
| 1747250 | 1749200 | seg_28 | 1406 |
| 2368950 | 2371350 | seg_29 | 1407 |
| 2374650 | 2376750 | seg_30 | 1408 |
| 2381200 | 2383650 | seg_31 | 1409 |
| 2391700 | 2394350 | seg_32 | 1410 |
| 2444150 | 2446650 | seg_33 | 1411 |
| 2451150 | 2452250 | seg_34 | 1412 |
| 2454950 | 2457000 | seg_35 | 1413 |
| 2461000 | 2462500 | seg_36 | 1414 |
| 2664000 | 2667450 | seg_37 | 1415 |
| 2669000 | 2672950 | seg_38 | 1416 |
| 2681550 | 2683000 | seg_39 | 1417 |
| 2684450 | 2685950 | seg_40 | 1418 |
| 2699450 | 2703000 | seg_41 | 1419 |
| 2854000 | 2856700 | seg_42 | 1420 |
| 2873200 | 2874800 | seg_43 | 1421 |
| 2876400 | 2879500 | seg_44 | 1422 |
| 2887500 | 2888650 | seg_45 | 1423 |
| 2936900 | 2938400 | seg_46 | 1424 |
| 2957200 | 2959050 | seg_47 | 1425 |
| 3466650 | 3467850 | seg_48 | 1426 |
| 3482000 | 3483150 | seg_49 | 1427 |
| 3507050 | 3508700 | seg_50 | 1428 |
| 3705050 | 3707200 | seg_51 | 1429 |
| 3708300 | 3710150 | seg_52 | 1430 |
| 3712800 | 3713800 | seg_53 | 1431 |
| 3724050 | 3726750 | seg_54 | 1432 |
| 9153950 | 9155700 | seg_55 | 1433 |
| 9229800 | 9231600 | seg_56 | 1434 |
| 9241950 | 9244700 | seg_57 | 1435 |
| 9246150 | 9248050 | seg_58 | 1436 |
| 9255400 | 9263150 | seg_59 | 1437 |
| 9268600 | 9269950 | seg_60 | 1438 |
| 9273550 | 9277500 | seg_61 | 1439 |
| 9371100 | 9382750 | seg_62 | 1440 |
| 9483500 | 9485050 | seg_63 | 1441 |
| 9793150 | 9794450 | seg_64 | 1442 |
| 9806050 | 9807500 | seg_65 | 1443 |
| 9814250 | 9818150 | seg_66 | 1444 |
| 9823350 | 9824550 | seg_67 | 1445 |
| 9863450 | 9867000 | seg_68 | 1446 |

TABLE XIII-continued

EZH2 in K562

| start | end | name | SEQ ID NO: |
|---|---|---|---|
| 9880300 | 9881950 | seg_69 | 1447 |
| 9883800 | 9885000 | seg_70 | 1448 |
| 9913900 | 9916050 | seg_71 | 1449 |
| 9929000 | 9930050 | seg_72 | 1450 |
| 10048550 | 10049650 | seg_73 | 1451 |
| 10180950 | 10182200 | seg_74 | 1452 |
| 10189550 | 10190550 | seg_75 | 1453 |
| 10405900 | 10406950 | seg_76 | 1454 |
| 10549850 | 10550950 | seg_77 | 1455 |
| 10575350 | 10576400 | seg_78 | 1456 |
| 10577550 | 10579300 | seg_79 | 1457 |
| 10587800 | 10589900 | seg_80 | 1458 |
| 10837250 | 10839150 | seg_81 | 1459 |
| 11358850 | 11360300 | seg_82 | 1460 |
| 11385800 | 11386800 | seg_83 | 1461 |
| 11478950 | 11480450 | seg_84 | 1462 |
| 11482700 | 11483900 | seg_85 | 1463 |
| 11735400 | 11736450 | seg_86 | 1464 |
| 12726850 | 12727900 | seg_87 | 1465 |
| 12750450 | 12751500 | seg_88 | 1466 |
| 12790000 | 12792000 | seg_89 | 1467 |
| 12793350 | 12796700 | seg_90 | 1468 |
| 12801350 | 12803400 | seg_91 | 1469 |
| 12995250 | 12996450 | seg_92 | 1470 |
| 13374100 | 13375150 | seg_93 | 1471 |
| 13450850 | 13452000 | seg_94 | 1472 |
| 13469850 | 13471200 | seg_95 | 1473 |
| 13476300 | 13477400 | seg_96 | 1474 |
| 13508450 | 13509700 | seg_97 | 1475 |
| 13587150 | 13589150 | seg_98 | 1476 |
| 13634850 | 13636950 | seg_99 | 1477 |
| 13800750 | 13802000 | seg_100 | 1478 |
| 13803050 | 13806050 | seg_101 | 1479 |
| 13820050 | 13821950 | seg_102 | 1480 |
| 13832300 | 13835750 | seg_103 | 1481 |
| 13917650 | 13919650 | seg_104 | 1482 |
| 13941900 | 13943750 | seg_105 | 1483 |
| 13954250 | 13956600 | seg_106 | 1484 |
| 13970300 | 13971650 | seg_107 | 1485 |
| 13982450 | 13985700 | seg_108 | 1486 |
| 14056900 | 14058300 | seg_109 | 1487 |
| 14082450 | 14083900 | seg_110 | 1488 |
| 14943900 | 14945100 | seg_111 | 1489 |
| 15286800 | 15288500 | seg_112 | 1490 |
| 15301150 | 15302150 | seg_113 | 1491 |
| 15321650 | 15322700 | seg_114 | 1492 |
| 15354950 | 15359650 | seg_115 | 1493 |
| 15382100 | 15387750 | seg_116 | 1494 |
| 15391300 | 15392750 | seg_117 | 1495 |
| 15661050 | 15663600 | seg_118 | 1496 |
| 16141650 | 16142650 | seg_119 | 1497 |
| 16548550 | 16550900 | seg_120 | 1498 |
| 16919800 | 16921600 | seg_121 | 1499 |
| 16927950 | 16929000 | seg_122 | 1500 |
| 16965250 | 16968400 | seg_123 | 1501 |
| 17028550 | 17029750 | seg_124 | 1502 |
| 17113350 | 17114550 | seg_125 | 1503 |
| 17749950 | 17751500 | seg_126 | 1504 |
| 17876650 | 17878250 | seg_127 | 1505 |
| 18211700 | 18212750 | seg_128 | 1506 |
| 18234150 | 18238350 | seg_129 | 1507 |
| 18249900 | 18251000 | seg_130 | 1508 |
| 18378400 | 18380050 | seg_131 | 1509 |
| 18382850 | 18383900 | seg_132 | 1510 |
| 18412350 | 18413650 | seg_133 | 1511 |
| 18416550 | 18418150 | seg_134 | 1512 |
| 18443550 | 18447600 | seg_135 | 1513 |
| 18451450 | 18452650 | seg_136 | 1514 |
| 18624850 | 18626400 | seg_137 | 1515 |
| 18651650 | 18653200 | seg_138 | 1516 |
| 18659400 | 18661000 | seg_139 | 1517 |
| 18663000 | 18664250 | seg_140 | 1518 |
| 18689000 | 18690200 | seg_141 | 1519 |
| 18694650 | 18696250 | seg_142 | 1520 |
| 18704800 | 18705850 | seg_143 | 1521 |
| 18814500 | 18815800 | seg_144 | 1522 |
| 18850450 | 18852300 | seg_145 | 1523 |
| 18858250 | 18862600 | seg_146 | 1524 |
| 18865700 | 18867200 | seg_147 | 1525 |
| 18891000 | 18894600 | seg_148 | 1526 |
| 19012650 | 19013750 | seg_149 | 1527 |
| 19038700 | 19039900 | seg_150 | 1528 |
| 19065750 | 19066850 | seg_151 | 1529 |
| 19141200 | 19142550 | seg_152 | 1530 |
| 19307900 | 19310300 | seg_153 | 1531 |
| 19348850 | 19352250 | seg_154 | 1532 |
| 19393250 | 19401800 | seg_155 | 1533 |
| 19415800 | 19417450 | seg_156 | 1534 |
| 19474150 | 19475400 | seg_157 | 1535 |
| 19554750 | 19556200 | seg_158 | 1536 |
| 19560350 | 19561400 | seg_159 | 1537 |
| 19570450 | 19571550 | seg_160 | 1538 |
| 19620350 | 19621400 | seg_161 | 1539 |
| 19638050 | 19639150 | seg_162 | 1540 |
| 19813200 | 19814750 | seg_163 | 1541 |
| 19817600 | 19819100 | seg_164 | 1542 |
| 19879900 | 19881050 | seg_165 | 1543 |
| 19883900 | 19887350 | seg_166 | 1544 |
| 19890300 | 19891400 | seg_167 | 1545 |
| 19894150 | 19895700 | seg_168 | 1546 |
| 19902750 | 19905650 | seg_169 | 1547 |
| 19922300 | 19923750 | seg_170 | 1548 |
| 20019400 | 20021100 | seg_171 | 1549 |
| 20041050 | 20042600 | seg_172 | 1550 |
| 20128750 | 20130450 | seg_173 | 1551 |
| 20288800 | 20290300 | seg_174 | 1552 |
| 20297600 | 20299550 | seg_175 | 1553 |
| 20311300 | 20312350 | seg_176 | 1554 |
| 20341300 | 20343100 | seg_177 | 1555 |
| 20350450 | 20352350 | seg_178 | 1556 |
| 20412250 | 20413300 | seg_179 | 1557 |
| 20427800 | 20429700 | seg_180 | 1558 |
| 20432100 | 20434300 | seg_181 | 1559 |
| 21924250 | 21925300 | seg_182 | 1560 |
| 22051000 | 22052100 | seg_183 | 1561 |
| 22073800 | 22074800 | seg_184 | 1562 |
| 23660850 | 23662600 | seg_185 | 1563 |
| 23774100 | 23775150 | seg_186 | 1564 |
| 24270650 | 24272400 | seg_187 | 1565 |
| 24276700 | 24278300 | seg_188 | 1566 |
| 24285100 | 24289350 | seg_189 | 1567 |
| 24328750 | 24333600 | seg_190 | 1568 |
| 24379500 | 24384800 | seg_191 | 1569 |
| 24483500 | 24485500 | seg_192 | 1570 |
| 24544700 | 24546050 | seg_193 | 1571 |
| 25026650 | 25045650 | seg_194 | 1572 |
| 25046800 | 25048550 | seg_195 | 1573 |
| 31007050 | 31009050 | seg_196 | 1574 |
| 31014200 | 31015250 | seg_197 | 1575 |
| 31022150 | 31023300 | seg_198 | 1576 |
| 37191850 | 37193450 | seg_199 | 1577 |
| 38037000 | 38038300 | seg_200 | 1578 |
| 38078450 | 38080750 | seg_201 | 1579 |
| 38195400 | 38197000 | seg_202 | 1580 |
| 38211800 | 38213050 | seg_203 | 1581 |
| 38475900 | 38477150 | seg_204 | 1582 |
| 38511700 | 38513450 | seg_205 | 1583 |
| 38537300 | 38539300 | seg_206 | 1584 |
| 39061650 | 39062900 | seg_207 | 1585 |
| 39551800 | 39553100 | seg_208 | 1586 |
| 39763900 | 39765400 | seg_209 | 1587 |
| 39775200 | 39777050 | seg_210 | 1588 |
| 40355900 | 40357500 | seg_211 | 1589 |
| 40389550 | 40391550 | seg_212 | 1590 |
| 40597850 | 40599200 | seg_213 | 1591 |
| 40869500 | 40870650 | seg_214 | 1592 |
| 41125350 | 41126800 | seg_215 | 1593 |
| 41167750 | 41169450 | seg_216 | 1594 |
| 41209650 | 41210900 | seg_217 | 1595 |
| 41814600 | 41816250 | seg_218 | 1596 |

TABLE XIII-continued

EZH2 in K562

| start | end | name | SEQ ID NO: |
|---|---|---|---|
| 43831100 | 43833350 | seg_219 | 1597 |
| 43888350 | 43890300 | seg_220 | 1598 |
| 44172850 | 44174600 | seg_221 | 1599 |
| 44538100 | 44539300 | seg_222 | 1600 |
| 45627800 | 45629350 | seg_223 | 1601 |
| 45708500 | 45709500 | seg_224 | 1602 |
| 46263300 | 46264350 | seg_225 | 1603 |
| 46465650 | 46466700 | seg_226 | 1604 |
| 46639450 | 46641100 | seg_227 | 1605 |
| 47125900 | 47127750 | seg_228 | 1606 |
| 47145650 | 47147250 | seg_229 | 1607 |
| 47232600 | 47233700 | seg_230 | 1608 |
| 47382350 | 47383400 | seg_231 | 1609 |
| 47542100 | 47544050 | seg_232 | 1610 |
| 47676000 | 47677900 | seg_233 | 1611 |
| 47981500 | 47983400 | seg_234 | 1612 |
| 48042250 | 48043650 | seg_235 | 1613 |
| 48045350 | 48046450 | seg_236 | 1614 |
| 48051300 | 48052550 | seg_237 | 1615 |
| 48063100 | 48065000 | seg_238 | 1616 |
| 48096650 | 48098100 | seg_239 | 1617 |
| 48155300 | 48156750 | seg_240 | 1618 |
| 48171500 | 48177300 | seg_241 | 1619 |
| 48288050 | 48289600 | seg_242 | 1620 |
| 48475350 | 48476950 | seg_243 | 1621 |
| 48511900 | 48513550 | seg_244 | 1622 |
| 49004850 | 49005850 | seg_245 | 1623 |
| 49420650 | 49421700 | seg_246 | 1624 |
| 49429000 | 49430200 | seg_247 | 1625 |
| 49463400 | 49464600 | seg_248 | 1626 |
| 49517800 | 49519800 | seg_249 | 1627 |
| 49594450 | 49595600 | seg_250 | 1628 |
| 51419250 | 51421950 | seg_251 | 1629 |
| 51423850 | 51425400 | seg_252 | 1630 |
| 51454600 | 51455900 | seg_253 | 1631 |
| 51458450 | 51460250 | seg_254 | 1632 |
| 51798900 | 51802500 | seg_255 | 1633 |
| 51935050 | 51936300 | seg_256 | 1634 |
| 51939700 | 51941850 | seg_257 | 1635 |
| 52543850 | 52545000 | seg_258 | 1636 |
| 52596350 | 52597600 | seg_259 | 1637 |
| 52603150 | 52604300 | seg_260 | 1638 |
| 52673200 | 52675150 | seg_261 | 1639 |
| 52713100 | 52714950 | seg_262 | 1640 |
| 52851450 | 52852550 | seg_263 | 1641 |
| 52854250 | 52855350 | seg_264 | 1642 |
| 52896900 | 52898050 | seg_265 | 1643 |
| 52996700 | 52998100 | seg_266 | 1644 |
| 53188000 | 53189350 | seg_267 | 1645 |
| 53347500 | 53352900 | seg_268 | 1646 |
| 53356450 | 53357750 | seg_269 | 1647 |
| 53360100 | 53362200 | seg_270 | 1648 |
| 53516400 | 53517800 | seg_271 | 1649 |
| 53759850 | 53761200 | seg_272 | 1650 |
| 53823250 | 53824350 | seg_273 | 1651 |
| 53842300 | 53844450 | seg_274 | 1652 |
| 54317850 | 54320600 | seg_275 | 1653 |
| 54386500 | 54387850 | seg_276 | 1654 |
| 54389200 | 54390400 | seg_277 | 1655 |
| 54495250 | 54496750 | seg_278 | 1656 |
| 55040550 | 55042350 | seg_279 | 1657 |
| 55142250 | 55144000 | seg_280 | 1658 |
| 55146600 | 55147900 | seg_281 | 1659 |
| 55209800 | 55211250 | seg_282 | 1660 |
| 55683550 | 55684650 | seg_283 | 1661 |
| 61880850 | 61882700 | seg_284 | 1662 |
| 64771000 | 64772400 | seg_285 | 1663 |
| 67652200 | 67654900 | seg_286 | 1664 |
| 68341700 | 68343050 | seg_287 | 1665 |
| 68353000 | 68354550 | seg_288 | 1666 |
| 68483250 | 68485150 | seg_289 | 1667 |
| 68525100 | 68526300 | seg_290 | 1668 |
| 68836050 | 68838050 | seg_291 | 1669 |
| 68918100 | 68920050 | seg_292 | 1670 |
| 69352950 | 69354000 | seg_293 | 1671 |
| 69697700 | 69699050 | seg_294 | 1672 |
| 70432400 | 70434300 | seg_295 | 1673 |
| 70436000 | 70437500 | seg_296 | 1674 |
| 70474400 | 70475600 | seg_297 | 1675 |
| 70877700 | 70883450 | seg_298 | 1676 |
| 70919900 | 70923050 | seg_299 | 1677 |
| 70926200 | 70950300 | seg_300 | 1678 |
| 70972100 | 70989450 | seg_301 | 1679 |
| 70992300 | 70994500 | seg_302 | 1680 |
| 70997850 | 70999500 | seg_303 | 1681 |
| 71003450 | 71005550 | seg_304 | 1682 |
| 71031900 | 71034450 | seg_305 | 1683 |
| 71094050 | 71095700 | seg_306 | 1684 |
| 71238100 | 71239150 | seg_307 | 1685 |
| 71261650 | 71263400 | seg_308 | 1686 |
| 71319750 | 71321300 | seg_309 | 1687 |
| 71348750 | 71353050 | seg_310 | 1688 |
| 71503150 | 71504200 | seg_311 | 1689 |
| 71512450 | 71513550 | seg_312 | 1690 |
| 71526450 | 71528800 | seg_313 | 1691 |
| 71945800 | 71946950 | seg_314 | 1692 |
| 71953450 | 71955300 | seg_315 | 1693 |
| 73398500 | 73400100 | seg_316 | 1694 |
| 73535100 | 73536450 | seg_317 | 1695 |
| 73638950 | 73640300 | seg_318 | 1696 |
| 73642000 | 73643200 | seg_319 | 1697 |
| 85339200 | 85340950 | seg_320 | 1698 |
| 100106050 | 100107200 | seg_321 | 1699 |
| 100119950 | 100121600 | seg_322 | 1700 |
| 100193650 | 100195150 | seg_323 | 1701 |
| 100471350 | 100473200 | seg_324 | 1702 |
| 100514900 | 100516350 | seg_325 | 1703 |
| 100532400 | 100533600 | seg_326 | 1704 |
| 101800900 | 101804000 | seg_327 | 1705 |
| 102378800 | 102380350 | seg_328 | 1706 |
| 102430600 | 102432050 | seg_329 | 1707 |
| 102530950 | 102533100 | seg_330 | 1708 |
| 102564900 | 102566400 | seg_331 | 1709 |
| 102584350 | 102585450 | seg_332 | 1710 |
| 102861350 | 102862700 | seg_333 | 1711 |
| 102917800 | 102919350 | seg_334 | 1712 |
| 103087250 | 103088400 | seg_335 | 1713 |
| 103166900 | 103168400 | seg_336 | 1714 |
| 103172500 | 103174800 | seg_337 | 1715 |
| 103216000 | 103218450 | seg_338 | 1716 |
| 103230800 | 103233250 | seg_339 | 1717 |
| 103253050 | 103254100 | seg_340 | 1718 |
| 103261650 | 103262700 | seg_341 | 1719 |
| 103301600 | 103303200 | seg_342 | 1720 |
| 103306050 | 103309200 | seg_343 | 1721 |
| 103311200 | 103312950 | seg_344 | 1722 |
| 103314600 | 103315800 | seg_345 | 1723 |
| 103355850 | 103358850 | seg_346 | 1724 |
| 103812100 | 103813500 | seg_347 | 1725 |
| 105065250 | 105066350 | seg_348 | 1726 |
| 105968700 | 105970600 | seg_349 | 1727 |
| 106044350 | 106046150 | seg_350 | 1728 |
| 106482900 | 106485150 | seg_351 | 1729 |
| 106748850 | 106751050 | seg_352 | 1730 |
| 106766500 | 106768400 | seg_353 | 1731 |
| 106839200 | 106841100 | seg_354 | 1732 |
| 106844750 | 106845950 | seg_355 | 1733 |
| 106857050 | 106858450 | seg_356 | 1734 |
| 106984400 | 106985900 | seg_357 | 1735 |
| 107012550 | 107013950 | seg_358 | 1736 |
| 107015700 | 107021050 | seg_359 | 1737 |
| 107067200 | 107071350 | seg_360 | 1738 |
| 107167050 | 107168350 | seg_361 | 1739 |
| 107318400 | 107320100 | seg_362 | 1740 |
| 107680300 | 107682050 | seg_363 | 1741 |
| 107800800 | 107802650 | seg_364 | 1742 |
| 108823900 | 108825300 | seg_365 | 1743 |
| 108842500 | 108844650 | seg_366 | 1744 |
| 109664500 | 109668200 | seg_367 | 1745 |
| 109675200 | 109677300 | seg_368 | 1746 |

TABLE XIII-continued

EZH2 in K562

| start | end | name | SEQ ID NO: |
|---|---|---|---|
| 109681600 | 109683350 | seg_369 | 1747 |
| 109687600 | 109689250 | seg_370 | 1748 |
| 109763200 | 109764700 | seg_371 | 1749 |
| 110037400 | 110040400 | seg_372 | 1750 |
| 110089850 | 110091400 | seg_373 | 1751 |
| 110338150 | 110339500 | seg_374 | 1752 |
| 111326550 | 111327950 | seg_375 | 1753 |
| 113342550 | 113344100 | seg_376 | 1754 |
| 113352150 | 113353850 | seg_377 | 1755 |
| 113418750 | 113420450 | seg_378 | 1756 |
| 113814950 | 113817950 | seg_379 | 1757 |
| 114206400 | 114207900 | seg_380 | 1758 |
| 114467100 | 114468700 | seg_381 | 1759 |
| 114956100 | 114958000 | seg_382 | 1760 |
| 117249800 | 117250800 | seg_383 | 1761 |
| 117862300 | 117863400 | seg_384 | 1762 |
| 117940450 | 117941800 | seg_385 | 1763 |
| 117956850 | 117963900 | seg_386 | 1764 |
| 117965550 | 117966650 | seg_387 | 1765 |
| 118052350 | 118054150 | seg_388 | 1766 |
| 118081300 | 118083250 | seg_389 | 1767 |
| 118109050 | 118110300 | seg_390 | 1768 |
| 118205950 | 118208800 | seg_391 | 1769 |
| 118212900 | 118215850 | seg_392 | 1770 |
| 118282850 | 118287450 | seg_393 | 1771 |
| 118346000 | 118349200 | seg_394 | 1772 |
| 118359850 | 118363400 | seg_395 | 1773 |
| 118366950 | 118370450 | seg_396 | 1774 |
| 118441450 | 118445300 | seg_397 | 1775 |
| 118449700 | 118451000 | seg_398 | 1776 |
| 118457400 | 118458500 | seg_399 | 1777 |
| 118475800 | 118478400 | seg_400 | 1778 |
| 118493600 | 118495250 | seg_401 | 1779 |
| 118496550 | 118498200 | seg_402 | 1780 |
| 118503050 | 118504750 | seg_403 | 1781 |
| 118513250 | 118514500 | seg_404 | 1782 |
| 118869150 | 118873850 | seg_405 | 1783 |
| 119086550 | 119088100 | seg_406 | 1784 |
| 119119400 | 119121600 | seg_407 | 1785 |
| 119123100 | 119136250 | seg_408 | 1786 |
| 119146350 | 119147850 | seg_409 | 1787 |
| 119149100 | 119157100 | seg_410 | 1788 |
| 119467950 | 119469350 | seg_411 | 1789 |
| 119504000 | 119505500 | seg_412 | 1790 |
| 119514900 | 119515950 | seg_413 | 1791 |
| 119865950 | 119867450 | seg_414 | 1792 |
| 120299600 | 120300600 | seg_415 | 1793 |
| 122316650 | 122320500 | seg_416 | 1794 |
| 122402300 | 122404250 | seg_417 | 1795 |
| 123373100 | 123375050 | seg_418 | 1796 |
| 124335350 | 124337600 | seg_419 | 1797 |
| 128781700 | 128784050 | seg_420 | 1798 |
| 128788300 | 128792400 | seg_421 | 1799 |
| 128811850 | 128813500 | seg_422 | 1800 |
| 128829500 | 128831000 | seg_423 | 1801 |
| 128834150 | 128836250 | seg_424 | 1802 |
| 128852750 | 128855450 | seg_425 | 1803 |
| 128996850 | 128998800 | seg_426 | 1804 |
| 129312750 | 129314600 | seg_427 | 1805 |
| 129429500 | 129430650 | seg_428 | 1806 |
| 129518000 | 129519450 | seg_429 | 1807 |
| 129685850 | 129687000 | seg_430 | 1808 |
| 130182350 | 130183950 | seg_431 | 1809 |
| 130192100 | 130193800 | seg_432 | 1810 |
| 130765450 | 130766550 | seg_433 | 1811 |
| 130814550 | 130815550 | seg_434 | 1812 |
| 131217450 | 131219600 | seg_435 | 1813 |
| 131226100 | 131227550 | seg_436 | 1814 |
| 131234500 | 131238250 | seg_437 | 1815 |
| 131552950 | 131554550 | seg_438 | 1816 |
| 131555800 | 131556900 | seg_439 | 1817 |
| 131706550 | 131707650 | seg_440 | 1818 |
| 133307050 | 133308100 | seg_441 | 1819 |
| 133367850 | 133369000 | seg_442 | 1820 |
| 133370100 | 133372950 | seg_443 | 1821 |
| 133751450 | 133752450 | seg_444 | 1822 |
| 133779700 | 133780700 | seg_445 | 1823 |
| 133810300 | 133811300 | seg_446 | 1824 |
| 133937450 | 133939000 | seg_447 | 1825 |
| 133984050 | 133985200 | seg_448 | 1826 |
| 133996850 | 133998300 | seg_449 | 1827 |
| 134096600 | 134097900 | seg_450 | 1828 |
| 134115350 | 134116650 | seg_451 | 1829 |
| 134141750 | 134143050 | seg_452 | 1830 |
| 134144200 | 134147750 | seg_453 | 1831 |
| 134153750 | 134155600 | seg_454 | 1832 |
| 134232350 | 134234600 | seg_455 | 1833 |
| 134262000 | 134263300 | seg_456 | 1834 |
| 134267150 | 134272000 | seg_457 | 1835 |
| 134313200 | 134319300 | seg_458 | 1836 |
| 134322900 | 134324600 | seg_459 | 1837 |
| 134342600 | 134344200 | seg_460 | 1838 |
| 134345900 | 134351900 | seg_461 | 1839 |
| 134368650 | 134375600 | seg_462 | 1840 |
| 134383050 | 134384100 | seg_463 | 1841 |
| 134557050 | 134558100 | seg_464 | 1842 |
| 134567350 | 134570450 | seg_465 | 1843 |
| 134582350 | 134583400 | seg_466 | 1844 |
| 134630300 | 134631800 | seg_467 | 1845 |
| 134725600 | 134726800 | seg_468 | 1846 |
| 134730400 | 134732000 | seg_469 | 1847 |
| 134841450 | 134843250 | seg_470 | 1848 |
| 134974900 | 134976100 | seg_471 | 1849 |
| 135142850 | 135149600 | seg_472 | 1850 |
| 135153750 | 135158600 | seg_473 | 1851 |
| 135164850 | 135166450 | seg_474 | 1852 |
| 135200900 | 135202500 | seg_475 | 1853 |
| 135227100 | 135229300 | seg_476 | 1854 |
| 135230550 | 135237050 | seg_477 | 1855 |
| 135238700 | 135240650 | seg_478 | 1856 |
| 135247650 | 135253150 | seg_479 | 1857 |
| 135255700 | 135257250 | seg_480 | 1858 |
| 135261000 | 135263500 | seg_481 | 1859 |
| 135278300 | 135279400 | seg_482 | 1860 |
| 135280500 | 135283000 | seg_483 | 1861 |
| 135286200 | 135288850 | seg_484 | 1862 |
| 135570450 | 135571950 | seg_485 | 1863 |
| 135573250 | 135575700 | seg_486 | 1864 |
| 135605150 | 135606400 | seg_487 | 1865 |
| 135623250 | 135624500 | seg_488 | 1866 |
| 135635700 | 135637100 | seg_489 | 1867 |
| 135700350 | 135703200 | seg_490 | 1868 |
| 135705250 | 135706450 | seg_491 | 1869 |
| 135736900 | 135741150 | seg_492 | 1870 |
| 136111350 | 136117550 | seg_493 | 1871 |
| 136134350 | 136135800 | seg_494 | 1872 |
| 136507400 | 136511500 | seg_495 | 1873 |
| 136629000 | 136633450 | seg_496 | 1874 |
| 136650650 | 136652500 | seg_497 | 1875 |
| 138637250 | 138639450 | seg_498 | 1876 |
| 138772500 | 138776000 | seg_499 | 1877 |
| 139024650 | 139025850 | seg_500 | 1878 |
| 139053450 | 139055300 | seg_501 | 1879 |
| 143224150 | 143226300 | seg_502 | 1880 |
| 148673150 | 148680900 | seg_503 | 1881 |
| 148682650 | 148684100 | seg_504 | 1882 |
| 148711650 | 148713850 | seg_505 | 1883 |
| 148735200 | 148736900 | seg_506 | 1884 |
| 148805000 | 148806550 | seg_507 | 1885 |
| 148826750 | 148829150 | seg_508 | 1886 |
| 148852950 | 148862150 | seg_509 | 1887 |
| 149108000 | 149109350 | seg_510 | 1888 |
| 149530200 | 149534000 | seg_511 | 1889 |
| 149646300 | 149649450 | seg_512 | 1890 |
| 149650500 | 149652300 | seg_513 | 1891 |
| 149673500 | 149676800 | seg_514 | 1892 |
| 149680400 | 149683100 | seg_515 | 1893 |
| 149691650 | 149693050 | seg_516 | 1894 |
| 150131750 | 150132800 | seg_517 | 1895 |
| 150134250 | 150137250 | seg_518 | 1896 |

TABLE XIII-continued

EZH2 in K562

| start | end | name | SEQ ID NO: |
|---|---|---|---|
| 150159250 | 150160300 | seg_519 | 1897 |
| 150256200 | 150257200 | seg_520 | 1898 |
| 150341400 | 150347800 | seg_521 | 1899 |
| 150394350 | 150398150 | seg_522 | 1900 |
| 150515800 | 150516800 | seg_523 | 1901 |
| 150721650 | 150722950 | seg_524 | 1902 |
| 150765850 | 150766900 | seg_525 | 1903 |
| 150827300 | 150828750 | seg_526 | 1904 |
| 150871800 | 150872900 | seg_527 | 1905 |
| 150911500 | 150912750 | seg_528 | 1906 |
| 150916300 | 150917600 | seg_529 | 1907 |
| 150941700 | 150943250 | seg_530 | 1908 |
| 151095050 | 151096600 | seg_531 | 1909 |
| 151989450 | 151991100 | seg_532 | 1910 |
| 152046300 | 152047500 | seg_533 | 1911 |
| 152051700 | 152053600 | seg_534 | 1912 |
| 152061800 | 152071500 | seg_535 | 1913 |
| 152072750 | 152074300 | seg_536 | 1914 |
| 152076150 | 152079750 | seg_537 | 1915 |
| 152101250 | 152104800 | seg_538 | 1916 |
| 152393100 | 152402450 | seg_539 | 1917 |
| 152522450 | 152523650 | seg_540 | 1918 |
| 152529100 | 152538150 | seg_541 | 1919 |
| 152565900 | 152567100 | seg_542 | 1920 |
| 152664400 | 152665900 | seg_543 | 1921 |
| 152749250 | 152750350 | seg_544 | 1922 |
| 152757900 | 152759300 | seg_545 | 1923 |
| 152786250 | 152787250 | seg_546 | 1924 |
| 152788650 | 152794100 | seg_547 | 1925 |
| 152800850 | 152804450 | seg_548 | 1926 |
| 152814800 | 152828650 | seg_549 | 1927 |
| 152830250 | 152836300 | seg_550 | 1928 |
| 152838450 | 152845550 | seg_551 | 1929 |
| 152868250 | 152873400 | seg_552 | 1930 |
| 152886950 | 152890650 | seg_553 | 1931 |
| 152892700 | 152894800 | seg_554 | 1932 |
| 152896000 | 152904000 | seg_555 | 1933 |
| 152929350 | 152932250 | seg_556 | 1934 |
| 153075300 | 153076350 | seg_557 | 1935 |
| 153078100 | 153079800 | seg_558 | 1936 |
| 153083600 | 153087450 | seg_559 | 1937 |
| 153088800 | 153098300 | seg_560 | 1938 |
| 153118550 | 153120150 | seg_561 | 1939 |
| 153123650 | 153124700 | seg_562 | 1940 |
| 153127450 | 153132350 | seg_563 | 1941 |
| 153150300 | 153151550 | seg_564 | 1942 |
| 153157700 | 153161200 | seg_565 | 1943 |
| 153162600 | 153164350 | seg_566 | 1944 |
| 153438400 | 153439700 | seg_567 | 1945 |
| 153455250 | 153457100 | seg_568 | 1946 |
| 153547800 | 153558950 | seg_569 | 1947 |
| 153829500 | 153833250 | seg_570 | 1948 |
| 153877100 | 153878700 | seg_571 | 1949 |
| 153883050 | 153884900 | seg_572 | 1950 |
| 153886450 | 153887600 | seg_573 | 1951 |
| 153979700 | 153981100 | seg_574 | 1952 |
| 154129300 | 154130500 | seg_575 | 1953 |
| 154214850 | 154216450 | seg_576 | 1954 |
| 154443300 | 154445000 | seg_577 | 1955 |
| 155118300 | 155119400 | seg_578 | 1956 |

Table XIV sets forth the hg19 coordinates and SEQ ID NOs, or the SUZ12 strong binding sites identified in K562.

TABLE XIV

SUZ12 in K562

| start | end | name | SEQ ID NO: |
|---|---|---|---|
| 169650 | 171500 | seg_1 | 1957 |
| 373150 | 374900 | seg_2 | 1958 |
| 376150 | 377150 | seg_3 | 1959 |
| 379350 | 383850 | seg_4 | 1960 |
| 385450 | 391000 | seg_5 | 1961 |
| 392750 | 393800 | seg_6 | 1962 |
| 397400 | 399300 | seg_7 | 1963 |
| 419800 | 421150 | seg_8 | 1964 |
| 426250 | 427400 | seg_9 | 1965 |
| 457200 | 458700 | seg_10 | 1966 |
| 605350 | 606900 | seg_11 | 1967 |
| 610200 | 612700 | seg_12 | 1968 |
| 751200 | 752650 | seg_13 | 1969 |
| 754300 | 755950 | seg_14 | 1970 |
| 843900 | 845100 | seg_15 | 1971 |
| 976900 | 978400 | seg_16 | 1972 |
| 989000 | 993500 | seg_17 | 1973 |
| 995100 | 996500 | seg_18 | 1974 |
| 1029100 | 1031050 | seg_19 | 1975 |
| 1240150 | 1241200 | seg_20 | 1976 |
| 1259600 | 1261050 | seg_21 | 1977 |
| 1329250 | 1330400 | seg_22 | 1978 |
| 1392750 | 1394000 | seg_23 | 1979 |
| 1397900 | 1399150 | seg_24 | 1980 |
| 1447300 | 1450000 | seg_25 | 1981 |
| 1464250 | 1469050 | seg_26 | 1982 |
| 1571500 | 1573550 | seg_27 | 1983 |
| 1589950 | 1591400 | seg_28 | 1984 |
| 1666750 | 1668400 | seg_29 | 1985 |
| 1736000 | 1737000 | seg_30 | 1986 |
| 1750100 | 1751300 | seg_31 | 1987 |
| 1776200 | 1777750 | seg_32 | 1988 |
| 2143700 | 2144900 | seg_33 | 1989 |
| 2441800 | 2442900 | seg_34 | 1990 |
| 2455900 | 2457600 | seg_35 | 1991 |
| 2499200 | 2503800 | seg_36 | 1992 |
| 2598050 | 2601800 | seg_37 | 1993 |
| 2608500 | 2610050 | seg_38 | 1994 |
| 2663650 | 2667050 | seg_39 | 1995 |
| 2685100 | 2686250 | seg_40 | 1996 |
| 2710300 | 2713050 | seg_41 | 1997 |
| 2718100 | 2719250 | seg_42 | 1998 |
| 2722300 | 2723400 | seg_43 | 1999 |
| 2985150 | 2986300 | seg_44 | 2000 |
| 3262450 | 3264450 | seg_45 | 2001 |
| 3705150 | 3706850 | seg_46 | 2002 |
| 3718850 | 3720100 | seg_47 | 2003 |
| 3836600 | 3837850 | seg_48 | 2004 |
| 4762000 | 4763100 | seg_49 | 2005 |
| 8433250 | 8434450 | seg_50 | 2006 |
| 9230300 | 9231800 | seg_51 | 2007 |
| 9245050 | 9246200 | seg_52 | 2008 |
| 9275350 | 9276800 | seg_53 | 2009 |
| 9291250 | 9292250 | seg_54 | 2010 |
| 9337400 | 9338550 | seg_55 | 2011 |
| 9372050 | 9382550 | seg_56 | 2012 |
| 9433800 | 9434800 | seg_57 | 2013 |
| 9465900 | 9467000 | seg_58 | 2014 |
| 9732550 | 9734250 | seg_59 | 2015 |
| 9754100 | 9755600 | seg_60 | 2016 |
| 9815800 | 9817450 | seg_61 | 2017 |
| 9861700 | 9864800 | seg_62 | 2018 |
| 9935000 | 9936000 | seg_63 | 2019 |
| 9943250 | 9944350 | seg_64 | 2020 |
| 9982300 | 9983400 | seg_65 | 2021 |
| 10066550 | 10068450 | seg_66 | 2022 |
| 10587800 | 10589000 | seg_67 | 2023 |
| 10995600 | 10996600 | seg_68 | 2024 |
| 11002150 | 11003400 | seg_69 | 2025 |
| 11317250 | 11318400 | seg_70 | 2026 |
| 11671200 | 11672400 | seg_71 | 2027 |
| 11681150 | 11684100 | seg_72 | 2028 |
| 11754000 | 11755100 | seg_73 | 2029 |
| 11778800 | 11779850 | seg_74 | 2030 |
| 12601150 | 12602900 | seg_75 | 2031 |
| 12791300 | 12794950 | seg_76 | 2032 |
| 12799050 | 12800050 | seg_77 | 2033 |

TABLE XIV-continued

SUZ12 in K562

| start | end | name | SEQ ID NO: |
|---|---|---|---|
| 12812950 | 12814100 | seg_78 | 2034 |
| 12857600 | 12858700 | seg_79 | 2035 |
| 12897150 | 12898350 | seg_80 | 2036 |
| 12993000 | 12994200 | seg_81 | 2037 |
| 13445800 | 13446850 | seg_82 | 2038 |
| 13503550 | 13504700 | seg_83 | 2039 |
| 13518050 | 13519350 | seg_84 | 2040 |
| 13587150 | 13589000 | seg_85 | 2041 |
| 13804100 | 13806050 | seg_86 | 2042 |
| 13834050 | 13835850 | seg_87 | 2043 |
| 13898100 | 13899500 | seg_88 | 2044 |
| 13955300 | 13956550 | seg_89 | 2045 |
| 14247250 | 14248400 | seg_90 | 2046 |
| 14596250 | 14597350 | seg_91 | 2047 |
| 14958750 | 14959900 | seg_92 | 2048 |
| 15134850 | 15135950 | seg_93 | 2049 |
| 15330250 | 15331650 | seg_94 | 2050 |
| 16488650 | 16489900 | seg_95 | 2051 |
| 16927400 | 16928750 | seg_96 | 2052 |
| 16967100 | 16968150 | seg_97 | 2053 |
| 17047350 | 17048350 | seg_98 | 2054 |
| 17793100 | 17794100 | seg_99 | 2055 |
| 17877100 | 17879400 | seg_100 | 2056 |
| 18001050 | 18002050 | seg_101 | 2057 |
| 18140450 | 18141600 | seg_102 | 2058 |
| 18179450 | 18180550 | seg_103 | 2059 |
| 18232100 | 18233200 | seg_104 | 2060 |
| 18236850 | 18239450 | seg_105 | 2061 |
| 18244700 | 18245900 | seg_106 | 2062 |
| 18442500 | 18445000 | seg_107 | 2063 |
| 18661950 | 18663150 | seg_108 | 2064 |
| 18667450 | 18668950 | seg_109 | 2065 |
| 18889600 | 18891200 | seg_110 | 2066 |
| 18892400 | 18894300 | seg_111 | 2067 |
| 18904350 | 18905750 | seg_112 | 2068 |
| 18931800 | 18932800 | seg_113 | 2069 |
| 19141050 | 19142200 | seg_114 | 2070 |
| 19285300 | 19286350 | seg_115 | 2071 |
| 19307300 | 19309350 | seg_116 | 2072 |
| 19349800 | 19351800 | seg_117 | 2073 |
| 19390850 | 19391950 | seg_118 | 2074 |
| 19395050 | 19396500 | seg_119 | 2075 |
| 19398600 | 19399850 | seg_120 | 2076 |
| 19504100 | 19505200 | seg_121 | 2077 |
| 19602850 | 19605250 | seg_122 | 2078 |
| 19627300 | 19628350 | seg_123 | 2079 |
| 19874700 | 19875850 | seg_124 | 2080 |
| 19904300 | 19906050 | seg_125 | 2081 |
| 20021350 | 20023050 | seg_126 | 2082 |
| 20099150 | 20100450 | seg_127 | 2083 |
| 20129200 | 20134650 | seg_128 | 2084 |
| 20159600 | 20160600 | seg_129 | 2085 |
| 20348600 | 20349750 | seg_130 | 2086 |
| 20366200 | 20367200 | seg_131 | 2087 |
| 21294850 | 21295950 | seg_132 | 2088 |
| 21991750 | 21992750 | seg_133 | 2089 |
| 22180550 | 22181700 | seg_134 | 2090 |
| 22537550 | 22538650 | seg_135 | 2091 |
| 22961950 | 22963000 | seg_136 | 2092 |
| 23093050 | 23094400 | seg_137 | 2093 |
| 23349300 | 23351100 | seg_138 | 2094 |
| 23412800 | 23413800 | seg_139 | 2095 |
| 23519800 | 23520850 | seg_140 | 2096 |
| 23889950 | 23891000 | seg_141 | 2097 |
| 23925150 | 23926350 | seg_142 | 2098 |
| 24147850 | 24148850 | seg_143 | 2099 |
| 24286700 | 24289050 | seg_144 | 2100 |
| 24301450 | 24303550 | seg_145 | 2101 |
| 24328700 | 24333250 | seg_146 | 2102 |
| 24379450 | 24382100 | seg_147 | 2103 |
| 24408550 | 24410100 | seg_148 | 2104 |
| 24504450 | 24505550 | seg_149 | 2105 |
| 24574200 | 24575400 | seg_150 | 2106 |
| 24644850 | 24646050 | seg_151 | 2107 |
| 25025650 | 25045000 | seg_152 | 2108 |
| 25046850 | 25048300 | seg_153 | 2109 |
| 25118300 | 25119350 | seg_154 | 2110 |
| 25302550 | 25303800 | seg_155 | 2111 |
| 26860050 | 26861050 | seg_156 | 2112 |
| 28053850 | 28054900 | seg_157 | 2113 |
| 30325950 | 30328550 | seg_158 | 2114 |
| 30797500 | 30798500 | seg_159 | 2115 |
| 30955050 | 30956300 | seg_160 | 2116 |
| 30992350 | 30993350 | seg_161 | 2117 |
| 31010750 | 31012250 | seg_162 | 2118 |
| 31691100 | 31692100 | seg_163 | 2119 |
| 33817650 | 33818700 | seg_164 | 2120 |
| 35897350 | 35898350 | seg_165 | 2121 |
| 37016650 | 37018000 | seg_166 | 2122 |
| 37064150 | 37065200 | seg_167 | 2123 |
| 37351000 | 37352100 | seg_168 | 2124 |
| 37733800 | 37734850 | seg_169 | 2125 |
| 38078900 | 38081100 | seg_170 | 2126 |
| 38663050 | 38664250 | seg_171 | 2127 |
| 38778550 | 38779750 | seg_172 | 2128 |
| 39021100 | 39022250 | seg_173 | 2129 |
| 39371550 | 39372650 | seg_174 | 2130 |
| 39382850 | 39383850 | seg_175 | 2131 |
| 39413850 | 39415500 | seg_176 | 2132 |
| 39458100 | 39459400 | seg_177 | 2133 |
| 39685600 | 39687150 | seg_178 | 2134 |
| 39740700 | 39741800 | seg_179 | 2135 |
| 39763700 | 39765450 | seg_180 | 2136 |
| 39843400 | 39844400 | seg_181 | 2137 |
| 39873150 | 39874450 | seg_182 | 2138 |
| 40027900 | 40029300 | seg_183 | 2139 |
| 40149800 | 40151100 | seg_184 | 2140 |
| 40263700 | 40265000 | seg_185 | 2141 |
| 40359650 | 40360750 | seg_186 | 2142 |
| 40375050 | 40376700 | seg_187 | 2143 |
| 40390200 | 40391900 | seg_188 | 2144 |
| 40602000 | 40603200 | seg_189 | 2145 |
| 40828200 | 40829350 | seg_190 | 2146 |
| 40890100 | 40891600 | seg_191 | 2147 |
| 41112400 | 41113550 | seg_192 | 2148 |
| 41306350 | 41307400 | seg_193 | 2149 |
| 41958050 | 41959450 | seg_194 | 2150 |
| 41983850 | 41985000 | seg_195 | 2151 |
| 42505050 | 42506050 | seg_196 | 2152 |
| 43471800 | 43472900 | seg_197 | 2153 |
| 43830050 | 43831700 | seg_198 | 2154 |
| 43964400 | 43965900 | seg_199 | 2155 |
| 44203200 | 44204350 | seg_200 | 2156 |
| 44997500 | 44998600 | seg_201 | 2157 |
| 46464100 | 46465450 | seg_202 | 2158 |
| 47127000 | 47128150 | seg_203 | 2159 |
| 47145550 | 47146800 | seg_204 | 2160 |
| 47175050 | 47176550 | seg_205 | 2161 |
| 47363250 | 47364350 | seg_206 | 2162 |
| 47371600 | 47373400 | seg_207 | 2163 |
| 47476800 | 47478350 | seg_208 | 2164 |
| 47595750 | 47596900 | seg_209 | 2165 |
| 47661850 | 47663050 | seg_210 | 2166 |
| 47984500 | 47985650 | seg_211 | 2167 |
| 48165350 | 48166500 | seg_212 | 2168 |
| 48175100 | 48176600 | seg_213 | 2169 |
| 48193350 | 48194400 | seg_214 | 2170 |
| 48199400 | 48200550 | seg_215 | 2171 |
| 48240000 | 48241200 | seg_216 | 2172 |
| 48828300 | 48829300 | seg_217 | 2173 |
| 48963250 | 48964250 | seg_218 | 2174 |
| 49029700 | 49030700 | seg_219 | 2175 |
| 49068450 | 49069750 | seg_220 | 2176 |
| 49074200 | 49075450 | seg_221 | 2177 |
| 49104450 | 49105650 | seg_222 | 2178 |
| 49409000 | 49410150 | seg_223 | 2179 |
| 49420300 | 49421700 | seg_224 | 2180 |
| 49551450 | 49552750 | seg_225 | 2181 |
| 49906350 | 49907600 | seg_226 | 2182 |
| 49917850 | 49919100 | seg_227 | 2183 |

TABLE XIV-continued

SUZ12 in K562

| start | end | name | SEQ ID NO: |
|---|---|---|---|
| 50213900 | 50215200 | seg_228 | 2184 |
| 50450650 | 50451850 | seg_229 | 2185 |
| 50555600 | 50557750 | seg_230 | 2186 |
| 50694600 | 50695650 | seg_231 | 2187 |
| 50918150 | 50919200 | seg_232 | 2188 |
| 51126600 | 51128150 | seg_233 | 2189 |
| 51316600 | 51317600 | seg_234 | 2190 |
| 51419250 | 51420500 | seg_235 | 2191 |
| 51424500 | 51426000 | seg_236 | 2192 |
| 51452900 | 51456150 | seg_237 | 2193 |
| 51458700 | 51460100 | seg_238 | 2194 |
| 51545600 | 51546650 | seg_239 | 2195 |
| 51800050 | 51801050 | seg_240 | 2196 |
| 51805500 | 51812400 | seg_241 | 2197 |
| 51929300 | 51932300 | seg_242 | 2198 |
| 51935000 | 51936100 | seg_243 | 2199 |
| 51939150 | 51940750 | seg_244 | 2200 |
| 52239900 | 52241050 | seg_245 | 2201 |
| 52267050 | 52268250 | seg_246 | 2202 |
| 52496400 | 52497400 | seg_247 | 2203 |
| 52526900 | 52528150 | seg_248 | 2204 |
| 52530600 | 52532500 | seg_249 | 2205 |
| 52543750 | 52545000 | seg_250 | 2206 |
| 52692900 | 52694100 | seg_251 | 2207 |
| 52705000 | 52706750 | seg_252 | 2208 |
| 52755450 | 52756450 | seg_253 | 2209 |
| 52809850 | 52811650 | seg_254 | 2210 |
| 52919850 | 52921300 | seg_255 | 2211 |
| 52925850 | 52927100 | seg_256 | 2212 |
| 52989600 | 52990850 | seg_257 | 2213 |
| 52994300 | 52995300 | seg_258 | 2214 |
| 53069800 | 53070900 | seg_259 | 2215 |
| 53284450 | 53286250 | seg_260 | 2216 |
| 53329950 | 53331050 | seg_261 | 2217 |
| 53348300 | 53351800 | seg_262 | 2218 |
| 53360200 | 53362250 | seg_263 | 2219 |
| 53510800 | 53511850 | seg_264 | 2220 |
| 53893900 | 53895050 | seg_265 | 2221 |
| 53947550 | 53948650 | seg_266 | 2222 |
| 54070050 | 54071100 | seg_267 | 2223 |
| 54221650 | 54222700 | seg_268 | 2224 |
| 54315000 | 54316050 | seg_269 | 2225 |
| 54386700 | 54387800 | seg_270 | 2226 |
| 54521250 | 54522900 | seg_271 | 2227 |
| 54776750 | 54777850 | seg_272 | 2228 |
| 55026400 | 55027550 | seg_273 | 2229 |
| 55142950 | 55144000 | seg_274 | 2230 |
| 55195550 | 55197050 | seg_275 | 2231 |
| 56029500 | 56030800 | seg_276 | 2232 |
| 56625450 | 56626500 | seg_277 | 2233 |
| 56787300 | 56788350 | seg_278 | 2234 |
| 57633650 | 57634750 | seg_279 | 2235 |
| 58499950 | 58501350 | seg_280 | 2236 |
| 58556450 | 58557650 | seg_281 | 2237 |
| 58564350 | 58569550 | seg_282 | 2238 |
| 58572250 | 58575150 | seg_283 | 2239 |
| 58576450 | 58579850 | seg_284 | 2240 |
| 61687500 | 61693950 | seg_285 | 2241 |
| 61696500 | 61697900 | seg_286 | 2242 |
| 61705150 | 61707200 | seg_287 | 2243 |
| 61709550 | 61713800 | seg_288 | 2244 |
| 61715700 | 61717700 | seg_289 | 2245 |
| 61718950 | 61720050 | seg_290 | 2246 |
| 61722850 | 61725350 | seg_291 | 2247 |
| 61735200 | 61737150 | seg_292 | 2248 |
| 61745250 | 61748350 | seg_293 | 2249 |
| 61759400 | 61765200 | seg_294 | 2250 |
| 61767100 | 61768400 | seg_295 | 2251 |
| 61771650 | 61773500 | seg_296 | 2252 |
| 61812750 | 61816700 | seg_297 | 2253 |
| 61825850 | 61827800 | seg_298 | 2254 |
| 61833050 | 61834950 | seg_299 | 2255 |
| 61836400 | 61840450 | seg_300 | 2256 |
| 61848600 | 61850050 | seg_301 | 2257 |
| 61871000 | 61872850 | seg_302 | 2258 |
| 61880650 | 61882600 | seg_303 | 2259 |
| 62373750 | 62375100 | seg_304 | 2260 |
| 62381350 | 62382900 | seg_305 | 2261 |
| 62967650 | 62969200 | seg_306 | 2262 |
| 63267250 | 63268250 | seg_307 | 2263 |
| 63412200 | 63413300 | seg_308 | 2264 |
| 64138750 | 64139800 | seg_309 | 2265 |
| 64770000 | 64772700 | seg_310 | 2266 |
| 66313800 | 66314950 | seg_311 | 2267 |
| 66763900 | 66766950 | seg_312 | 2268 |
| 67871900 | 67872900 | seg_313 | 2269 |
| 68048550 | 68051950 | seg_314 | 2270 |
| 68132200 | 68133300 | seg_315 | 2271 |
| 68233300 | 68234300 | seg_316 | 2272 |
| 68270750 | 68271850 | seg_317 | 2273 |
| 68406000 | 68407300 | seg_318 | 2274 |
| 68423100 | 68425000 | seg_319 | 2275 |
| 68482450 | 68484700 | seg_320 | 2276 |
| 68524950 | 68526550 | seg_321 | 2277 |
| 68836650 | 68837650 | seg_322 | 2278 |
| 69354600 | 69355600 | seg_323 | 2279 |
| 69394450 | 69395900 | seg_324 | 2280 |
| 69663950 | 69665850 | seg_325 | 2281 |
| 70013100 | 70014100 | seg_326 | 2282 |
| 70368600 | 70369750 | seg_327 | 2283 |
| 70435950 | 70436950 | seg_328 | 2284 |
| 70443150 | 70444550 | seg_329 | 2285 |
| 70839050 | 70840250 | seg_330 | 2286 |
| 70877750 | 70883200 | seg_331 | 2287 |
| 70920450 | 70921550 | seg_332 | 2288 |
| 70931300 | 70944400 | seg_333 | 2289 |
| 70945900 | 70947000 | seg_334 | 2290 |
| 70948700 | 70950550 | seg_335 | 2291 |
| 70973450 | 70990950 | seg_336 | 2292 |
| 71033300 | 71034650 | seg_337 | 2293 |
| 71091950 | 71093750 | seg_338 | 2294 |
| 71130200 | 71132050 | seg_339 | 2295 |
| 71237900 | 71239300 | seg_340 | 2296 |
| 71241400 | 71242500 | seg_341 | 2297 |
| 71279100 | 71280300 | seg_342 | 2298 |
| 71350200 | 71352700 | seg_343 | 2299 |
| 71364150 | 71365850 | seg_344 | 2300 |
| 71525750 | 71529400 | seg_345 | 2301 |
| 71800550 | 71801550 | seg_346 | 2302 |
| 71951850 | 71953000 | seg_347 | 2303 |
| 72011750 | 72013700 | seg_348 | 2304 |
| 72136450 | 72138350 | seg_349 | 2305 |
| 72146600 | 72148500 | seg_350 | 2306 |
| 72157050 | 72158200 | seg_351 | 2307 |
| 72666800 | 72668350 | seg_352 | 2308 |
| 73134450 | 73135450 | seg_353 | 2309 |
| 73397650 | 73399200 | seg_354 | 2310 |
| 73498350 | 73499350 | seg_355 | 2311 |
| 73642400 | 73643800 | seg_356 | 2312 |
| 74055400 | 74056550 | seg_357 | 2313 |
| 77165200 | 77166850 | seg_358 | 2314 |
| 77223450 | 77224850 | seg_359 | 2315 |
| 77296400 | 77297850 | seg_360 | 2316 |
| 78307850 | 78308850 | seg_361 | 2317 |
| 79181150 | 79182150 | seg_362 | 2318 |
| 79277400 | 79278700 | seg_363 | 2319 |
| 79717550 | 79718700 | seg_364 | 2320 |
| 80106100 | 80107250 | seg_365 | 2321 |
| 80258650 | 80259800 | seg_366 | 2322 |
| 83187600 | 83188750 | seg_367 | 2323 |
| 85105500 | 85106600 | seg_368 | 2324 |
| 85317700 | 85318700 | seg_369 | 2325 |
| 86337800 | 86339100 | seg_370 | 2326 |
| 88482200 | 88483250 | seg_371 | 2327 |
| 89470750 | 89472100 | seg_372 | 2328 |
| 91035500 | 91036850 | seg_373 | 2329 |
| 93266850 | 93268000 | seg_374 | 2330 |
| 99556100 | 99557150 | seg_375 | 2331 |
| 99830600 | 99831700 | seg_376 | 2332 |
| 99891050 | 99892300 | seg_377 | 2333 |

TABLE XIV-continued

SUZ12 in K562

| start | end | name | SEQ ID NO: |
|---|---|---|---|
| 99934950 | 99936050 | seg_378 | 2334 |
| 99999850 | 100001500 | seg_379 | 2335 |
| 100334000 | 100335900 | seg_380 | 2336 |
| 100509100 | 100510450 | seg_381 | 2337 |
| 100672350 | 100673500 | seg_382 | 2338 |
| 100744750 | 100745800 | seg_383 | 2339 |
| 100793500 | 100794650 | seg_384 | 2340 |
| 100852500 | 100853550 | seg_385 | 2341 |
| 100867500 | 100868650 | seg_386 | 2342 |
| 101564000 | 101565000 | seg_387 | 2343 |
| 101730800 | 101732700 | seg_388 | 2344 |
| 101770350 | 101771700 | seg_389 | 2345 |
| 102529150 | 102533650 | seg_390 | 2346 |
| 102564750 | 102566250 | seg_391 | 2347 |
| 102585450 | 102586700 | seg_392 | 2348 |
| 102840700 | 102841750 | seg_393 | 2349 |
| 102918500 | 102920100 | seg_394 | 2350 |
| 102982800 | 102984450 | seg_395 | 2351 |
| 103086000 | 103088000 | seg_396 | 2352 |
| 103172500 | 103174100 | seg_397 | 2353 |
| 103216950 | 103218150 | seg_398 | 2354 |
| 103231050 | 103232850 | seg_399 | 2355 |
| 103241500 | 103242650 | seg_400 | 2356 |
| 103305100 | 103306050 | seg_401 | 2357 |
| 103355950 | 103358450 | seg_402 | 2358 |
| 103526000 | 103527100 | seg_403 | 2359 |
| 103809050 | 103810850 | seg_404 | 2360 |
| 105065050 | 105067650 | seg_405 | 2361 |
| 105960300 | 105961850 | seg_406 | 2362 |
| 106047050 | 106048050 | seg_407 | 2363 |
| 106172400 | 106173500 | seg_408 | 2364 |
| 106686250 | 106687400 | seg_499 | 2365 |
| 106748850 | 106751450 | seg_410 | 2366 |
| 106766900 | 106768200 | seg_411 | 2367 |
| 106793100 | 106794250 | seg_412 | 2368 |
| 106843800 | 106846550 | seg_413 | 2369 |
| 106991800 | 106993500 | seg_414 | 2370 |
| 107018250 | 107019350 | seg_415 | 2371 |
| 107067850 | 107070850 | seg_416 | 2372 |
| 107223950 | 107225250 | seg_417 | 2373 |
| 107509250 | 107510600 | seg_418 | 2374 |
| 107621250 | 107622550 | seg_419 | 2375 |
| 107964200 | 107965250 | seg_420 | 2376 |
| 107975000 | 107976700 | seg_421 | 2377 |
| 108199300 | 108200550 | seg_422 | 2378 |
| 108296850 | 108298000 | seg_423 | 2379 |
| 108674800 | 108676200 | seg_424 | 2380 |
| 108703300 | 108705200 | seg_425 | 2381 |
| 108793550 | 108795100 | seg_426 | 2382 |
| 108811600 | 108812750 | seg_427 | 2383 |
| 108842800 | 108843800 | seg_428 | 2384 |
| 109133400 | 109135000 | seg_429 | 2385 |
| 109247900 | 109249000 | seg_430 | 2386 |
| 109686900 | 109688500 | seg_431 | 2387 |
| 110038450 | 110040100 | seg_432 | 2388 |
| 111148500 | 111149550 | seg_433 | 2389 |
| 111323950 | 111326100 | seg_434 | 2390 |
| 111377450 | 111378600 | seg_435 | 2391 |
| 111877350 | 111878350 | seg_436 | 2392 |
| 112067850 | 112068950 | seg_437 | 2393 |
| 113251050 | 113252200 | seg_438 | 2394 |
| 113815000 | 113819700 | seg_439 | 2395 |
| 114795000 | 114796050 | seg_440 | 2396 |
| 114954500 | 114955550 | seg_441 | 2397 |
| 114957400 | 114958700 | seg_442 | 2398 |
| 115997450 | 115998650 | seg_443 | 2399 |
| 117249550 | 117251250 | seg_444 | 2400 |
| 117349200 | 117350550 | seg_445 | 2401 |
| 117956850 | 117960550 | seg_446 | 2402 |
| 118109900 | 118111100 | seg_447 | 2403 |
| 118206800 | 118209350 | seg_448 | 2404 |
| 118214300 | 118215550 | seg_449 | 2405 |
| 118240400 | 118241500 | seg_450 | 2406 |
| 118283750 | 118285900 | seg_451 | 2407 |
| 118367150 | 118368400 | seg_452 | 2408 |
| 118532900 | 118534700 | seg_453 | 2409 |
| 118552150 | 118553350 | seg_454 | 2410 |
| 118636600 | 118637750 | seg_455 | 2411 |
| 118868550 | 118869800 | seg_456 | 2412 |
| 119123450 | 119126250 | seg_457 | 2413 |
| 119128250 | 119130300 | seg_458 | 2414 |
| 119133050 | 119135500 | seg_459 | 2415 |
| 119147300 | 119149300 | seg_460 | 2416 |
| 119152200 | 119153950 | seg_461 | 2417 |
| 119443650 | 119445500 | seg_462 | 2418 |
| 119503950 | 119505200 | seg_463 | 2419 |
| 119626450 | 119627500 | seg_464 | 2420 |
| 120007900 | 120009150 | seg_465 | 2421 |
| 120122250 | 120123600 | seg_466 | 2422 |
| 120742050 | 120743100 | seg_467 | 2423 |
| 121110750 | 121111750 | seg_468 | 2424 |
| 121201700 | 121202750 | seg_469 | 2425 |
| 122004000 | 122005250 | seg_470 | 2426 |
| 122317650 | 122321300 | seg_471 | 2427 |
| 122323700 | 122324850 | seg_472 | 2428 |
| 124416550 | 124417650 | seg_473 | 2429 |
| 126645100 | 126646650 | seg_474 | 2430 |
| 127166250 | 127167250 | seg_475 | 2431 |
| 127302450 | 127303900 | seg_476 | 2432 |
| 128393800 | 128394950 | seg_477 | 2433 |
| 128756950 | 128758000 | seg_478 | 2434 |
| 128781850 | 128783650 | seg_479 | 2435 |
| 128787750 | 128789650 | seg_480 | 2436 |
| 128812100 | 128813800 | seg_481 | 2437 |
| 128822550 | 128823650 | seg_482 | 2438 |
| 128833600 | 128834700 | seg_483 | 2439 |
| 128882700 | 128883950 | seg_484 | 2440 |
| 129429400 | 129430750 | seg_485 | 2441 |
| 129444800 | 129445800 | seg_486 | 2442 |
| 129517950 | 129519000 | seg_487 | 2443 |
| 129598850 | 129599900 | seg_488 | 2444 |
| 129617200 | 129618400 | seg_489 | 2445 |
| 129671600 | 129672750 | seg_490 | 2446 |
| 130182550 | 130183750 | seg_491 | 2447 |
| 130211050 | 130212100 | seg_492 | 2448 |
| 130215900 | 130218550 | seg_493 | 2449 |
| 130409100 | 130410150 | seg_494 | 2450 |
| 130804750 | 130805950 | seg_495 | 2451 |
| 131351450 | 131352650 | seg_496 | 2452 |
| 131556050 | 131558450 | seg_497 | 2453 |
| 131752700 | 131753800 | seg_498 | 2454 |
| 132008150 | 132009150 | seg_499 | 2455 |
| 132086850 | 132088300 | seg_500 | 2456 |
| 132264250 | 132264500 | seg_501 | 2457 |
| 133370100 | 133372850 | seg_502 | 2458 |
| 133384600 | 133385600 | seg_503 | 2459 |
| 133682650 | 133684050 | seg_504 | 2460 |
| 134003650 | 134004750 | seg_505 | 2461 |
| 134133250 | 134134300 | seg_506 | 2462 |
| 134141600 | 134142800 | seg_507 | 2463 |
| 134233350 | 134234550 | seg_508 | 2464 |
| 134280300 | 134282050 | seg_509 | 2465 |
| 134314000 | 134315050 | seg_510 | 2466 |
| 134346900 | 134347900 | seg_511 | 2467 |
| 134349000 | 134350350 | seg_512 | 2468 |
| 134358450 | 134359550 | seg_513 | 2469 |
| 134368700 | 134369700 | seg_514 | 2470 |
| 134370750 | 134373750 | seg_515 | 2471 |
| 134478200 | 134479400 | seg_516 | 2472 |
| 134512850 | 134514000 | seg_517 | 2473 |
| 134555850 | 134556850 | seg_518 | 2474 |
| 134566100 | 134571950 | seg_519 | 2475 |
| 134731350 | 134732350 | seg_520 | 2476 |
| 134753150 | 134754200 | seg_521 | 2477 |
| 134775800 | 134776800 | seg_522 | 2478 |
| 134871500 | 134872550 | seg_523 | 2479 |
| 134888100 | 134889150 | seg_524 | 2480 |
| 134931900 | 134933650 | seg_525 | 2481 |
| 134947700 | 134950650 | seg_526 | 2482 |
| 134998700 | 134999900 | seg_527 | 2483 |

TABLE XIV-continued

SUZ12 in K562

| start | end | name | SEQ ID NO: |
|---|---|---|---|
| 135033500 | 135035000 | seg_528 | 2484 |
| 135138100 | 135139300 | seg_529 | 2485 |
| 135141350 | 135147300 | seg_530 | 2486 |
| 135212600 | 135213950 | seg_531 | 2487 |
| 135228300 | 135230300 | seg_532 | 2488 |
| 135233600 | 135234900 | seg_533 | 2489 |
| 135250050 | 135251600 | seg_534 | 2490 |
| 135436600 | 135438050 | seg_535 | 2491 |
| 135572450 | 135573650 | seg_536 | 2492 |
| 135634450 | 135636250 | seg_537 | 2493 |
| 135736550 | 135737900 | seg_538 | 2494 |
| 135741150 | 135742750 | seg_539 | 2495 |
| 135906100 | 135907150 | seg_540 | 2496 |
| 136114400 | 136117300 | seg_541 | 2497 |
| 136132050 | 136133500 | seg_542 | 2498 |
| 136318450 | 136319900 | seg_543 | 2499 |
| 136507450 | 136511100 | seg_544 | 2500 |
| 136628850 | 136633350 | seg_545 | 2501 |
| 136650850 | 136652450 | seg_546 | 2502 |
| 137064300 | 137065400 | seg_547 | 2503 |
| 138313850 | 138315100 | seg_548 | 2504 |
| 138501150 | 138502400 | seg_549 | 2505 |
| 138689350 | 138690400 | seg_550 | 2506 |
| 138772800 | 138775400 | seg_551 | 2507 |
| 139015500 | 139016750 | seg_552 | 2508 |
| 139172400 | 139174100 | seg_553 | 2509 |
| 139253700 | 139254950 | seg_554 | 2510 |
| 139584250 | 139586100 | seg_555 | 2511 |
| 139589450 | 139593950 | seg_556 | 2512 |
| 140096200 | 140097500 | seg_557 | 2513 |
| 140130900 | 140131900 | seg_558 | 2514 |
| 143215950 | 143217150 | seg_559 | 2515 |
| 147095200 | 147096350 | seg_560 | 2516 |
| 147627750 | 147628750 | seg_561 | 2517 |
| 147670600 | 147671600 | seg_562 | 2518 |
| 148425850 | 148426900 | seg_563 | 2519 |
| 148432950 | 148434000 | seg_564 | 2520 |
| 148552100 | 148554200 | seg_565 | 2521 |
| 148640200 | 148641350 | seg_566 | 2522 |
| 148673650 | 148678650 | seg_567 | 2523 |
| 148679900 | 148684000 | seg_568 | 2524 |
| 148712800 | 148714250 | seg_569 | 2525 |
| 148749000 | 148750600 | seg_570 | 2526 |
| 148752850 | 148753850 | seg_571 | 2527 |
| 148816200 | 148817450 | seg_572 | 2528 |
| 148848550 | 148851050 | seg_573 | 2529 |
| 148853750 | 148858950 | seg_574 | 2530 |
| 148885600 | 148886800 | seg_575 | 2531 |
| 149087550 | 149088750 | seg_576 | 2532 |
| 149221300 | 149222500 | seg_577 | 2533 |
| 149326200 | 149327250 | seg_578 | 2534 |
| 149527800 | 149533900 | seg_579 | 2535 |
| 149646250 | 149648200 | seg_580 | 2536 |
| 149670700 | 149671900 | seg_581 | 2537 |
| 149681150 | 149683750 | seg_582 | 2538 |
| 149715600 | 149716650 | seg_583 | 2539 |
| 150103250 | 150104600 | seg_584 | 2540 |
| 150133850 | 150135550 | seg_585 | 2541 |
| 150137200 | 150138250 | seg_586 | 2542 |
| 150140550 | 150141850 | seg_587 | 2543 |
| 150166150 | 150167250 | seg_588 | 2544 |
| 150188550 | 150189700 | seg_589 | 2545 |
| 150342250 | 150347350 | seg_590 | 2546 |
| 150395650 | 150397300 | seg_591 | 2547 |
| 150554150 | 150555950 | seg_592 | 2548 |
| 150565200 | 150566300 | seg_593 | 2549 |
| 150903100 | 150904100 | seg_594 | 2550 |
| 150934500 | 150935550 | seg_595 | 2551 |
| 151097500 | 151098700 | seg_596 | 2552 |
| 151891100 | 151892300 | seg_597 | 2553 |
| 151910750 | 151912800 | seg_598 | 2554 |
| 151973850 | 151975150 | seg_599 | 2555 |
| 152044600 | 152046350 | seg_600 | 2556 |
| 152049050 | 152050250 | seg_601 | 2557 |
| 152051700 | 152054800 | seg_602 | 2558 |
| 152057500 | 152058500 | seg_603 | 2559 |
| 152061950 | 152063850 | seg_604 | 2560 |
| 152065900 | 152071400 | seg_605 | 2561 |
| 152076500 | 152078400 | seg_606 | 2562 |
| 152096400 | 152098350 | seg_607 | 2563 |
| 152101500 | 152102750 | seg_608 | 2564 |
| 152155100 | 152156400 | seg_609 | 2565 |
| 152346450 | 152347600 | seg_610 | 2566 |
| 152349600 | 152351300 | seg_611 | 2567 |
| 152392250 | 152393600 | seg_612 | 2568 |
| 152397400 | 152399350 | seg_613 | 2569 |
| 152530950 | 152538400 | seg_614 | 2570 |
| 152639750 | 152640900 | seg_615 | 2571 |
| 152662500 | 152664500 | seg_616 | 2572 |
| 152695700 | 152696750 | seg_617 | 2573 |
| 152757650 | 152760600 | seg_618 | 2574 |
| 152773950 | 152775950 | seg_619 | 2575 |
| 152789000 | 152790950 | seg_620 | 2576 |
| 152792050 | 152797450 | seg_621 | 2577 |
| 152801800 | 152804350 | seg_622 | 2578 |
| 152811300 | 152813150 | seg_623 | 2579 |
| 152815500 | 152817200 | seg_624 | 2580 |
| 152818800 | 152828200 | seg_625 | 2581 |
| 152831650 | 152837100 | seg_626 | 2582 |
| 152839000 | 152842300 | seg_627 | 2583 |
| 152870900 | 152872850 | seg_628 | 2584 |
| 152875300 | 152879100 | seg_629 | 2585 |
| 152887500 | 152889300 | seg_630 | 2586 |
| 152891850 | 152893950 | seg_631 | 2587 |
| 152896800 | 152900700 | seg_632 | 2588 |
| 152903550 | 152905450 | seg_633 | 2589 |
| 152908450 | 152909650 | seg_634 | 2590 |
| 153070100 | 153072100 | seg_635 | 2591 |
| 153075150 | 153076450 | seg_636 | 2592 |
| 153078150 | 153079950 | seg_637 | 2593 |
| 153089000 | 153091450 | seg_638 | 2594 |
| 153093650 | 153097850 | seg_639 | 2595 |
| 153123550 | 153131800 | seg_640 | 2596 |
| 153133350 | 153135150 | seg_641 | 2597 |
| 153150200 | 153151550 | seg_642 | 2598 |
| 153157550 | 153159050 | seg_643 | 2599 |
| 153199600 | 153200600 | seg_644 | 2600 |
| 153405550 | 153406900 | seg_645 | 2601 |
| 153409000 | 153412050 | seg_646 | 2602 |
| 153423450 | 153426400 | seg_647 | 2603 |
| 153438400 | 153439900 | seg_648 | 2604 |
| 153447400 | 153449250 | seg_649 | 2605 |
| 153454750 | 153456450 | seg_650 | 2606 |
| 153460750 | 153463050 | seg_651 | 2607 |
| 153477600 | 153479200 | seg_652 | 2608 |
| 153481700 | 153485800 | seg_653 | 2609 |
| 153498150 | 153500900 | seg_654 | 2610 |
| 153551150 | 153553600 | seg_655 | 2611 |
| 153559500 | 153561300 | seg_656 | 2612 |
| 153563100 | 153564150 | seg_657 | 2613 |
| 153604800 | 153605900 | seg_658 | 2614 |
| 153617600 | 153619700 | seg_659 | 2615 |
| 153803300 | 153804700 | seg_660 | 2616 |
| 153827800 | 153828850 | seg_661 | 2617 |
| 153830300 | 153833450 | seg_662 | 2618 |
| 155235050 | 155236450 | seg_663 | 2619 |
| 155245550 | 155247000 | seg_664 | 2620 |
| 155253000 | 155254000 | seg_665 | 2621 |
| 155259200 | 155260550 | seg_666 | 2622 |

Table XV sets forth the hg19 coordinates and SEQ NOs. for the strong EZH2 binding sites identified in GM12878 cells.

TABLE XV

EZH2 in GM12878

| start | end | name | SEQ ID NO: |
|---|---|---|---|
| 334650 | 336100 | seg_1 | 2623 |
| 1330550 | 1331800 | seg_2 | 2624 |
| 1610000 | 1611450 | seg_3 | 2625 |
| 1639800 | 1641400 | seg_4 | 2626 |
| 2500300 | 2501650 | seg_5 | 2627 |
| 2730100 | 2731700 | seg_6 | 2628 |
| 3728950 | 3730750 | seg_7 | 2629 |
| 7001450 | 7003250 | seg_8 | 2630 |
| 7066750 | 7067800 | seg_9 | 2631 |
| 7247600 | 7248900 | seg_10 | 2632 |
| 8007900 | 8008900 | seg_11 | 2633 |
| 8706300 | 8707500 | seg_12 | 2634 |
| 8796200 | 8797750 | seg_13 | 2635 |
| 9754800 | 9756400 | seg_14 | 2636 |
| 10123700 | 10128400 | seg_15 | 2637 |
| 10587050 | 10589450 | seg_16 | 2638 |
| 11777450 | 11778850 | seg_17 | 2639 |
| 11807750 | 11809050 | seg_18 | 2640 |
| 12328750 | 12329950 | seg_19 | 2641 |
| 12511300 | 12512400 | seg_20 | 2642 |
| 12789700 | 12791650 | seg_21 | 2643 |
| 12861500 | 12862950 | seg_22 | 2644 |
| 12907600 | 12908700 | seg_23 | 2645 |
| 13002150 | 13005550 | seg_24 | 2646 |
| 13022550 | 13023650 | seg_25 | 2647 |
| 13104600 | 13106550 | seg_26 | 2648 |
| 13140400 | 13141450 | seg_27 | 2649 |
| 13275200 | 13276500 | seg_28 | 2650 |
| 13400400 | 13401500 | seg_29 | 2651 |
| 13690350 | 13691400 | seg_30 | 2652 |
| 13769950 | 13771750 | seg_31 | 2653 |
| 13861350 | 13862450 | seg_32 | 2654 |
| 13954750 | 13956950 | seg_33 | 2655 |
| 14044850 | 14046750 | seg_34 | 2656 |
| 15161350 | 15162400 | seg_35 | 2657 |
| 15221450 | 15222600 | seg_36 | 2658 |
| 15366600 | 15367950 | seg_37 | 2659 |
| 15635900 | 15637200 | seg_38 | 2660 |
| 15661250 | 15663050 | seg_39 | 2661 |
| 15691700 | 15692750 | seg_40 | 2662 |
| 15870450 | 15871500 | seg_41 | 2663 |
| 15873100 | 15875050 | seg_42 | 2664 |
| 16038450 | 16039750 | seg_43 | 2665 |
| 16042200 | 16043200 | seg_44 | 2666 |
| 16728700 | 16730250 | seg_45 | 2667 |
| 16900250 | 16901750 | seg_46 | 2668 |
| 17016300 | 17017600 | seg_47 | 2669 |
| 17092400 | 17093800 | seg_48 | 2670 |
| 17395100 | 17396350 | seg_49 | 2671 |
| 17502900 | 17504050 | seg_50 | 2672 |
| 17784350 | 17785350 | seg_51 | 2673 |
| 17814350 | 17815500 | seg_52 | 2674 |
| 18371700 | 18372700 | seg_53 | 2675 |
| 18873500 | 18875100 | seg_54 | 2676 |
| 19140800 | 19142750 | seg_55 | 2677 |
| 20313350 | 20314350 | seg_56 | 2678 |
| 21392500 | 21393700 | seg_57 | 2679 |
| 21456000 | 21457350 | seg_58 | 2680 |
| 22244450 | 22245550 | seg_59 | 2681 |
| 22543750 | 22544950 | seg_60 | 2682 |
| 23349400 | 23350400 | seg_61 | 2683 |
| 24071600 | 24072950 | seg_62 | 2684 |
| 24163650 | 24165150 | seg_63 | 2685 |
| 24664100 | 24665300 | seg_64 | 2686 |
| 25024050 | 25042800 | seg_65 | 2687 |
| 29296100 | 29297200 | seg_66 | 2688 |
| 29464050 | 29465100 | seg_67 | 2689 |
| 29572800 | 29574700 | seg_68 | 2690 |
| 30201850 | 30203000 | seg_69 | 2691 |
| 30358350 | 30359600 | seg_70 | 2692 |
| 30553550 | 30554600 | seg_71 | 2693 |
| 30731150 | 30732450 | seg_72 | 2694 |
| 30753250 | 30754400 | seg_73 | 2695 |
| 30989450 | 30990650 | seg_74 | 2696 |
| 31188900 | 31190050 | seg_75 | 2697 |
| 31789800 | 31791200 | seg_76 | 2698 |
| 32372400 | 32373550 | seg_77 | 2699 |
| 32690150 | 32691150 | seg_78 | 2700 |
| 37222250 | 37223300 | seg_79 | 2701 |
| 37645650 | 37647450 | seg_80 | 2702 |
| 37765500 | 37766650 | seg_81 | 2703 |
| 38135850 | 38136950 | seg_82 | 2704 |
| 38537450 | 38538750 | seg_83 | 2705 |
| 39511450 | 39512600 | seg_84 | 2706 |
| 39546900 | 39548650 | seg_85 | 2707 |
| 39634900 | 39635950 | seg_86 | 2708 |
| 39871150 | 39873000 | seg_87 | 2709 |
| 40265250 | 40266350 | seg_88 | 2710 |
| 41095400 | 41096450 | seg_89 | 2711 |
| 41209250 | 41211000 | seg_90 | 2712 |
| 41579300 | 41581500 | seg_91 | 2713 |
| 43208150 | 43209200 | seg_92 | 2714 |
| 45627750 | 45630900 | seg_93 | 2715 |
| 45708550 | 45711000 | seg_94 | 2716 |
| 46497450 | 46498550 | seg_95 | 2717 |
| 46692050 | 46693500 | seg_96 | 2718 |
| 46772150 | 46774250 | seg_97 | 2719 |
| 46819250 | 46820950 | seg_98 | 2720 |
| 46839750 | 46841250 | seg_99 | 2721 |
| 50489150 | 50490250 | seg_100 | 2722 |
| 53349050 | 53352550 | seg_101 | 2723 |
| 53356550 | 53357650 | seg_102 | 2724 |
| 53467000 | 53468050 | seg_103 | 2725 |
| 53659750 | 53660850 | seg_104 | 2726 |
| 53677550 | 53678650 | seg_105 | 2727 |
| 56267800 | 56269150 | seg_106 | 2728 |
| 61838500 | 61840400 | seg_107 | 2729 |
| 62599850 | 62601050 | seg_108 | 2730 |
| 62906550 | 62907850 | seg_109 | 2731 |
| 64255700 | 64256850 | seg_110 | 2732 |
| 64754100 | 64755650 | seg_111 | 2733 |
| 64801300 | 64802950 | seg_112 | 2734 |
| 68049150 | 68050700 | seg_113 | 2735 |
| 68230350 | 68231550 | seg_114 | 2736 |
| 68392000 | 68393100 | seg_115 | 2737 |
| 68607150 | 68608150 | seg_116 | 2738 |
| 68725350 | 68726600 | seg_117 | 2739 |
| 69416400 | 69418200 | seg_118 | 2740 |
| 69555900 | 69556900 | seg_119 | 2741 |
| 69663400 | 69665750 | seg_120 | 2742 |
| 69690000 | 69691650 | seg_121 | 2743 |
| 71320100 | 71321750 | seg_122 | 2744 |
| 71351100 | 71353000 | seg_123 | 2745 |
| 71495000 | 71496100 | seg_124 | 2746 |
| 71523650 | 71529700 | seg_125 | 2747 |
| 71833400 | 71834600 | seg_126 | 2748 |
| 73639250 | 73642650 | seg_127 | 2749 |
| 78177750 | 78179500 | seg_128 | 2750 |
| 78196450 | 78197450 | seg_129 | 2751 |
| 78211700 | 78214250 | seg_130 | 2752 |
| 78408600 | 78409850 | seg_131 | 2753 |
| 78413000 | 78414000 | seg_132 | 2754 |
| 78416550 | 78417950 | seg_133 | 2755 |
| 78513750 | 78515600 | seg_134 | 2756 |
| 80385100 | 80386100 | seg_135 | 2757 |
| 82723300 | 82724450 | seg_136 | 2758 |
| 88458350 | 88460200 | seg_137 | 2759 |
| 91034350 | 91035850 | seg_138 | 2760 |
| 96703000 | 96704200 | seg_139 | 2761 |
| 99622650 | 99623950 | seg_140 | 2762 |
| 99666250 | 99668550 | seg_141 | 2763 |
| 99880550 | 99881650 | seg_142 | 2764 |
| 99985450 | 99986650 | seg_143 | 2765 |
| 102632100 | 102633150 | seg_144 | 2766 |
| 102942900 | 102943950 | seg_145 | 2767 |
| 105218650 | 105219800 | seg_146 | 2768 |
| 105938200 | 105940150 | seg_147 | 2769 |
| 105968900 | 105969900 | seg_148 | 2770 |
| 106044700 | 106046300 | seg_149 | 2771 |
| 106117050 | 106118200 | seg_150 | 2772 |

TABLE XV-continued

EZH2 in GM12878

| start | end | name | SEQ ID NO: |
|---|---|---|---|
| 106691800 | 106694950 | seg_151 | 2773 |
| 106750650 | 106751900 | seg_152 | 2774 |
| 107067250 | 107070800 | seg_153 | 2775 |
| 107314500 | 107315550 | seg_154 | 2776 |
| 107494550 | 107495800 | seg_155 | 2777 |
| 107670350 | 107671350 | seg_156 | 2778 |
| 108728500 | 108730000 | seg_157 | 2779 |
| 109388700 | 109390200 | seg_158 | 2780 |
| 109606250 | 109607300 | seg_159 | 2781 |
| 109634900 | 109636050 | seg_160 | 2782 |
| 109693150 | 109694700 | seg_161 | 2783 |
| 109938700 | 109940350 | seg_162 | 2784 |
| 110094600 | 110096000 | seg_163 | 2785 |
| 110955050 | 110956250 | seg_164 | 2786 |
| 111165850 | 111167200 | seg_165 | 2787 |
| 111431200 | 111432300 | seg_166 | 2788 |
| 111921950 | 111923200 | seg_167 | 2789 |
| 112094000 | 112095700 | seg_168 | 2790 |
| 114642350 | 114643450 | seg_169 | 2791 |
| 117505350 | 117506550 | seg_170 | 2792 |
| 117661700 | 117662750 | seg_171 | 2793 |
| 117957150 | 117960300 | seg_172 | 2794 |
| 117985600 | 117986600 | seg_173 | 2795 |
| 118109100 | 118110500 | seg_174 | 2796 |
| 119124200 | 119126100 | seg_175 | 2797 |
| 119130600 | 119136250 | seg_176 | 2798 |
| 119149750 | 119150850 | seg_177 | 2799 |
| 119283750 | 119285050 | seg_178 | 2800 |
| 119443250 | 119445250 | seg_179 | 2801 |
| 119475500 | 119476550 | seg_180 | 2802 |
| 120440750 | 120442950 | seg_181 | 2803 |
| 120630700 | 120631700 | seg_182 | 2804 |
| 124337400 | 124339100 | seg_183 | 2805 |
| 125673400 | 125674600 | seg_184 | 2806 |
| 128265000 | 128266000 | seg_185 | 2807 |
| 129114500 | 129116250 | seg_186 | 2808 |
| 129398550 | 129399700 | seg_187 | 2809 |
| 129750050 | 129751050 | seg_188 | 2810 |
| 131866700 | 131867750 | seg_189 | 2811 |
| 132547800 | 132548950 | seg_190 | 2812 |
| 133307500 | 133308850 | seg_191 | 2813 |
| 133603350 | 133604800 | seg_192 | 2814 |
| 133681150 | 133683450 | seg_193 | 2815 |
| 133684650 | 133685700 | seg_194 | 2816 |
| 134491550 | 134493250 | seg_195 | 2817 |
| 135228150 | 135229350 | seg_196 | 2818 |
| 135231600 | 135232650 | seg_197 | 2819 |
| 136114000 | 136117750 | seg_198 | 2820 |
| 136133300 | 136135150 | seg_199 | 2821 |
| 136507800 | 136510950 | seg_200 | 2822 |
| 136650000 | 136652650 | seg_201 | 2823 |
| 138275750 | 138278250 | seg_202 | 2824 |
| 138285450 | 138287700 | seg_203 | 2825 |
| 139172250 | 139173500 | seg_204 | 2826 |
| 139583350 | 139585350 | seg_205 | 2827 |
| 139847900 | 139849150 | seg_206 | 2828 |
| 147582000 | 147584900 | seg_207 | 2829 |
| 148958200 | 148959900 | seg_208 | 2830 |
| 149394250 | 149395700 | seg_209 | 2831 |
| 149529400 | 149535200 | seg_210 | 2832 |
| 150315200 | 150316600 | seg_211 | 2833 |
| 150345300 | 150346350 | seg_212 | 2834 |
| 152910650 | 152911850 | seg_213 | 2835 |
| 153094250 | 153095900 | seg_214 | 2836 |
| 153097200 | 153098250 | seg_215 | 2837 |

Each PRC2 strong site or the paRNA(s) associated with each PRC2 strong site is a candidate drug target against with antisense oligonucleotides (ASO) can be designed.

PRC2-associated RNAs were called by analyzing RNA-seq datasets for the corresponding cell lines (wgEncodeEH000187, wgEncodeEH000170, wgEncodeEH000182) and identifying those that overlap the PRC2 site in either orientation by at least 1 base pair.

Again, the PRC2 site-associated RNAs can be noncoding (long noncoding RNA, lncRNA) or occasionally part of a coding mRNA; for simplicity, we will discuss them together as polycomb-associated RNAs (paRNAs). In K562 cells, there are 1275 paRNAs associated with the EZH2 strong sites (Table XVI), 1317 paRNAs associated with strong SUZ12 sites (Table XVII), In GM12878 cells, there are 503 paRNAs associated with the EZH2 strong sites (Table XVIII), Previously annotated RNAs were given a specific ENSEMBL ID in Tables XVI-XVIII (e.g., ENST00000433425.1).

Shown in the following Tables XVI-XVIII are (in column order): Transcript ID number (Ensemble nomenclature); SIN (SEQ NO:); START and STOP, the Start and stop base numbers (coordinates) on the X-chromosome; STRAND, the strand of the X-chromosome (+, -); SUZ12_ID or EZH2_ID, the segment number with which the paRNA is associated; EZH2_START and EZH2_END or SUZ_START and SUZ_END, the start and end base numbers of the segment on the X chr; NEAREST GENE, the name of the closest annotated gene; DISEASE GENE; the name of the closest disease gene. In the sequence listing submitted herewith, the transcripts are represented in DNA sequences; replacement of the "T" nucleotides with "U" would render the original RNA sequence.

TABLE XVI paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000334060.3 | 2838 | 585079 | 620146 | + | seg_8 | 610100 | 614650 | SHOX | OA1 = GPR143 |
| ENST00000381575.1 | 2839 | 591542 | 620146 | + | seg_8 | 610100 | 614650 | SHOX | OA1 = GPR143 |
| ENST00000381566.1 | 2840 | 1317790 | 1331527 | − | seg_20 | 1324000 | 1325900 | CRLF2 | OA1 = GPR143 |
| ENST00000381567.3 | 2841 | 1314890 | 1331527 | − | seg_20 | 1324000 | 1325900 | CRLF2 | OA1 = GPR143 |
| ENST00000467626.1 | 2842 | 1314894 | 1331616 | − | seg_20 | 1324000 | 1325900 | CRLF2 | OA1 = GPR143 |
| ENST00000400841.2 | 2843 | 1314894 | 1331530 | − | seg_20 | 1324000 | 1325900 | CRLF2 | OA1 = GPR143 |
| ENST00000486791.1 | 2844 | 1387738 | 1428827 | + | seg_22 | 1392500 | 1394100 | CSF2RA | OA1 = GPR143 |
| ENST00000381524.3 | 2845 | 1387701 | 1429274 | + | seg_22 | 1392500 | 1394100 | CSF2RA | OA1 = GPR143 |
| ENST00000412290.1 | 2846 | 1387711 | 1413288 | + | seg_22 | 1392500 | 1394100 | CSF2RA | OA1 = GPR143 |
| ENST00000501036.2 | 2847 | 1387693 | 1428828 | + | seg_22 | 1392500 | 1394100 | CSF2RA | OA1 = GPR143 |
| ENST00000381529.3 | 2848 | 1387693 | 1428815 | + | seg_22 | 1392500 | 1394100 | CSF2RA | OA1 = GPR143 |
| ENST00000361536.3 | 2849 | 1387693 | 1428828 | + | seg_22 | 1392500 | 1394100 | CSF2RA | OA1 = GPR143 |
| ENST00000355432.3 | 2850 | 1387738 | 1428827 | + | seg_22 | 1392500 | 1394100 | CSF2RA | OA1 = GPR143 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000355805.2 | 2851 | 1387738 | 1428827 | + | seg_22 | 1392500 | 1394100 | CSF2RA | OA1 = GPR143 |
| ENST00000419094.1 | 2852 | 1387723 | 1409320 | + | seg_22 | 1392500 | 1394100 | CSF2RA | OA1 = GPR143 |
| ENST00000493312.1 | 2853 | 1387707 | 1419436 | + | seg_22 | 1392500 | 1394100 | CSF2RA | OA1 = GPR143 |
| ENST00000381507.4 | 2854 | 1387693 | 1428828 | + | seg_22 | 1392500 | 1394100 | CSF2RA | OA1 = GPR143 |
| ENST00000381509.3 | 2855 | 1387725 | 1424834 | + | seg_22 | 1392500 | 1394100 | CSF2RA | OA1 = GPR143 |
| ENST00000494969.1 | 2856 | 1387725 | 1428815 | + | seg_22 | 1392500 | 1394100 | CSF2RA | OA1 = GPR143 |
| ENST00000432318.2 | 2857 | 1387693 | 1428828 | + | seg_22 | 1392500 | 1394100 | CSF2RA | OA1 = GPR143 |
| ENST00000481245.1 | 2858 | 1387728 | 1401113 | + | seg_22 | 1392500 | 1394100 | CSF2RA | OA1 = GPR143 |
| ENST00000477940.1 | 2859 | 1404545 | 1407533 | + | seg_23 | 1403850 | 1405100 | CSF2RA | OA1 = GPR143 |
| ENST00000486791.1 | 2860 | 1387738 | 1428827 | + | seg_23 | 1403850 | 1405100 | CSF2RA | OA1 = GPR143 |
| ENST00000381500.1 | 2861 | 1401579 | 1428531 | + | seg_23 | 1403850 | 1405100 | CSF2RA | OA1 = GPR143 |
| ENST00000381524.3 | 2862 | 1387701 | 1429274 | + | seg_23 | 1403850 | 1405100 | CSF2RA | OA1 = GPR143 |
| ENST00000417535.2 | 2863 | 1401571 | 1428828 | + | seg_23 | 1403850 | 1405100 | CSF2RA | OA1 = GPR143 |
| ENST00000412290.1 | 2864 | 1387711 | 1413288 | + | seg_23 | 1403850 | 1405100 | CSF2RA | OA1 = GPR143 |
| ENST00000501036.2 | 2865 | 1387693 | 1428828 | + | seg_23 | 1403850 | 1405100 | CSF2RA | OA1 = GPR143 |
| ENST00000381529.3 | 2866 | 1387693 | 1428815 | + | seg_23 | 1403850 | 1405100 | CSF2RA | OA1 = GPR143 |
| ENST00000361536.3 | 2867 | 1387693 | 1428828 | + | seg_23 | 1403850 | 1405100 | CSF2RA | OA1 = GPR143 |
| ENST00000355432.3 | 2868 | 1387738 | 1428827 | + | seg_23 | 1403850 | 1405100 | CSF2RA | OA1 = GPR143 |
| ENST00000355805.2 | 2869 | 1387738 | 1428827 | + | seg_23 | 1403850 | 1405100 | CSF2RA | OA1 = GPR143 |
| ENST00000419094.1 | 2870 | 1387723 | 1409320 | + | seg_23 | 1403850 | 1405100 | CSF2RA | OA1 = GPR143 |
| ENST00000493312.1 | 2871 | 1387707 | 1419436 | + | seg_23 | 1403850 | 1405100 | CSF2RA | OA1 = GPR143 |
| ENST00000381507.4 | 2872 | 1387693 | 1428828 | + | seg_23 | 1403850 | 1405100 | CSF2RA | OA1 = GPR143 |
| ENST00000381509.3 | 2873 | 1387725 | 1424834 | + | seg_23 | 1403850 | 1405100 | CSF2RA | OA1 = GPR143 |
| ENST00000494969.1 | 2874 | 1387725 | 1428815 | + | seg_23 | 1403850 | 1405100 | CSF2RA | OA1 = GPR143 |
| ENST00000432318.2 | 2875 | 1387693 | 1428828 | + | seg_23 | 1403850 | 1405100 | CSF2RA | OA1 = GPR143 |
| ENST00000381469.2 | 2876 | 1460659 | 1501358 | + | seg_24 | 1460050 | 1461400 | IL3RA | OA1 = GPR143 |
| ENST00000331035.4 | 2877 | 1455509 | 1501578 | + | seg_24 | 1460050 | 1461400 | IL3RA | OA1 = GPR143 |
| ENST00000432757.1 | 2878 | 1455689 | 1475224 | + | seg_24 | 1460050 | 1461400 | IL3RA | OA1 = GPR143 |
| ENST00000381469.2 | 2879 | 1460659 | 1501358 | + | seg_25 | 1464650 | 1468000 | IL3RA | OA1 = GPR143 |
| ENST00000331035.4 | 2880 | 1455509 | 1501578 | + | seg_25 | 1464650 | 1468000 | IL3RA | OA1 = GPR143 |
| ENST00000432757.1 | 2881 | 1455689 | 1475224 | + | seg_25 | 1464650 | 1468000 | IL3RA | OA1 = GPR143 |
| ENST00000381229.4 | 2882 | 1734057 | 1761920 | + | seg_27 | 1733950 | 1735600 | ASMT | OA1 = GPR143 |
| ENST00000381233.3 | 2883 | 1734068 | 1761974 | + | seg_27 | 1733950 | 1735600 | ASMT | OA1 = GPR143 |
| ENST00000381241.3 | 2884 | 1733894 | 1761974 | + | seg_27 | 1733950 | 1735600 | ASMT | OA1 = GPR143 |
| ENST00000381229.4 | 2885 | 1734057 | 1761920 | + | seg_28 | 1747250 | 1749200 | ASMT | OA1 = GPR143 |
| ENST00000381233.3 | 2886 | 1734068 | 1761974 | + | seg_28 | 1747250 | 1749200 | ASMT | OA1 = GPR143 |
| ENST00000381241.3 | 2887 | 1733894 | 1761974 | + | seg_28 | 1747250 | 1749200 | ASMT | OA1 = GPR143 |
| ENST00000509780.1 | 2888 | 1746639 | 1755356 | + | seg_28 | 1747250 | 1749200 | ASMT | OA1 = GPR143 |
| ENST00000430536.2 | 2889 | 2255872 | 2419001 | − | seg_29 | 2368950 | 2371350 | DHRSX | OA1 = GPR143 |
| ENST00000441131.2 | 2890 | 2184895 | 2420846 | − | seg_29 | 2368950 | 2371350 | DHRSX | OA1 = GPR143 |
| ENST00000334651.5 | 2891 | 2137557 | 2419019 | − | seg_29 | 2368950 | 2371350 | DHRSX | OA1 = GPR143 |
| ENST00000444280.1 | 2892 | 2184811 | 2418691 | − | seg_29 | 2368950 | 2371350 | DHRSX | OA1 = GPR143 |
| ENST00000478825.1 | 2893 | 2209543 | 2418630 | − | seg_29 | 2368950 | 2371350 | DHRSX | OA1 = GPR143 |
| ENST00000412516.2 | 2894 | 2161103 | 2419014 | − | seg_29 | 2368950 | 2371350 | DHRSX | OA1 = GPR143 |
| ENST00000430536.2 | 2895 | 2255872 | 2419001 | − | seg_30 | 2374650 | 2376750 | DHRSX | OA1 = GPR143 |
| ENST00000441131.2 | 2896 | 2184895 | 2420846 | − | seg_30 | 2374650 | 2376750 | DHRSX | OA1 = GPR143 |
| ENST00000334651.5 | 2897 | 2137557 | 2419019 | − | seg_30 | 2374650 | 2376750 | DHRSX | OA1 = GPR143 |
| ENST00000444280.1 | 2898 | 2184811 | 2418691 | − | seg_30 | 2374650 | 2376750 | DHRSX | OA1 = GPR143 |
| ENST00000478825.1 | 2899 | 2209543 | 2418630 | − | seg_30 | 2374650 | 2376750 | DHRSX | OA1 = GPR143 |
| ENST00000412516.2 | 2900 | 2161103 | 2419014 | − | seg_30 | 2374650 | 2376750 | DHRSX | OA1 = GPR143 |
| ENST00000430536.2 | 2901 | 2255872 | 2419001 | − | seg_31 | 2381200 | 2383650 | ZBED1 | OA1 = GPR143 |
| ENST00000441131.2 | 2902 | 2184895 | 2420846 | − | seg_31 | 2381200 | 2383650 | ZBED1 | OA1 = GPR143 |
| ENST00000334651.5 | 2903 | 2137557 | 2419019 | − | seg_31 | 2381200 | 2383650 | ZBED1 | OA1 = GPR143 |
| ENST00000444280.1 | 2904 | 2184811 | 2418691 | − | seg_31 | 2381200 | 2383650 | ZBED1 | OA1 = GPR143 |
| ENST00000478825.1 | 2905 | 2209543 | 2418630 | − | seg_31 | 2381200 | 2383650 | ZBED1 | OA1 = GPR143 |
| ENST00000412516.2 | 2906 | 2161103 | 2419014 | − | seg_31 | 2381200 | 2383650 | ZBED1 | OA1 = GPR143 |
| ENST00000430536.2 | 2907 | 2255872 | 2419001 | − | seg_32 | 2391700 | 2394350 | ZBED1 | OA1 = GPR143 |
| ENST00000441131.2 | 2908 | 2184895 | 2420846 | − | seg_32 | 2391700 | 2394350 | ZBED1 | OA1 = GPR143 |
| ENST00000334651.5 | 2909 | 2137557 | 2419019 | − | seg_32 | 2391700 | 2394350 | ZBED1 | OA1 = GPR143 |
| ENST00000444280.1 | 2910 | 2184811 | 2418691 | − | seg_32 | 2391700 | 2394350 | ZBED1 | OA1 = GPR143 |
| ENST00000478825.1 | 2911 | 2209543 | 2418630 | − | seg_32 | 2391700 | 2394350 | ZBED1 | OA1 = GPR143 |
| ENST00000412516.2 | 2912 | 2161103 | 2419014 | − | seg_32 | 2391700 | 2394350 | ZBED1 | OA1 = GPR143 |
| ENST00000426774.1 | 2913 | 2670093 | 2734539 | + | seg_38 | 2669000 | 2672950 | XG | OA1 = GPR143 |
| ENST00000533923.2 | 2914 | 2670231 | 2732581 | + | seg_38 | 2669000 | 2672950 | XG | OA1 = GPR143 |
| ENST00000381174.5 | 2915 | 2670091 | 2733968 | + | seg_38 | 2669000 | 2672950 | XG | OA1 = GPR143 |
| ENST00000503018.1 | 2916 | 2670337 | 2693037 | + | seg_38 | 2669000 | 2672950 | XG | OA1 = GPR143 |
| ENST00000419513.2 | 2917 | 2670093 | 2732589 | + | seg_38 | 2669000 | 2672950 | XG | OA1 = GPR143 |
| ENST00000509484.2 | 2918 | 2670186 | 2729477 | + | seg_38 | 2669000 | 2672950 | XG | OA1 = GPR143 |
| ENST00000426774.1 | 2919 | 2670093 | 2734539 | + | seg_39 | 2681550 | 2683000 | XG | OA1 = GPR143 |
| ENST00000533923.2 | 2920 | 2670231 | 2732581 | + | seg_39 | 2681550 | 2683000 | XG | OA1 = GPR143 |
| ENST00000381174.5 | 2921 | 2670091 | 2733968 | + | seg_39 | 2681550 | 2683000 | XG | OA1 = GPR143 |
| ENST00000503018.1 | 2922 | 2670337 | 2693037 | + | seg_39 | 2681550 | 2683000 | XG | OA1 = GPR143 |
| ENST00000419513.2 | 2923 | 2670093 | 2732589 | + | seg_39 | 2681550 | 2683000 | XG | OA1 = GPR143 |
| ENST00000509484.2 | 2924 | 2670186 | 2729477 | + | seg_39 | 2681550 | 2683000 | XG | OA1 = GPR143 |
| ENST00000426774.1 | 2925 | 2670093 | 2734539 | + | seg_40 | 2684450 | 2685950 | XG | OA1 = GPR143 |
| ENST00000533923.2 | 2926 | 2670231 | 2732581 | + | seg_40 | 2684450 | 2685950 | XG | OA1 = GPR143 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000381174.5 | 2927 | 2670091 | 2733968 | + | seg_40 | 2684450 | 2685950 | XG | OA1 = GPR143 |
| ENST00000503018.1 | 2928 | 2670337 | 2693037 | + | seg_40 | 2684450 | 2685950 | XG | OA1 = GPR143 |
| ENST00000419513.2 | 2929 | 2670093 | 2732589 | + | seg_40 | 2684450 | 2685950 | XG | OA1 = GPR143 |
| ENST00000509484.2 | 2930 | 2670186 | 2729477 | + | seg_40 | 2684450 | 2685950 | XG | OA1 = GPR143 |
| ENST00000426774.1 | 2931 | 2670093 | 2734539 | + | seg_41 | 2699450 | 2703000 | XG | OA1 = GPR143 |
| ENST00000533923.2 | 2932 | 2670231 | 2732581 | + | seg_41 | 2699450 | 2703000 | XG | OA1 = GPR143 |
| ENST00000381174.5 | 2933 | 2670091 | 2733968 | + | seg_41 | 2699450 | 2703000 | XG | OA1 = GPR143 |
| ENST00000419513.2 | 2934 | 2670093 | 2732589 | + | seg_41 | 2699450 | 2703000 | XG | OA1 = GPR143 |
| ENST00000509484.2 | 2935 | 2670186 | 2729477 | + | seg_41 | 2699450 | 2703000 | XG | OA1 = GPR143 |
| ENST00000381134.3 | 2936 | 2852857 | 2882311 | − | seg_42 | 2854000 | 2856700 | ARSD | OA1 = GPR143 |
| ENST00000545496.1 | 2937 | 2852852 | 2882325 | − | seg_42 | 2854000 | 2856700 | ARSD | OA1 = GPR143 |
| ENST00000540563.1 | 2938 | 2852699 | 2886286 | − | seg_42 | 2854000 | 2856700 | ARSD | OA1 = GPR143 |
| ENST00000438544.1 | 2939 | 2867664 | 2882305 | − | seg_43 | 2873200 | 2874800 | ARSE | OA1 = GPR143 |
| ENST00000381134.3 | 2940 | 2852857 | 2882311 | − | seg_43 | 2873200 | 2874800 | ARSE | OA1 = GPR143 |
| ENST00000545496.1 | 2941 | 2852852 | 2882325 | − | seg_43 | 2873200 | 2874800 | ARSE | OA1 = GPR143 |
| ENST00000540563.1 | 2942 | 2852699 | 2886286 | − | seg_43 | 2873200 | 2874800 | ARSE | OA1 = GPR143 |
| ENST00000496095.1 | 2943 | 2876452 | 2882305 | − | seg_44 | 2876400 | 2879500 | ARSE | OA1 = GPR143 |
| ENST00000438544.1 | 2944 | 2867664 | 2882305 | − | seg_44 | 2876400 | 2879500 | ARSE | OA1 = GPR143 |
| ENST00000381134.3 | 2945 | 2852857 | 2882311 | − | seg_44 | 2876400 | 2879500 | ARSE | OA1 = GPR143 |
| ENST00000545496.1 | 2946 | 2852852 | 2882325 | − | seg_44 | 2876400 | 2879500 | ARSE | OA1 = GPR143 |
| ENST00000540563.1 | 2947 | 2852699 | 2886286 | − | seg_44 | 2876400 | 2879500 | ARSE | OA1 = GPR143 |
| ENST00000381130.2 | 2948 | 2924654 | 2951612 | + | seg_46 | 2936900 | 2938400 | ARSH | OA1 = GPR143 |
| ENST00000432442.1 | 2949 | 9217960 | 9243246 | + | seg_56 | 9229800 | 9231600 | FAM9B | OA1 = GPR143 |
| ENST00000432442.1 | 2950 | 9217960 | 9243246 | + | seg_57 | 9241950 | 9244700 | FAM9B | OA1 = GPR143 |
| ENST00000416620.1 | 2951 | 9370791 | 9382606 | + | seg_62 | 9371100 | 9382750 | TBL1X | OA1 = GPR143 |
| ENST00000441088.1 | 2952 | 9431360 | 9622328 | + | seg_63 | 9483500 | 9485000 | TBL1X | OA1 = GPR143 |
| ENST00000217964.7 | 2953 | 9433048 | 9687778 | + | seg_63 | 9483500 | 9485000 | TBL1X | OA1 = GPR143 |
| ENST00000380961.1 | 2954 | 9431369 | 9686902 | + | seg_63 | 9483500 | 9485000 | TBL1X | OA1 = GPR143 |
| ENST00000407597.2 | 2955 | 9431335 | 9687780 | + | seg_63 | 9483500 | 9485000 | TBL1X | OA1 = GPR143 |
| ENST00000424279.1 | 2956 | 9431335 | 9687780 | + | seg_63 | 9483500 | 9485000 | TBL1X | OA1 = GPR143 |
| ENST00000415293.1 | 2957 | 9431371 | 9656077 | + | seg_63 | 9483500 | 9485000 | TBL1X | OA1 = GPR143 |
| ENST00000536365.1 | 2958 | 9431352 | 9684302 | + | seg_63 | 9483500 | 9485000 | TBL1X | OA1 = GPR143 |
| ENST00000422314.1 | 2959 | 9433334 | 9652158 | + | seg_63 | 9483500 | 9485000 | TBL1X | OA1 = GPR143 |
| ENST00000380913.3 | 2960 | 9754496 | 9917483 | + | seg_64 | 9793150 | 9794450 | SHROOM2 | OA1 = GPR143 |
| ENST00000380913.3 | 2961 | 9754496 | 9917483 | + | seg_65 | 9806050 | 9807500 | SHROOM2 | OA1 = GPR143 |
| ENST00000380913.3 | 2962 | 9754496 | 9917483 | + | seg_66 | 9814250 | 9818150 | SHROOM2 | OA1 = GPR143 |
| ENST00000380913.3 | 2963 | 9754496 | 9917483 | + | seg_67 | 9823350 | 9824550 | SHROOM2 | OA1 = GPR143 |
| ENST00000493668.1 | 2964 | 9866185 | 9905186 | + | seg_68 | 9863450 | 9867000 | SHROOM2 | OA1 = GPR143 |
| ENST00000380913.3 | 2965 | 9754496 | 9917483 | + | seg_68 | 9863450 | 9867000 | SHROOM2 | OA1 = GPR143 |
| ENST00000493668.1 | 2966 | 9866185 | 9905186 | + | seg_69 | 9880300 | 9881950 | SHROOM2 | OA1 = GPR143 |
| ENST00000418909.2 | 2967 | 9880412 | 9916398 | + | seg_69 | 9880300 | 9881950 | SHROOM2 | OA1 = GPR143 |
| ENST00000540923.1 | 2968 | 9880723 | 9917476 | + | seg_69 | 9880300 | 9881950 | SHROOM2 | OA1 = GPR143 |
| ENST00000452575.1 | 2969 | 9880723 | 9914748 | + | seg_69 | 9880300 | 9881950 | SHROOM2 | OA1 = GPR143 |
| ENST00000380913.3 | 2970 | 9754496 | 9917483 | + | seg_69 | 9880300 | 9881950 | SHROOM2 | OA1 = GPR143 |
| ENST00000493668.1 | 2971 | 9866185 | 9905186 | + | seg_70 | 9883800 | 9885000 | SHROOM2 | OA1 = GPR143 |
| ENST00000418909.2 | 2972 | 9880412 | 9916398 | + | seg_70 | 9883800 | 9885000 | SHROOM2 | OA1 = GPR143 |
| ENST00000540923.1 | 2973 | 9880723 | 9917476 | + | seg_70 | 9883800 | 9885000 | SHROOM2 | OA1 = GPR143 |
| ENST00000452575.1 | 2974 | 9880723 | 9914748 | + | seg_70 | 9883800 | 9885000 | SHROOM2 | OA1 = GPR143 |
| ENST00000380913.3 | 2975 | 9754496 | 9917483 | + | seg_70 | 9883800 | 9885000 | SHROOM2 | OA1 = GPR143 |
| ENST00000418909.2 | 2976 | 9880412 | 9916398 | + | seg_71 | 9913900 | 9916050 | SHROOM2 | OA1 = GPR143 |
| ENST00000540923.1 | 2977 | 9880723 | 9917476 | + | seg_71 | 9913900 | 9916050 | SHROOM2 | OA1 = GPR143 |
| ENST00000452575.1 | 2978 | 9880723 | 9914748 | + | seg_71 | 9913900 | 9916050 | SHROOM2 | OA1 = GPR143 |
| ENST00000380913.3 | 2979 | 9754496 | 9917483 | + | seg_71 | 9913900 | 9916050 | SHROOM2 | OA1 = GPR143 |
| ENST00000543293.1 | 2980 | 10031499 | 10086141 | + | seg_73 | 10048550 | 10049650 | WWC3 | OA1 = GPR143 |
| ENST00000398613.4 | 2981 | 10035291 | 10109658 | + | seg_73 | 10048550 | 10049650 | WWC3 | OA1 = GPR143 |
| ENST00000380861.4 | 2982 | 9983602 | 10112518 | + | seg_73 | 10048550 | 10049650 | WWC3 | OA1 = GPR143 |
| ENST00000454666.1 | 2983 | 10031499 | 10109658 | + | seg_73 | 10048550 | 10049650 | WWC3 | OA1 = GPR143 |
| ENST00000421085.2 | 2984 | 10126540 | 10201760 | + | seg_74 | 10180950 | 10182200 | CLCN4 | OA1 = GPR143 |
| ENST00000380829.1 | 2985 | 10126488 | 10201737 | + | seg_74 | 10180950 | 10182200 | CLCN4 | OA1 = GPR143 |
| ENST00000380833.4 | 2986 | 10125024 | 10205700 | + | seg_74 | 10180950 | 10182200 | CLCN4 | OA1 = GPR143 |
| ENST00000421085.2 | 2987 | 10126540 | 10201760 | + | seg_75 | 10189550 | 10190550 | CLCN4 | OA1 = GPR143 |
| ENST00000380829.1 | 2988 | 10126488 | 10201737 | + | seg_75 | 10189550 | 10190550 | CLCN4 | OA1 = GPR143 |
| ENST00000380833.4 | 2989 | 10125024 | 10205700 | + | seg_75 | 10189550 | 10190550 | CLCN4 | OA1 = GPR143 |
| ENST00000384473.1 | 2990 | 10550857 | 10550959 | + | seg_77 | 10549850 | 10550950 | MID1 | OA1 = GPR143 |
| ENST00000423614.1 | 2991 | 10534995 | 10588625 | − | seg_77 | 10549850 | 10550950 | MID1 | OA1 = GPR143 |
| ENST00000453318.2 | 2992 | 10413350 | 10645779 | − | seg_77 | 10549850 | 10550950 | MID1 | OA1 = GPR143 |
| ENST00000380782.1 | 2993 | 10413596 | 10588459 | − | seg_77 | 10549850 | 10550950 | MID1 | OA1 = GPR143 |
| ENST00000380787.1 | 2994 | 10413596 | 10851773 | − | seg_77 | 10549850 | 10550950 | MID1 | OA1 = GPR143 |
| ENST00000380785.1 | 2995 | 10413596 | 10851762 | − | seg_77 | 10549850 | 10550950 | MID1 | OA1 = GPR143 |
| ENST00000317552.4 | 2996 | 10413350 | 10588674 | − | seg_77 | 10549850 | 10550950 | MID1 | OA1 = GPR143 |
| ENST00000413894.1 | 2997 | 10423115 | 10645727 | − | seg_77 | 10549850 | 10550950 | MID1 | OA1 = GPR143 |
| ENST00000380780.1 | 2998 | 10413596 | 10557949 | − | seg_77 | 10549850 | 10550950 | MID1 | OA1 = GPR143 |
| ENST00000423614.1 | 2999 | 10534995 | 10588625 | − | seg_78 | 10575350 | 10576400 | MID1 | OA1 = GPR143 |
| ENST00000453318.2 | 3000 | 10413350 | 10645779 | − | seg_78 | 10575350 | 10576400 | MID1 | OA1 = GPR143 |
| ENST00000380782.1 | 3001 | 10413596 | 10588459 | − | seg_78 | 10575350 | 10576400 | MID1 | OA1 = GPR143 |
| ENST00000380787.1 | 3002 | 10413596 | 10851773 | − | seg_78 | 10575350 | 10576400 | MID1 | OA1 = GPR143 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000380785.1 | 3003 | 10413596 | 10851762 | − | seg__78 | 10575350 | 10576400 | MID1 | OA1 = GPR143 |
| ENST00000317552.4 | 3004 | 10413350 | 10588674 | − | seg__78 | 10575350 | 10576400 | MID1 | OA1 = GPR143 |
| ENST00000413894.1 | 3005 | 10423115 | 10645727 | − | seg__78 | 10575350 | 10576400 | MID1 | OA1 = GPR143 |
| ENST00000423614.1 | 3006 | 10534995 | 10588625 | − | seg__79 | 10577550 | 10579300 | MID1 | OA1 = GPR143 |
| ENST00000453318.2 | 3007 | 10413350 | 10645779 | − | seg__79 | 10577550 | 10579300 | MID1 | OA1 = GPR143 |
| ENST00000380782.1 | 3008 | 10413596 | 10588459 | − | seg__79 | 10577550 | 10579300 | MID1 | OA1 = GPR143 |
| ENST00000380787.1 | 3009 | 10413596 | 10851773 | − | seg__79 | 10577550 | 10579300 | MID1 | OA1 = GPR143 |
| ENST00000380785.1 | 3010 | 10413596 | 10851762 | − | seg__79 | 10577550 | 10579300 | MID1 | OA1 = GPR143 |
| ENST00000317552.4 | 3011 | 10413350 | 10588674 | − | seg__79 | 10577550 | 10579300 | MID1 | OA1 = GPR143 |
| ENST00000413894.1 | 3012 | 10423115 | 10645727 | − | seg__79 | 10577550 | 10579300 | MID1 | OA1 = GPR143 |
| ENST00000423614.1 | 3013 | 10534995 | 10588625 | − | seg__80 | 10587800 | 10589900 | MID1 | OA1 = GPR143 |
| ENST00000453318.2 | 3014 | 10413350 | 10645779 | − | seg__80 | 10587800 | 10589900 | MID1 | OA1 = GPR143 |
| ENST00000380782.1 | 3015 | 10413596 | 10588459 | − | seg__80 | 10587800 | 10589900 | MID1 | OA1 = GPR143 |
| ENST00000380787.1 | 3016 | 10413596 | 10851773 | − | seg__80 | 10587800 | 10589900 | MID1 | OA1 = GPR143 |
| ENST00000380785.1 | 3017 | 10413596 | 10851762 | − | seg__80 | 10587800 | 10589900 | MID1 | OA1 = GPR143 |
| ENST00000317552.4 | 3018 | 10413350 | 10588674 | − | seg__80 | 10587800 | 10589900 | MID1 | OA1 = GPR143 |
| ENST00000413894.1 | 3019 | 10423115 | 10645727 | − | seg__80 | 10587800 | 10589900 | MID1 | OA1 = GPR143 |
| ENST00000380787.1 | 3020 | 10413596 | 10851773 | − | seg__81 | 10837250 | 10839150 | HCCS | OA1 = GPR143 |
| ENST00000380785.1 | 3021 | 10413596 | 10851762 | − | seg__81 | 10837250 | 10839150 | HCCS | OA1 = GPR143 |
| ENST00000380736.1 | 3022 | 11155663 | 11445893 | − | seg__82 | 11358850 | 11360300 | ARHGAP6 | OA1 = GPR143 |
| ENST00000413512.3 | 3023 | 11162134 | 11369656 | − | seg__82 | 11358850 | 11360300 | ARHGAP6 | OA1 = GPR143 |
| ENST00000380732.3 | 3024 | 11166770 | 11682948 | − | seg__82 | 11358850 | 11360300 | ARHGAP6 | OA1 = GPR143 |
| ENST00000489330.1 | 3025 | 11155667 | 11683203 | − | seg__82 | 11358850 | 11360300 | ARHGAP6 | OA1 = GPR143 |
| ENST00000337414.4 | 3026 | 11155664 | 11683821 | − | seg__82 | 11358850 | 11360300 | ARHGAP6 | OA1 = GPR143 |
| ENST00000495242.1 | 3027 | 11155664 | 11683821 | − | seg__82 | 11358850 | 11360300 | ARHGAP6 | OA1 = GPR143 |
| ENST00000380718.1 | 3028 | 11161517 | 11683821 | − | seg__82 | 11358850 | 11360300 | ARHGAP6 | OA1 = GPR143 |
| ENST00000380736.1 | 3029 | 11155663 | 11445893 | − | seg__83 | 11385800 | 11386800 | ARHGAP6 | OA1 = GPR143 |
| ENST00000380732.3 | 3030 | 11166770 | 11682948 | − | seg__83 | 11385800 | 11386800 | ARHGAP6 | OA1 = GPR143 |
| ENST00000489330.1 | 3031 | 11155667 | 11683203 | − | seg__83 | 11385800 | 11386800 | ARHGAP6 | OA1 = GPR143 |
| ENST00000337414.4 | 3032 | 11155664 | 11683821 | − | seg__83 | 11385800 | 11386800 | ARHGAP6 | OA1 = GPR143 |
| ENST00000495242.1 | 3033 | 11155664 | 11683821 | − | seg__83 | 11385800 | 11386800 | ARHGAP6 | OA1 = GPR143 |
| ENST00000380718.1 | 3034 | 11161517 | 11683821 | − | seg__83 | 11385800 | 11386800 | ARHGAP6 | OA1 = GPR143 |
| ENST00000380732.3 | 3035 | 11166770 | 11682948 | − | seg__84 | 11478950 | 11480450 | ARHGAP6 | OA1 = GPR143 |
| ENST00000489330.1 | 3036 | 11155667 | 11683203 | − | seg__84 | 11478950 | 11480450 | ARHGAP6 | OA1 = GPR143 |
| ENST00000337414.4 | 3037 | 11155664 | 11683821 | − | seg__84 | 11478950 | 11480450 | ARHGAP6 | OA1 = GPR143 |
| ENST00000495242.1 | 3038 | 11155664 | 11683821 | − | seg__84 | 11478950 | 11480450 | ARHGAP6 | OA1 = GPR143 |
| ENST00000380718.1 | 3039 | 11161517 | 11683821 | − | seg__84 | 11478950 | 11480450 | ARHGAP6 | OA1 = GPR143 |
| ENST00000380732.3 | 3040 | 11166770 | 11682948 | − | seg__85 | 11482700 | 11483900 | ARHGAP6 | OA1 = GPR143 |
| ENST00000489330.1 | 3041 | 11155667 | 11683203 | − | seg__85 | 11482700 | 11483900 | ARHGAP6 | OA1 = GPR143 |
| ENST00000337414.4 | 3042 | 11155664 | 11683821 | − | seg__85 | 11482700 | 11483900 | ARHGAP6 | OA1 = GPR143 |
| ENST00000495242.1 | 3043 | 11155664 | 11683821 | − | seg__85 | 11482700 | 11483900 | ARHGAP6 | OA1 = GPR143 |
| ENST00000380718.1 | 3044 | 11161517 | 11683821 | − | seg__85 | 11482700 | 11483900 | ARHGAP6 | OA1 = GPR143 |
| ENST00000304087.6 | 3045 | 12516791 | 12742633 | + | seg__87 | 12726850 | 12727900 | PRPS2 | SEDL = TRAPPC2 |
| ENST00000380682.1 | 3046 | 12156585 | 12742642 | + | seg__87 | 12726850 | 12727900 | PRPS2 | SEDL = TRAPPC2 |
| ENST00000429478.2 | 3047 | 12516714 | 12736911 | + | seg__87 | 12726850 | 12727900 | PRPS2 | SEDL = TRAPPC2 |
| ENST00000451311.2 | 3048 | 12993227 | 12995346 | + | seg__92 | 12995250 | 12996450 | TMSB4X | SEDL = TRAPPC2 |
| ENST00000380635.1 | 3049 | 12993363 | 12995346 | + | seg__92 | 12995250 | 12996450 | TMSB4X | SEDL = TRAPPC2 |
| ENST00000380636.1 | 3050 | 12993229 | 12995345 | + | seg__92 | 12995250 | 12996450 | TMSB4X | SEDL = TRAPPC2 |
| ENST00000456091.1 | 3051 | 13354500 | 13391753 | + | seg__93 | 13374100 | 13375150 | ATXN3L | SEDL = TRAPPC2 |
| ENST00000380602.3 | 3052 | 13587741 | 13651694 | + | seg__98 | 13587150 | 13589150 | EGFL6 | SEDL = TRAPPC2 |
| ENST00000361306.1 | 3053 | 13587724 | 13651693 | + | seg__98 | 13587150 | 13589150 | EGFL6 | SEDL = TRAPPC2 |
| ENST00000380602.3 | 3054 | 13587741 | 13651694 | + | seg__99 | 13634850 | 13636950 | TCEANC | SEDL = TRAPPC2 |
| ENST00000361306.1 | 3055 | 13587724 | 13651693 | + | seg__99 | 13634850 | 13636950 | TCEANC | SEDL = TRAPPC2 |
| ENST00000493677.1 | 3056 | 13790818 | 13835188 | − | seg__100 | 13800750 | 13802000 | GPM6B | OFD1 |
| ENST00000355135.2 | 3057 | 13792073 | 13835188 | − | seg__100 | 13800750 | 13802000 | GPM6B | OFD1 |
| ENST00000316715.4 | 3058 | 13789150 | 13835461 | − | seg__100 | 13800750 | 13802000 | GPM6B | OFD1 |
| ENST00000495211.1 | 3059 | 13794286 | 13802040 | − | seg__100 | 13800750 | 13802000 | GPM6B | OFD1 |
| ENST00000356942.5 | 3060 | 13792073 | 13835465 | − | seg__100 | 13800750 | 13802000 | GPM6B | OFD1 |
| ENST00000475307.1 | 3061 | 13801568 | 13835442 | − | seg__100 | 13800750 | 13802000 | GPM6B | OFD1 |
| ENST00000493085.1 | 3062 | 13797972 | 13907176 | − | seg__100 | 13800750 | 13802000 | GPM6B | OFD1 |
| ENST00000398361.3 | 3063 | 13792456 | 13956534 | − | seg__100 | 13800750 | 13802000 | GPM6B | OFD1 |
| ENST00000468080.1 | 3064 | 13798027 | 13907731 | − | seg__100 | 13800750 | 13802000 | GPM6B | OFD1 |
| ENST00000454189.2 | 3065 | 13789575 | 13956757 | − | seg__100 | 13800750 | 13802000 | GPM6B | OFD1 |
| ENST00000493677.1 | 3066 | 13790818 | 13835188 | − | seg__101 | 13803050 | 13806050 | GPM6B | OFD1 |
| ENST00000355135.2 | 3067 | 13792073 | 13835188 | − | seg__101 | 13803050 | 13806050 | GPM6B | OFD1 |
| ENST00000316715.4 | 3068 | 13789150 | 13835461 | − | seg__101 | 13803050 | 13806050 | GPM6B | OFD1 |
| ENST00000356942.5 | 3069 | 13792073 | 13835465 | − | seg__101 | 13803050 | 13806050 | GPM6B | OFD1 |
| ENST00000475307.1 | 3070 | 13801568 | 13835442 | − | seg__101 | 13803050 | 13806050 | GPM6B | OFD1 |
| ENST00000493085.1 | 3071 | 13797972 | 13907176 | − | seg__101 | 13803050 | 13806050 | GPM6B | OFD1 |
| ENST00000398361.3 | 3072 | 13792456 | 13956534 | − | seg__101 | 13803050 | 13806050 | GPM6B | OFD1 |
| ENST00000468080.1 | 3073 | 13798027 | 13907731 | − | seg__101 | 13803050 | 13806050 | GPM6B | OFD1 |
| ENST00000454189.2 | 3074 | 13789575 | 13956757 | − | seg__101 | 13803050 | 13806050 | GPM6B | OFD1 |
| ENST00000493677.1 | 3075 | 13790818 | 13835188 | − | seg__102 | 13820050 | 13821950 | GPM6B | OFD1 |
| ENST00000355135.2 | 3076 | 13792073 | 13835188 | − | seg__102 | 13820050 | 13821950 | GPM6B | OFD1 |
| ENST00000316715.4 | 3077 | 13789150 | 13835461 | − | seg__102 | 13820050 | 13821950 | GPM6B | OFD1 |
| ENST00000356942.5 | 3078 | 13792073 | 13835465 | − | seg__102 | 13820050 | 13821950 | GPM6B | OFD1 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000475307.1 | 3079 | 13801568 | 13835442 | − | seg_102 | 13820050 | 13821950 | GPM6B | OFD1 |
| ENST00000493085.1 | 3080 | 13797972 | 13907176 | − | seg_102 | 13820050 | 13821950 | GPM6B | OFD1 |
| ENST00000398361.3 | 3081 | 13792456 | 13956534 | − | seg_102 | 13820050 | 13821950 | GPM6B | OFD1 |
| ENST00000468080.1 | 3082 | 13798027 | 13907731 | − | seg_102 | 13820050 | 13821950 | GPM6B | OFD1 |
| ENST00000454189.2 | 3083 | 13789575 | 13956757 | − | seg_102 | 13820050 | 13821950 | GPM6B | OFD1 |
| ENST00000493677.1 | 3084 | 13790818 | 13835188 | − | seg_103 | 13832300 | 13835750 | GPM6B | OFD1 |
| ENST00000355135.2 | 3085 | 13792073 | 13835188 | − | seg_103 | 13832300 | 13835750 | GPM6B | OFD1 |
| ENST00000316715.4 | 3086 | 13789150 | 13835461 | − | seg_103 | 13832300 | 13835750 | GPM6B | OFD1 |
| ENST00000356942.5 | 3087 | 13792073 | 13835465 | − | seg_103 | 13832300 | 13835750 | GPM6B | OFD1 |
| ENST00000475307.1 | 3088 | 13801568 | 13835442 | − | seg_103 | 13832300 | 13835750 | GPM6B | OFD1 |
| ENST00000493085.1 | 3089 | 13797972 | 13907176 | − | seg_103 | 13832300 | 13835750 | GPM6B | OFD1 |
| ENST00000398361.3 | 3090 | 13792456 | 13956534 | − | seg_103 | 13832300 | 13835750 | GPM6B | OFD1 |
| ENST00000468080.1 | 3091 | 13798027 | 13907731 | − | seg_103 | 13832300 | 13835750 | GPM6B | OFD1 |
| ENST00000454189.2 | 3092 | 13789575 | 13956757 | − | seg_103 | 13832300 | 13835750 | GPM6B | OFD1 |
| ENST00000398361.3 | 3093 | 13792456 | 13956534 | − | seg_104 | 13917650 | 13919650 | GPM6B | OFD1 |
| ENST00000454189.2 | 3094 | 13789575 | 13956757 | − | seg_104 | 13917650 | 13919650 | GPM6B | OFD1 |
| ENST00000398361.3 | 3095 | 13792456 | 13956534 | − | seg_105 | 13941900 | 13943750 | GPM6B | OFD1 |
| ENST00000454189.2 | 3096 | 13789575 | 13956757 | − | seg_105 | 13941900 | 13943750 | GPM6B | OFD1 |
| ENST00000398361.3 | 3097 | 13792456 | 13956534 | − | seg_106 | 13954250 | 13956600 | GPM6B | OFD1 |
| ENST00000454189.2 | 3098 | 13789575 | 13956757 | − | seg_106 | 13954250 | 13956600 | GPM6B | OFD1 |
| ENST00000380488.4 | 3099 | 15262109 | 15288270 | − | seg_112 | 15286800 | 15288500 | ASB9 | PIGA |
| ENST00000473862.1 | 3100 | 15262412 | 15288135 | − | seg_112 | 15286800 | 15288500 | ASB9 | PIGA |
| ENST00000546332.1 | 3101 | 15262111 | 15288589 | − | seg_112 | 15286800 | 15288500 | ASB9 | PIGA |
| ENST00000380483.3 | 3102 | 15262109 | 15288173 | − | seg_112 | 15286800 | 15288500 | ASB9 | PIGA |
| ENST00000380485.3 | 3103 | 15262109 | 15288183 | − | seg_112 | 15286800 | 15288500 | ASB9 | PIGA |
| ENST00000470015.1 | 3104 | 15268652 | 15288281 | − | seg_112 | 15286800 | 15288500 | ASB9 | PIGA |
| ENST00000380470.3 | 3105 | 15299819 | 15333746 | − | seg_113 | 15301150 | 15302150 | ASB9 | PIGA |
| ENST00000537676.1 | 3106 | 15298053 | 15332681 | − | seg_113 | 15301150 | 15302150 | ASB9 | PIGA |
| ENST00000344384.4 | 3107 | 15300441 | 15332681 | − | seg_113 | 15301150 | 15302150 | ASB9 | PIGA |
| ENST00000485437.1 | 3108 | 15301628 | 15333727 | − | seg_113 | 15301150 | 15302150 | ASB9 | PIGA |
| ENST00000480796.1 | 3109 | 15301166 | 15333778 | − | seg_113 | 15301150 | 15302150 | ASB9 | PIGA |
| ENST00000380470.3 | 3110 | 15299819 | 15333746 | − | seg_114 | 15321650 | 15322700 | ASB11 | PIGA |
| ENST00000537676.1 | 3111 | 15298053 | 15332681 | − | seg_114 | 15321650 | 15322700 | ASB11 | PIGA |
| ENST00000344384.4 | 3112 | 15300441 | 15332681 | − | seg_114 | 15321650 | 15322700 | ASB11 | PIGA |
| ENST00000485437.1 | 3113 | 15301628 | 15333727 | − | seg_114 | 15321650 | 15322700 | ASB11 | PIGA |
| ENST00000480796.1 | 3114 | 15301166 | 15333778 | − | seg_114 | 15321650 | 15322700 | ASB11 | PIGA |
| ENST00000297904.3 | 3115 | 15363713 | 15402498 | − | seg_116 | 15382100 | 15387750 | FIGF | PIGA |
| ENST00000297904.3 | 3116 | 15363713 | 15402498 | − | seg_117 | 15391300 | 15392750 | FIGF | PIGA |
| ENST00000380342.3 | 3117 | 15645441 | 15683154 | − | seg_118 | 15661050 | 15663600 | TMEM27 | PIGA |
| ENST00000380289.2 | 3118 | 16141679 | 16171144 | + | seg_119 | 16141650 | 16142650 | GRPR | PIGA |
| ENST00000535371.1 | 3119 | 16142045 | 16170808 | + | seg_119 | 16141650 | 16142650 | GRPR | PIGA |
| ENST00000357277.3 | 3120 | 16964814 | 17171395 | + | seg_123 | 16965250 | 16968400 | REPS2 | CC = NHS |
| ENST00000380063.2 | 3121 | 16964814 | 17167136 | + | seg_123 | 16965250 | 16968400 | REPS2 | CC = NHS |
| ENST00000481792.1 | 3122 | 16965193 | 17040494 | + | seg_123 | 16965250 | 16968400 | REPS2 | CC = NHS |
| ENST00000303843.7 | 3123 | 16964985 | 17171395 | + | seg_123 | 16965250 | 16968400 | REPS2 | CC = NHS |
| ENST00000357277.3 | 3124 | 16964814 | 17171395 | + | seg_124 | 17028550 | 17029750 | REPS2 | CC = NHS |
| ENST00000380063.2 | 3125 | 16964814 | 17167136 | + | seg_124 | 17028550 | 17029750 | REPS2 | CC = NHS |
| ENST00000380064.4 | 3126 | 16996667 | 17165745 | + | seg_124 | 17028550 | 17029750 | REPS2 | CC = NHS |
| ENST00000481792.1 | 3127 | 16965193 | 17040494 | + | seg_124 | 17028550 | 17029750 | REPS2 | CC = NHS |
| ENST00000303843.7 | 3128 | 16964985 | 17171395 | + | seg_124 | 17028550 | 17029750 | REPS2 | CC = NHS |
| ENST00000469714.1 | 3129 | 17092636 | 17165752 | + | seg_125 | 17113350 | 17114550 | REPS2 | CC = NHS |
| ENST00000357277.3 | 3130 | 16964814 | 17171395 | + | seg_125 | 17113350 | 17114550 | REPS2 | CC = NHS |
| ENST00000380063.2 | 3131 | 16964814 | 17167136 | + | seg_125 | 17113350 | 17114550 | REPS2 | CC = NHS |
| ENST00000380064.4 | 3132 | 16996667 | 17165745 | + | seg_125 | 17113350 | 17114550 | REPS2 | CC = NHS |
| ENST00000303843.7 | 3133 | 16964985 | 17171395 | + | seg_125 | 17113350 | 17114550 | REPS2 | CC = NHS |
| ENST00000380057.4 | 3134 | 17705832 | 17754111 | + | seg_126 | 17749950 | 17751500 | SCML1 | CC = NHS |
| ENST00000398097.3 | 3135 | 17653413 | 17754098 | + | seg_126 | 17749950 | 17751500 | SCML1 | CC = NHS |
| ENST00000380060.3 | 3136 | 17393543 | 17754114 | + | seg_126 | 17749950 | 17751500 | SCML1 | CC = NHS |
| ENST00000360011.1 | 3137 | 17818171 | 17878827 | − | seg_127 | 17876650 | 17878250 | RAI2 | CC = NHS |
| ENST00000331511.1 | 3138 | 17818171 | 17879356 | − | seg_127 | 17876650 | 17878250 | RAI2 | CC = NHS |
| ENST00000545871.1 | 3139 | 17818171 | 17879457 | − | seg_127 | 17876650 | 17878250 | RAI2 | CC = NHS |
| ENST00000451717.1 | 3140 | 17818171 | 17879457 | − | seg_127 | 17876650 | 17878250 | RAI2 | CC = NHS |
| ENST00000415486.2 | 3141 | 17818171 | 17879457 | − | seg_127 | 17876650 | 17878250 | RAI2 | CC = NHS |
| ENST00000380033.4 | 3142 | 18181051 | 18239003 | − | seg_128 | 18211700 | 18212750 | BEND2 | CDKL5 |
| ENST00000380030.3 | 3143 | 18189095 | 18239024 | − | seg_128 | 18211700 | 18212750 | BEND2 | CDKL5 |
| ENST00000380033.4 | 3144 | 18181051 | 18239003 | − | seg_129 | 18234150 | 18238350 | BEND2 | CDKL5 |
| ENST00000380030.3 | 3145 | 18189095 | 18239024 | − | seg_129 | 18234150 | 18238350 | BEND2 | CDKL5 |
| ENST00000379996.3 | 3146 | 18443703 | 18671749 | + | seg_135 | 18443550 | 18447600 | CDKL5 | CDKL5 |
| ENST00000379996.3 | 3147 | 18443703 | 18671749 | + | seg_136 | 18451450 | 18452650 | CDKL5 | CDKL5 |
| ENST00000463994.1 | 3148 | 18622067 | 18638077 | + | seg_137 | 18624850 | 18626400 | RS1 | RS1 |
| ENST00000379996.3 | 3149 | 18443703 | 18671749 | + | seg_137 | 18624850 | 18626400 | RS1 | RS1 |
| ENST00000379989.3 | 3150 | 18460308 | 18671745 | + | seg_137 | 18624850 | 18626400 | RS1 | RS1 |
| ENST00000379996.3 | 3151 | 18443703 | 18671749 | + | seg_138 | 18651650 | 18653200 | RS1 | RS1 |
| ENST00000379989.3 | 3152 | 18460308 | 18671745 | + | seg_138 | 18651650 | 18653200 | RS1 | RS1 |
| ENST00000476595.1 | 3153 | 18660044 | 18668657 | − | seg_139 | 18659400 | 18661000 | RS1 | RS1 |
| ENST00000379984.3 | 3154 | 18658030 | 18690229 | − | seg_139 | 18659400 | 18661000 | RS1 | RS1 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000379996.3 | 3155 | 18443703 | 18671749 | + | seg_139 | 18659400 | 18661000 | RS1 | RS1 |
| ENST00000379989.3 | 3156 | 18460308 | 18671745 | + | seg_139 | 18659400 | 18661000 | RS1 | RS1 |
| ENST00000476595.1 | 3157 | 18660044 | 18668657 | − | seg_140 | 18663000 | 18664250 | RS1 | RS1 |
| ENST00000379984.3 | 3158 | 18658030 | 18690229 | − | seg_140 | 18663000 | 18664250 | RS1 | RS1 |
| ENST00000379996.3 | 3159 | 18443703 | 18671749 | + | seg_140 | 18663000 | 18664250 | RS1 | RS1 |
| ENST00000379989.3 | 3160 | 18460308 | 18671745 | + | seg_140 | 18663000 | 18664250 | RS1 | RS1 |
| ENST00000379984.3 | 3161 | 18658030 | 18690229 | − | seg_141 | 18689000 | 18690200 | RS1 | RS1 |
| ENST00000486029.1 | 3162 | 18694029 | 18716028 | + | seg_142 | 18694650 | 18696250 | RS1 | RS1 |
| ENST00000486029.1 | 3163 | 18694029 | 18716028 | + | seg_143 | 18704800 | 18705850 | RS1 | RS1 |
| ENST00000379962.2 | 3164 | 18748282 | 18845778 | + | seg_144 | 18814500 | 18815800 | PPEF1 | RS1 |
| ENST00000359763.6 | 3165 | 18709046 | 18846039 | + | seg_144 | 18814500 | 18815800 | PPEF1 | RS1 |
| ENST00000349874.5 | 3166 | 18709046 | 18846039 | + | seg_144 | 18814500 | 18815800 | PPEF1 | RS1 |
| ENST00000543630.1 | 3167 | 18709046 | 18846039 | + | seg_144 | 18814500 | 18815800 | PPEF1 | RS1 |
| ENST00000544635.1 | 3168 | 18725773 | 18845806 | + | seg_144 | 18814500 | 18815800 | PPEF1 | RS1 |
| ENST00000361511.3 | 3169 | 18709032 | 18846035 | + | seg_144 | 18814500 | 18815800 | PPEF1 | RS1 |
| ENST00000340581.3 | 3170 | 19008128 | 19100861 | − | seg_149 | 19012650 | 19013750 | PHKA2 | PHKA2 |
| ENST00000397917.4 | 3171 | 19008829 | 19049228 | − | seg_149 | 19012650 | 19013750 | PHKA2 | PHKA2 |
| ENST00000357991.3 | 3172 | 19007432 | 19140579 | − | seg_149 | 19012650 | 19013750 | PHKA2 | PHKA2 |
| ENST00000379869.3 | 3173 | 19007432 | 19140677 | − | seg_149 | 19012650 | 19013750 | PHKA2 | PHKA2 |
| ENST00000379876.1 | 3174 | 19007427 | 19140755 | − | seg_149 | 19012650 | 19013750 | PHKA2 | PHKA2 |
| ENST00000354791.3 | 3175 | 19007427 | 19140755 | − | seg_149 | 19012650 | 19013750 | PHKA2 | PHKA2 |
| ENST00000356606.4 | 3176 | 19007433 | 19140582 | − | seg_149 | 19012650 | 19013750 | PHKA2 | PHKA2 |
| ENST00000379873.2 | 3177 | 19007427 | 19140755 | − | seg_149 | 19012650 | 19013750 | PHKA2 | PHKA2 |
| ENST00000360279.4 | 3178 | 19007432 | 19140677 | − | seg_149 | 19012650 | 19013750 | PHKA2 | PHKA2 |
| ENST00000357544.3 | 3179 | 19007432 | 19140677 | − | seg_149 | 19012650 | 19013750 | PHKA2 | PHKA2 |
| ENST00000379878.3 | 3180 | 19007427 | 19140755 | − | seg_149 | 19012650 | 19013750 | PHKA2 | PHKA2 |
| ENST00000340581.3 | 3181 | 19008128 | 19100861 | − | seg_150 | 19038700 | 19039900 | PHKA2 | PHKA2 |
| ENST00000397917.4 | 3182 | 19008829 | 19049228 | − | seg_150 | 19038700 | 19039900 | PHKA2 | PHKA2 |
| ENST00000479496.1 | 3183 | 19037686 | 19054506 | − | seg_150 | 19038700 | 19039900 | PHKA2 | PHKA2 |
| ENST00000357991.3 | 3184 | 19007432 | 19140579 | − | seg_150 | 19038700 | 19039900 | PHKA2 | PHKA2 |
| ENST00000379869.3 | 3185 | 19007432 | 19140677 | − | seg_150 | 19038700 | 19039900 | PHKA2 | PHKA2 |
| ENST00000379876.1 | 3186 | 19007427 | 19140755 | − | seg_150 | 19038700 | 19039900 | PHKA2 | PHKA2 |
| ENST00000354791.3 | 3187 | 19007427 | 19140755 | − | seg_150 | 19038700 | 19039900 | PHKA2 | PHKA2 |
| ENST00000356606.4 | 3188 | 19007433 | 19140582 | − | seg_150 | 19038700 | 19039900 | PHKA2 | PHKA2 |
| ENST00000379873.2 | 3189 | 19007427 | 19140755 | − | seg_150 | 19038700 | 19039900 | PHKA2 | PHKA2 |
| ENST00000360279.4 | 3190 | 19007432 | 19140677 | − | seg_150 | 19038700 | 19039900 | PHKA2 | PHKA2 |
| ENST00000357544.3 | 3191 | 19007432 | 19140677 | − | seg_150 | 19038700 | 19039900 | PHKA2 | PHKA2 |
| ENST00000379878.3 | 3192 | 19007427 | 19140755 | − | seg_150 | 19038700 | 19039900 | PHKA2 | PHKA2 |
| ENST00000340581.3 | 3193 | 19008128 | 19100861 | − | seg_151 | 19065750 | 19066850 | GPR64 | PHKA2 |
| ENST00000357991.3 | 3194 | 19007432 | 19140579 | − | seg_151 | 19065750 | 19066850 | GPR64 | PHKA2 |
| ENST00000379869.3 | 3195 | 19007432 | 19140677 | − | seg_151 | 19065750 | 19066850 | GPR64 | PHKA2 |
| ENST00000379876.1 | 3196 | 19007427 | 19140755 | − | seg_151 | 19065750 | 19066850 | GPR64 | PHKA2 |
| ENST00000354791.3 | 3197 | 19007427 | 19140755 | − | seg_151 | 19065750 | 19066850 | GPR64 | PHKA2 |
| ENST00000356606.4 | 3198 | 19007433 | 19140582 | − | seg_151 | 19065750 | 19066850 | GPR64 | PHKA2 |
| ENST00000379873.2 | 3199 | 19007427 | 19140755 | − | seg_151 | 19065750 | 19066850 | GPR64 | PHKA2 |
| ENST00000360279.4 | 3200 | 19007432 | 19140677 | − | seg_151 | 19065750 | 19066850 | GPR64 | PHKA2 |
| ENST00000357544.3 | 3201 | 19007432 | 19140677 | − | seg_151 | 19065750 | 19066850 | GPR64 | PHKA2 |
| ENST00000379878.3 | 3202 | 19007427 | 19140755 | − | seg_151 | 19065750 | 19066850 | GPR64 | PHKA2 |
| ENST00000365274.1 | 3203 | 19394892 | 19394993 | + | seg_155 | 19393250 | 19401800 | PDHA1 | PHKA2 |
| ENST00000338883.4 | 3204 | 19378174 | 19533379 | − | seg_155 | 19393250 | 19401800 | PDHA1 | PHKA2 |
| ENST00000359173.3 | 3205 | 19378176 | 19478245 | − | seg_155 | 19393250 | 19401800 | PDHA1 | PHKA2 |
| ENST00000469203.2 | 3206 | 19378797 | 19504642 | − | seg_155 | 19393250 | 19401800 | PDHA1 | PHKA2 |
| ENST00000518578.1 | 3207 | 19378174 | 19500394 | − | seg_155 | 19393250 | 19401800 | PDHA1 | PHKA2 |
| ENST00000338883.4 | 3208 | 19378174 | 19533379 | − | seg_156 | 19415800 | 19417450 | MAP3K15 | PHKA2 |
| ENST00000359173.3 | 3209 | 19378176 | 19478245 | − | seg_156 | 19415800 | 19417450 | MAP3K15 | PHKA2 |
| ENST00000469203.2 | 3210 | 19378797 | 19504642 | − | seg_156 | 19415800 | 19417450 | MAP3K15 | PHKA2 |
| ENST00000518578.1 | 3211 | 19378174 | 19500394 | − | seg_156 | 19415800 | 19417450 | MAP3K15 | PHKA2 |
| ENST00000338883.4 | 3212 | 19378174 | 19533379 | − | seg_157 | 19474150 | 19475400 | MAP3K15 | PHKA2 |
| ENST00000359173.3 | 3213 | 19378176 | 19478245 | − | seg_157 | 19474150 | 19475400 | MAP3K15 | PHKA2 |
| ENST00000469203.2 | 3214 | 19378797 | 19504642 | − | seg_157 | 19474150 | 19475400 | MAP3K15 | PHKA2 |
| ENST00000518578.1 | 3215 | 19378174 | 19500394 | − | seg_157 | 19474150 | 19475400 | MAP3K15 | PHKA2 |
| ENST00000397804.1 | 3216 | 19553520 | 19725207 | − | seg_158 | 19554750 | 19556200 | MAP3K15 | PHKA2 |
| ENST00000379698.4 | 3217 | 19553811 | 19817869 | − | seg_158 | 19554750 | 19556200 | MAP3K15 | PHKA2 |
| ENST00000397821.3 | 3218 | 19552093 | 19905719 | − | seg_158 | 19554750 | 19556200 | MAP3K15 | PHKA2 |
| ENST00000379702.2 | 3219 | 19552083 | 19905719 | − | seg_158 | 19554750 | 19556200 | MAP3K15 | PHKA2 |
| ENST00000379726.3 | 3220 | 19554532 | 19764529 | − | seg_158 | 19554750 | 19556200 | MAP3K15 | PHKA2 |
| ENST00000541422.1 | 3221 | 19554308 | 19688480 | − | seg_158 | 19554750 | 19556200 | MAP3K15 | PHKA2 |
| ENST00000379716.1 | 3222 | 19552125 | 19689116 | − | seg_158 | 19554750 | 19556200 | MAP3K15 | PHKA2 |
| ENST00000397804.1 | 3223 | 19553520 | 19725207 | − | seg_159 | 19560350 | 19561400 | MAP3K15 | PHKA2 |
| ENST00000379698.4 | 3224 | 19553811 | 19817869 | − | seg_159 | 19560350 | 19561400 | MAP3K15 | PHKA2 |
| ENST00000397821.3 | 3225 | 19552093 | 19905719 | − | seg_159 | 19560350 | 19561400 | MAP3K15 | PHKA2 |
| ENST00000379702.2 | 3226 | 19552083 | 19905719 | − | seg_159 | 19560350 | 19561400 | MAP3K15 | PHKA2 |
| ENST00000379726.3 | 3227 | 19554532 | 19765429 | − | seg_159 | 19560350 | 19561400 | MAP3K15 | PHKA2 |
| ENST00000541422.1 | 3228 | 19554308 | 19688480 | − | seg_159 | 19560350 | 19561400 | MAP3K15 | PHKA2 |
| ENST00000379716.1 | 3229 | 19552125 | 19689116 | − | seg_159 | 19560350 | 19561400 | MAP3K15 | PHKA2 |
| ENST00000397804.1 | 3230 | 19553520 | 19725207 | − | seg_160 | 19570450 | 19571550 | MAP3K15 | PHKA2 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000379698.4 | 3231 | 19553811 | 19817869 | − | seg_160 | 19570450 | 19571550 | MAP3K15 | PHKA2 |
| ENST00000397821.3 | 3232 | 19552093 | 19905719 | − | seg_160 | 19570450 | 19571550 | MAP3K15 | PHKA2 |
| ENST00000379702.2 | 3233 | 19552083 | 19905719 | − | seg_160 | 19570450 | 19571550 | MAP3K15 | PHKA2 |
| ENST00000379726.3 | 3234 | 19554532 | 19764529 | − | seg_160 | 19570450 | 19571550 | MAP3K15 | PHKA2 |
| ENST00000541422.1 | 3235 | 19554308 | 19688480 | − | seg_160 | 19570450 | 19571550 | MAP3K15 | PHKA2 |
| ENST00000379716.1 | 3236 | 19552125 | 19689116 | − | seg_160 | 19570450 | 19571550 | MAP3K15 | PHKA2 |
| ENST00000397804.1 | 3237 | 19553520 | 19725207 | − | seg_161 | 19620350 | 19621400 | SH3KBP1 | PHKA2 |
| ENST00000379698.4 | 3238 | 19553811 | 19817869 | − | seg_161 | 19620350 | 19621400 | SH3KBP1 | PHKA2 |
| ENST00000397821.3 | 3239 | 19552093 | 19905719 | − | seg_161 | 19620350 | 19621400 | SH3KBP1 | PHKA2 |
| ENST00000477102.1 | 3240 | 19610186 | 19682833 | − | seg_161 | 19620350 | 19621400 | SH3KBP1 | PHKA2 |
| ENST00000379697.3 | 3241 | 19606396 | 19905577 | − | seg_161 | 19620350 | 19621400 | SH3KBP1 | PHKA2 |
| ENST00000494961.1 | 3242 | 19606802 | 19713819 | − | seg_161 | 19620350 | 19621400 | SH3KBP1 | PHKA2 |
| ENST00000379702.2 | 3243 | 19552083 | 19905719 | − | seg_161 | 19620350 | 19621400 | SH3KBP1 | PHKA2 |
| ENST00000379726.3 | 3244 | 19554532 | 19764529 | − | seg_161 | 19620350 | 19621400 | SH3KBP1 | PHKA2 |
| ENST00000541422.1 | 3245 | 19554308 | 19688480 | − | seg_161 | 19620350 | 19621400 | SH3KBP1 | PHKA2 |
| ENST00000379716.1 | 3246 | 19552125 | 19689116 | − | seg_161 | 19620350 | 19621400 | SH3KBP1 | PHKA2 |
| ENST00000397804.1 | 3247 | 19553520 | 19725207 | − | seg_162 | 19638050 | 19639150 | SH3KBP1 | PHKA2 |
| ENST00000379698.4 | 3248 | 19553811 | 19817869 | − | seg_162 | 19638050 | 19639150 | SH3KBP1 | PHKA2 |
| ENST00000397821.3 | 3249 | 19552093 | 19905719 | − | seg_162 | 19638050 | 19639150 | SH3KBP1 | PHKA2 |
| ENST00000477102.1 | 3250 | 19610186 | 19682833 | − | seg_162 | 19638050 | 19639150 | SH3KBP1 | PHKA2 |
| ENST00000379697.3 | 3251 | 19606396 | 19905577 | − | seg_162 | 19638050 | 19639150 | SH3KBP1 | PHKA2 |
| ENST00000494961.1 | 3252 | 19606802 | 19713819 | − | seg_162 | 19638050 | 19639150 | SH3KBP1 | PHKA2 |
| ENST00000379702.2 | 3253 | 19552083 | 19905719 | − | seg_162 | 19638050 | 19639150 | SH3KBP1 | PHKA2 |
| ENST00000379726.3 | 3254 | 19554532 | 19764529 | − | seg_162 | 19638050 | 19639150 | SH3KBP1 | PHKA2 |
| ENST00000541422.1 | 3255 | 19554308 | 19688480 | − | seg_162 | 19638050 | 19639150 | SH3KBP1 | PHKA2 |
| ENST00000379716.1 | 3256 | 19552125 | 19689116 | − | seg_162 | 19638050 | 19639150 | SH3KBP1 | PHKA2 |
| ENST00000379698.4 | 3257 | 19553811 | 19817869 | − | seg_163 | 19813200 | 19814750 | SH3KBP1 | PHKA2 |
| ENST00000397821.3 | 3258 | 19552093 | 19905719 | − | seg_163 | 19813200 | 19814750 | SH3KBP1 | PHKA2 |
| ENST00000379697.3 | 3259 | 19606396 | 19905577 | − | seg_163 | 19813200 | 19814750 | SH3KBP1 | PHKA2 |
| ENST00000379702.2 | 3260 | 19552083 | 19905719 | − | seg_163 | 19813200 | 19814750 | SH3KBP1 | PHKA2 |
| ENST00000379698.4 | 3261 | 19553811 | 19817869 | − | seg_164 | 19817600 | 19819100 | SH3KBP1 | PHKA2 |
| ENST00000397821.3 | 3262 | 19552093 | 19905719 | − | seg_164 | 19817600 | 19819100 | SH3KBP1 | PHKA2 |
| ENST00000379697.3 | 3263 | 19606396 | 19905577 | − | seg_164 | 19817600 | 19819100 | SH3KBP1 | PHKA2 |
| ENST00000379702.2 | 3264 | 19552083 | 19905719 | − | seg_164 | 19817600 | 19819100 | SH3KBP1 | PHKA2 |
| ENST00000397821.3 | 3265 | 19552093 | 19905719 | − | seg_165 | 19879900 | 19881050 | SH3KBP1 | PHKA2 |
| ENST00000379697.3 | 3266 | 19606396 | 19905577 | − | seg_165 | 19879900 | 19881050 | SH3KBP1 | PHKA2 |
| ENST00000379702.2 | 3267 | 19552083 | 19905719 | − | seg_165 | 19879900 | 19881050 | SH3KBP1 | PHKA2 |
| ENST00000397821.3 | 3268 | 19552093 | 19905719 | − | seg_166 | 19883900 | 19887350 | SH3KBP1 | PHKA2 |
| ENST00000379697.3 | 3269 | 19606396 | 19905577 | − | seg_166 | 19883900 | 19887350 | SH3KBP1 | PHKA2 |
| ENST00000379702.2 | 3270 | 19552083 | 19905719 | − | seg_166 | 19883900 | 19887350 | SH3KBP1 | PHKA2 |
| ENST00000397821.3 | 3271 | 19552093 | 19905719 | − | seg_167 | 19890300 | 19891400 | SH3KBP1 | PHKA2 |
| ENST00000379697.3 | 3272 | 19606396 | 19905577 | − | seg_167 | 19890300 | 19891400 | SH3KBP1 | PHKA2 |
| ENST00000379702.2 | 3273 | 19552083 | 19905719 | − | seg_167 | 19890300 | 19891400 | SH3KBP1 | PHKA2 |
| ENST00000397821.3 | 3274 | 19552093 | 19905719 | − | seg_168 | 19894150 | 19895700 | SH3KBP1 | PHKA2 |
| ENST00000379697.3 | 3275 | 19606396 | 19905577 | − | seg_168 | 19894150 | 19895700 | SH3KBP1 | PHKA2 |
| ENST00000379702.2 | 3276 | 19552083 | 19905719 | − | seg_168 | 19894150 | 19895700 | SH3KBP1 | PHKA2 |
| ENST00000397821.3 | 3277 | 19552093 | 19905719 | − | seg_169 | 19902750 | 19905650 | SH3KBP1 | PHKA2 |
| ENST00000379697.3 | 3278 | 19606396 | 19905577 | − | seg_169 | 19902750 | 19905650 | SH3KBP1 | PHKA2 |
| ENST00000379702.2 | 3279 | 19552083 | 19905719 | − | seg_169 | 19902750 | 19905650 | SH3KBP1 | PHKA2 |
| ENST00000466145.1 | 3280 | 20039466 | 20044061 | − | seg_172 | 20041050 | 20042600 | MAP7D2 | PHKA2 |
| ENST00000379643.4 | 3281 | 20024833 | 20135114 | − | seg_172 | 20041050 | 20042600 | MAP7D2 | PHKA2 |
| ENST00000544957.1 | 3282 | 20026440 | 20135022 | − | seg_172 | 20041050 | 20042600 | MAP7D2 | PHKA2 |
| ENST00000543767.1 | 3283 | 20024989 | 20074895 | − | seg_172 | 20041050 | 20042600 | MAP7D2 | PHKA2 |
| ENST00000443379.2 | 3284 | 20024833 | 20135114 | − | seg_172 | 20041050 | 20042600 | MAP7D2 | PHKA2 |
| ENST00000379651.3 | 3285 | 20024831 | 20135016 | − | seg_172 | 20041050 | 20042600 | MAP7D2 | PHKA2 |
| ENST00000452324.2 | 3286 | 20024833 | 20134756 | − | seg_172 | 20041050 | 20042600 | MAP7D2 | PHKA2 |
| ENST00000485173.1 | 3287 | 20025227 | 20082856 | − | seg_172 | 20041050 | 20042600 | MAP7D2 | PHKA2 |
| ENST00000330274.7 | 3288 | 20070519 | 20135114 | − | seg_173 | 20128750 | 20130450 | MAP7D2 | PHKA2 |
| ENST00000379643.4 | 3289 | 20024833 | 20135114 | − | seg_173 | 20128750 | 20130450 | MAP7D2 | PHKA2 |
| ENST00000544957.1 | 3290 | 20026440 | 20135022 | − | seg_173 | 20128750 | 20130450 | MAP7D2 | PHKA2 |
| ENST00000443379.2 | 3291 | 20024833 | 20135114 | − | seg_173 | 20128750 | 20130450 | MAP7D2 | PHKA2 |
| ENST00000379651.3 | 3292 | 20024831 | 20135016 | − | seg_173 | 20128750 | 20130450 | MAP7D2 | PHKA2 |
| ENST00000452324.2 | 3293 | 20024833 | 20134756 | − | seg_173 | 20128750 | 20130450 | MAP7D2 | PHKA2 |
| ENST00000379374.4 | 3294 | 22050559 | 22269427 | + | seg_183 | 22051000 | 22052100 | PHEX | PHEX |
| ENST00000537599.1 | 3295 | 22051016 | 22266300 | + | seg_183 | 22051000 | 22052100 | PHEX | PHEX |
| ENST00000379374.4 | 3296 | 22050559 | 22269427 | + | seg_184 | 22073800 | 22074800 | PHEX | PHEX |
| ENST00000537599.1 | 3297 | 22051016 | 22266300 | + | seg_184 | 22073800 | 22074800 | PHEX | PHEX |
| ENST00000535894.1 | 3298 | 22056171 | 22266413 | + | seg_184 | 22073800 | 22074800 | PHEX | PHEX |
| ENST00000379295.1 | 3299 | 23721801 | 23784592 | − | seg_186 | 23774100 | 23775150 | ACOT9 | SAT = SAT1 |
| ENST00000486479.1 | 3300 | 24329024 | 24331432 | − | seg_190 | 24328750 | 24333600 | ZFX | SAT = SAT1 |
| ENST00000536351.1 | 3301 | 24328979 | 24331432 | − | seg_190 | 24328750 | 24333600 | ZFX | SAT = SAT1 |
| ENST00000413856.1 | 3302 | 24380878 | 24383541 | + | seg_191 | 24379500 | 24384800 | PDK3 | SAT = SAT1 |
| ENST00000436466.1 | 3303 | 24380878 | 24383495 | + | seg_191 | 24379500 | 24384800 | PDK3 | SAT = SAT1 |
| ENST00000441463.2 | 3304 | 24483573 | 24557954 | + | seg_192 | 24483500 | 24485500 | PDK3 | SAT = SAT1 |
| ENST00000379162.4 | 3305 | 24483338 | 24552542 | + | seg_192 | 24483500 | 24485500 | PDK3 | SAT = SAT1 |
| ENST00000441463.2 | 3306 | 24483573 | 24557954 | + | seg_193 | 24544700 | 24546050 | PDK3 | SAT = SAT1 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000379162.4 | 3307 | 24483338 | 24552542 | + | seg_193 | 24544700 | 24546050 | PDK3 | SAT = SAT1 |
| ENST00000379044.4 | 3308 | 25021811 | 25034065 | − | seg_194 | 25026650 | 25045650 | ARX | SAT = SAT1 |
| ENST00000438281.1 | 3309 | 25047662 | 25048352 | + | seg_195 | 25046800 | 25048550 | ARX | SAT = SAT1 |
| ENST00000432886.2 | 3310 | 38008589 | 38080177 | − | seg_200 | 38037000 | 38038300 | SRPX | RPGR |
| ENST00000378533.3 | 3311 | 38008592 | 38080152 | − | seg_200 | 38037000 | 38038300 | SRPX | RPGR |
| ENST00000538295.1 | 3312 | 38008589 | 38080177 | − | seg_200 | 38037000 | 38038300 | SRPX | RPGR |
| ENST00000343800.6 | 3313 | 38008595 | 38080696 | − | seg_200 | 38037000 | 38038300 | SRPX | RPGR |
| ENST00000544439.1 | 3314 | 38008589 | 38080177 | − | seg_200 | 38037000 | 38038300 | SRPX | RPGR |
| ENST00000465127.1 | 3315 | 37208583 | 38546928 | + | seg_200 | 38037000 | 38038300 | SRPX | RPGR |
| ENST00000423919.1 | 3316 | 38080644 | 38082920 | + | seg_201 | 38078450 | 38080750 | SRPX | RPGR |
| ENST00000432886.2 | 3317 | 38008589 | 38080177 | − | seg_201 | 38078450 | 38080750 | SRPX | RPGR |
| ENST00000378533.3 | 3318 | 38008592 | 38080152 | − | seg_201 | 38078450 | 38080750 | SRPX | RPGR |
| ENST00000538295.1 | 3319 | 38008589 | 38080177 | − | seg_201 | 38078450 | 38080750 | SRPX | RPGR |
| ENST00000343800.6 | 3320 | 38008595 | 38080696 | − | seg_201 | 38078450 | 38080750 | SRPX | RPGR |
| ENST00000544439.1 | 3321 | 38008589 | 38080177 | − | seg_201 | 38078450 | 38080750 | SRPX | RPGR |
| ENST00000465127.1 | 3322 | 37208583 | 38546928 | + | seg_201 | 38078450 | 38080750 | SRPX | RPGR |
| ENST00000465127.1 | 3323 | 37208583 | 38546928 | + | seg_202 | 38195400 | 38197000 | RPGR | RPGR |
| ENST00000488812.1 | 3324 | 38211858 | 38262920 | + | seg_203 | 38211800 | 38213050 | OTC | OTC |
| ENST00000039007.4 | 3325 | 38211798 | 38280703 | + | seg_203 | 38211800 | 38213050 | OTC | OTC |
| ENST00000465127.1 | 3326 | 37208583 | 38546928 | + | seg_203 | 38211800 | 38213050 | OTC | OTC |
| ENST00000480976.1 | 3327 | 38420797 | 38533519 | + | seg_204 | 38475900 | 38477150 | TSPAN7 | OTC |
| ENST00000494037.1 | 3328 | 38471575 | 38530670 | + | seg_204 | 38475900 | 38477150 | TSPAN7 | OTC |
| ENST00000488893.1 | 3329 | 38429936 | 38535070 | + | seg_204 | 38475900 | 38477150 | TSPAN7 | OTC |
| ENST00000471410.1 | 3330 | 38420795 | 38547422 | + | seg_204 | 38475900 | 38477150 | TSPAN7 | OTC |
| ENST00000545599.1 | 3331 | 38420797 | 38547525 | + | seg_204 | 38475900 | 38477150 | TSPAN7 | OTC |
| ENST00000378482.2 | 3332 | 38420623 | 38548167 | + | seg_204 | 38475900 | 38477150 | TSPAN7 | OTC |
| ENST00000422612.2 | 3333 | 38420795 | 38547422 | + | seg_204 | 38475900 | 38477150 | TSPAN7 | OTC |
| ENST00000286824.6 | 3334 | 38420797 | 38547651 | + | seg_204 | 38475900 | 38477150 | TSPAN7 | OTC |
| ENST00000475216.1 | 3335 | 38420797 | 38547525 | + | seg_204 | 38475900 | 38477150 | TSPAN7 | OTC |
| ENST00000465127.1 | 3336 | 37208583 | 38546928 | + | seg_204 | 38475900 | 38477150 | TSPAN7 | OTC |
| ENST00000480976.1 | 3337 | 38420797 | 38533519 | + | seg_205 | 38511700 | 38513450 | TSPAN7 | OTC |
| ENST00000494037.1 | 3338 | 38471575 | 38530670 | + | seg_205 | 38511700 | 38513450 | TSPAN7 | OTC |
| ENST00000488893.1 | 3339 | 38429936 | 38535070 | + | seg_205 | 38511700 | 38513450 | TSPAN7 | OTC |
| ENST00000471410.1 | 3340 | 38420795 | 38547422 | + | seg_205 | 38511700 | 38513450 | TSPAN7 | OTC |
| ENST00000545599.1 | 3341 | 38420797 | 38547525 | + | seg_205 | 38511700 | 38513450 | TSPAN7 | OTC |
| ENST00000378482.2 | 3342 | 38420623 | 38548167 | + | seg_205 | 38511700 | 38513450 | TSPAN7 | OTC |
| ENST00000422612.2 | 3343 | 38420795 | 38547422 | + | seg_205 | 38511700 | 38513450 | TSPAN7 | OTC |
| ENST00000286824.6 | 3344 | 38420797 | 38547651 | + | seg_205 | 38511700 | 38513450 | TSPAN7 | OTC |
| ENST00000475216.1 | 3345 | 38420797 | 38547525 | + | seg_205 | 38511700 | 38513450 | TSPAN7 | OTC |
| ENST00000465127.1 | 3346 | 37208583 | 38546928 | + | seg_205 | 38511700 | 38513450 | TSPAN7 | OTC |
| ENST00000471410.1 | 3347 | 38420795 | 38547422 | + | seg_206 | 38537300 | 38539300 | TSPAN7 | OTC |
| ENST00000545599.1 | 3348 | 38420797 | 38547525 | + | seg_206 | 38537300 | 38539300 | TSPAN7 | OTC |
| ENST00000378482.2 | 3349 | 38420623 | 38548167 | + | seg_206 | 38537300 | 38539300 | TSPAN7 | OTC |
| ENST00000422612.2 | 3350 | 38420795 | 38547422 | + | seg_206 | 38537300 | 38539300 | TSPAN7 | OTC |
| ENST00000286824.6 | 3351 | 38420797 | 38547651 | + | seg_206 | 38537300 | 38539300 | TSPAN7 | OTC |
| ENST00000419600.2 | 3352 | 38525350 | 38548169 | + | seg_206 | 38537300 | 38539300 | TSPAN7 | OTC |
| ENST00000475216.1 | 3353 | 38420797 | 38547525 | + | seg_206 | 38537300 | 38539300 | TSPAN7 | OTC |
| ENST00000465127.1 | 3354 | 37208583 | 38546928 | + | seg_206 | 38537300 | 38539300 | TSPAN7 | OTC |
| ENST00000456333.1 | 3355 | 40594652 | 40597950 | + | seg_213 | 40597850 | 40599200 | MED14 | CSNB1 = NYX |
| ENST00000478993.1 | 3356 | 41192651 | 41223725 | + | seg_217 | 41209650 | 41210900 | DDX3X | CSNB1 = NYX |
| ENST00000378062.5 | 3357 | 43808022 | 43832750 | − | seg_219 | 43831100 | 43833350 | NDP | NDP |
| ENST00000470584.1 | 3358 | 43808928 | 43832632 | − | seg_219 | 43831100 | 43833350 | NDP | NDP |
| ENST00000397254.2 | 3359 | 43888578 | 43890167 | + | seg_220 | 43888350 | 43890300 | NDP | NDP |
| ENST00000378056.5 | 3360 | 44094631 | 44202923 | − | seg_221 | 44172850 | 44174600 | EFHC2 | NDP |
| ENST00000441230.1 | 3361 | 44007958 | 44202911 | − | seg_221 | 44172850 | 44174600 | EFHC2 | NDP |
| ENST00000333807.6 | 3362 | 44007129 | 44202923 | − | seg_221 | 44172850 | 44174600 | EFHC2 | NDP |
| ENST00000420999.1 | 3363 | 44007911 | 44202918 | − | seg_221 | 44172850 | 44174600 | EFHC2 | NDP |
| ENST00000414772.1 | 3364 | 45707328 | 45710447 | − | seg_224 | 45708500 | 45709500 | KRBOX4 | UBA1 |
| ENST00000456532.1 | 3365 | 45707509 | 45710920 | − | seg_224 | 45708500 | 45709500 | KRBOX4 | UBA1 |
| ENST00000491894.1 | 3366 | 46465730 | 46480451 | − | seg_226 | 46465650 | 46466700 | CHST7 | UBA1 |
| ENST00000464933.1 | 3367 | 46465696 | 46495069 | − | seg_226 | 46465650 | 46466700 | CHST7 | UBA1 |
| ENST00000489574.1 | 3368 | 46465730 | 46529121 | − | seg_226 | 46465650 | 46466700 | CHST7 | UBA1 |
| ENST00000328306.4 | 3369 | 46464753 | 46618490 | − | seg_226 | 46465650 | 46466700 | CHST7 | UBA1 |
| ENST00000377073.3 | 3370 | 47229982 | 47273704 | + | seg_230 | 47232600 | 47233700 | ZNF157 | UBA1 |
| ENST00000403001.3 | 3371 | 48046211 | 48051817 | − | seg_236 | 48045350 | 48046450 | SSX5 | WAS |
| ENST00000311798.1 | 3372 | 48045656 | 48056199 | − | seg_236 | 48045350 | 48046450 | SSX5 | WAS |
| ENST00000347757.1 | 3373 | 48045656 | 48056199 | − | seg_236 | 48045350 | 48046450 | SSX5 | WAS |
| ENST00000376923.1 | 3374 | 48045656 | 48054794 | − | seg_236 | 48045350 | 48046450 | SSX5 | WAS |
| ENST00000403001.3 | 3375 | 48046211 | 48051817 | − | seg_237 | 48051300 | 48052550 | SSX5 | WAS |
| ENST00000311798.1 | 3376 | 48045656 | 48056199 | − | seg_237 | 48051300 | 48052550 | SSX5 | WAS |
| ENST00000347757.1 | 3377 | 48045656 | 48056199 | − | seg_237 | 48051300 | 48052550 | SSX5 | WAS |
| ENST00000376923.1 | 3378 | 48045656 | 48054794 | − | seg_237 | 48051300 | 48052550 | SSX5 | WAS |
| ENST00000407081.2 | 3379 | 48156255 | 48165614 | − | seg_240 | 48155300 | 48156750 | SSX9 | WAS |
| ENST00000376909.1 | 3380 | 48154885 | 48165675 | − | seg_240 | 48155300 | 48156750 | SSX9 | WAS |
| ENST00000438101.1 | 3381 | 49429447 | 49433283 | − | seg_247 | 49429000 | 49430200 | PAGE1 | CLCN5 |
| ENST00000474146.1 | 3382 | 49595287 | 49598570 | + | seg_250 | 49594450 | 49595600 | PAGE4 | CLCN5 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000376141.1 | 3383 | 49593863 | 49598576 | + | seg_250 | 49594450 | 49595600 | PAGE4 | CLCN5 |
| ENST00000218068.6 | 3384 | 49593906 | 49598576 | + | seg_250 | 49594450 | 49595600 | PAGE4 | CLCN5 |
| ENST00000478785.1 | 3385 | 49593951 | 49595934 | + | seg_250 | 49594450 | 49595600 | PAGE4 | CLCN5 |
| ENST00000491883.1 | 3386 | 51425000 | 51425485 | − | seg_252 | 51423850 | 51425400 | GSPT2 | CLCN5 |
| ENST00000477634.1 | 3387 | 51928008 | 51935364 | + | seg_256 | 51935050 | 51936300 | MAGED4 | MRX1 = IQSEC2 |
| ENST00000497416.1 | 3388 | 51933114 | 51935352 | + | seg_256 | 51935050 | 51936300 | MAGED4 | MRX1 = IQSEC2 |
| ENST00000416960.1 | 3389 | 51927919 | 51935364 | + | seg_256 | 51935050 | 51936300 | MAGED4 | MRX1 = IQSEC2 |
| ENST00000497348.1 | 3390 | 51934138 | 51935280 | + | seg_256 | 51935050 | 51936300 | MAGED4 | MRX1 = IQSEC2 |
| ENST00000488430.1 | 3391 | 51927983 | 51935364 | + | seg_256 | 51935050 | 51936300 | MAGED4 | MRX1 = IQSEC2 |
| ENST00000459685.1 | 3392 | 51927972 | 51935364 | + | seg_256 | 51935050 | 51936300 | MAGED4 | MRX1 = IQSEC2 |
| ENST00000471932.1 | 3393 | 51927943 | 51935364 | + | seg_256 | 51935050 | 51936300 | MAGED4 | MRX1 = IQSEC2 |
| ENST00000479281.1 | 3394 | 51930729 | 51935364 | + | seg_256 | 51935050 | 51936300 | MAGED4 | MRX1 = IQSEC2 |
| ENST00000375626.3 | 3395 | 51928008 | 51935364 | + | seg_256 | 51935050 | 51936300 | MAGED4 | MRX1 = IQSEC2 |
| ENST00000498483.1 | 3396 | 51928008 | 51935364 | + | seg_256 | 51935050 | 51936300 | MAGED4 | MRX1 = IQSEC2 |
| ENST00000375563.4 | 3397 | 52541053 | 52545988 | − | seg_258 | 52543850 | 52545000 | XAGE1E | MRX1 = IQSEC2 |
| ENST00000375567.3 | 3398 | 52541053 | 52546033 | − | seg_258 | 52543850 | 52545000 | XAGE1E | MRX1 = IQSEC2 |
| ENST00000375570.1 | 3399 | 52541053 | 52546189 | − | seg_258 | 52543850 | 52545000 | XAGE1E | MRX1 = IQSEC2 |
| ENST00000463689.1 | 3400 | 52541053 | 52544001 | − | seg_258 | 52543850 | 52545000 | XAGE1E | MRX1 = IQSEC2 |
| ENST00000429372.2 | 3401 | 52541053 | 52546197 | − | seg_258 | 52543850 | 52545000 | XAGE1E | MRX1 = IQSEC2 |
| ENST00000298181.5 | 3402 | 52673140 | 52683950 | − | seg_261 | 52673200 | 52675150 | SSX7 | MRX1 = IQSEC2 |
| ENST00000375496.2 | 3403 | 52854316 | 52858317 | − | seg_264 | 52854250 | 52855350 | XAGE5 | MRX1 = IQSEC2 |
| ENST00000502642.1 | 3404 | 52853318 | 52858317 | − | seg_264 | 52854250 | 52855350 | XAGE5 | MRX1 = IQSEC2 |
| ENST00000305824.4 | 3405 | 52853316 | 52858317 | − | seg_264 | 52854250 | 52855350 | XAGE5 | MRX1 = IQSEC2 |
| ENST00000346279.3 | 3406 | 52891557 | 52897099 | − | seg_265 | 52896900 | 52898050 | XAGE3 | MRX1 = IQSEC2 |
| ENST00000515858.1 | 3407 | 52994637 | 53024651 | − | seg_266 | 52996700 | 52998100 | FAM156A | MRX1 = IQSEC2 |
| ENST00000451084.2 | 3408 | 52977462 | 53024634 | − | seg_266 | 52996700 | 52998100 | FAM156A | MRX1 = IQSEC2 |
| ENST00000416923.1 | 3409 | 52977768 | 53024632 | − | seg_266 | 52996700 | 52998100 | FAM156A | MRX1 = IQSEC2 |
| ENST00000511863.1 | 3410 | 52984353 | 53024651 | − | seg_266 | 52996700 | 52998100 | FAM156A | MRX1 = IQSEC2 |
| ENST00000414076.2 | 3411 | 52976960 | 53024551 | − | seg_266 | 52996700 | 52998100 | FAM156A | MRX1 = IQSEC2 |
| ENST00000505988.1 | 3412 | 52977787 | 53024551 | − | seg_266 | 52996700 | 52998100 | FAM156A | MRX1 = IQSEC2 |
| ENST00000512364.1 | 3413 | 52976462 | 53024644 | − | seg_266 | 52996700 | 52998100 | FAM156A | MRX1 = IQSEC2 |
| ENST00000505062.1 | 3414 | 52994760 | 53024651 | − | seg_266 | 52996700 | 52998100 | FAM156A | MRX1 = IQSEC2 |
| ENST00000475552.1 | 3415 | 52977803 | 53024634 | − | seg_266 | 52996700 | 52998100 | FAM156A | MRX1 = IQSEC2 |
| ENST00000432596.1 | 3416 | 53352187 | 53352973 | + | seg_268 | 53347500 | 53352900 | IQSEC2 | MRX1 = IQSEC2 |
| ENST00000396435.3 | 3417 | 53262058 | 53350522 | − | seg_268 | 53347500 | 53352900 | IQSEC2 | MRX1 = IQSEC2 |
| ENST00000375368.5 | 3418 | 53262059 | 53350522 | − | seg_268 | 53347500 | 53352900 | IQSEC2 | MRX1 = IQSEC2 |
| ENST00000375159.2 | 3419 | 54224757 | 54360106 | − | seg_275 | 54317850 | 54320600 | WNK3 | FGD1 |
| ENST00000354646.2 | 3420 | 54219258 | 54384438 | − | seg_275 | 54317850 | 54320600 | WNK3 | FGD1 |
| ENST00000375169.3 | 3421 | 54219256 | 54384438 | − | seg_275 | 54317850 | 54320600 | WNK3 | FGD1 |
| ENST00000375135.3 | 3422 | 54471887 | 54522599 | − | seg_278 | 54495250 | 54496750 | FGD1 | FGD1 |
| ENST00000537277.1 | 3423 | 54475243 | 54522322 | − | seg_278 | 54495250 | 54496750 | FGD1 | FGD1 |
| ENST00000498636.1 | 3424 | 55035546 | 55046866 | − | seg_279 | 55040550 | 55042350 | ALAS2 | ALAS2 |
| ENST00000335854.4 | 3425 | 55035522 | 55057410 | − | seg_279 | 55040550 | 55042350 | ALAS2 | ALAS2 |
| ENST00000396198.3 | 3426 | 55035488 | 55057410 | − | seg_279 | 55040550 | 55042350 | ALAS2 | ALAS2 |
| ENST00000330807.5 | 3427 | 55035488 | 55057497 | − | seg_279 | 55040550 | 55042350 | ALAS2 | ALAS2 |
| ENST00000473660.1 | 3428 | 55210389 | 55210459 | − | seg_282 | 55209800 | 55211250 | MTRNR2L10 | ALAS2 |
| ENST00000440433.1 | 3429 | 64770778 | 64772301 | − | seg_285 | 64771000 | 64772400 | LAS1L | AR |
| ENST00000491714.1 | 3430 | 67652773 | 67653755 | − | seg_286 | 67652200 | 67654900 | OPHN1 | AR |
| ENST00000540071.1 | 3431 | 67266504 | 67653369 | − | seg_286 | 67652200 | 67654900 | OPHN1 | AR |
| ENST00000355520.5 | 3432 | 67262186 | 67653647 | − | seg_286 | 67652200 | 67654900 | OPHN1 | AR |
| ENST00000338901.3 | 3433 | 68835911 | 68890104 | + | seg_291 | 68836050 | 68838050 | EDA | ED1 = EDA |
| ENST00000374548.1 | 3434 | 68835911 | 69177354 | + | seg_291 | 68836050 | 68838050 | EDA | ED1 = EDA |
| ENST00000525810.1 | 3435 | 68835911 | 69080892 | + | seg_291 | 68836050 | 68838050 | EDA | ED1 = EDA |
| ENST00000513754.2 | 3436 | 68835911 | 69177327 | + | seg_291 | 68836050 | 68838050 | EDA | ED1 = EDA |
| ENST00000533317.1 | 3437 | 68835911 | 69177327 | + | seg_291 | 68836050 | 68838050 | EDA | ED1 = EDA |
| ENST00000527388.1 | 3438 | 68835911 | 69080892 | + | seg_291 | 68836050 | 68838050 | EDA | ED1 = EDA |
| ENST00000502251.1 | 3439 | 68835911 | 69177354 | + | seg_291 | 68836050 | 68838050 | EDA | ED1 = EDA |
| ENST00000374552.4 | 3440 | 68835911 | 69259319 | + | seg_291 | 68836050 | 68838050 | EDA | ED1 = EDA |
| ENST00000374553.2 | 3441 | 68835911 | 69259319 | + | seg_291 | 68836050 | 68838050 | EDA | ED1 = EDA |
| ENST00000524573.1 | 3442 | 68835961 | 69255487 | + | seg_291 | 68836050 | 68838050 | EDA | ED1 = EDA |
| ENST00000374548.1 | 3443 | 68835911 | 69177354 | + | seg_292 | 68918100 | 68920050 | EDA | ED1 = EDA |
| ENST00000525810.1 | 3444 | 68835911 | 69080892 | + | seg_292 | 68918100 | 68920050 | EDA | ED1 = EDA |
| ENST00000513754.2 | 3445 | 68835911 | 69177327 | + | seg_292 | 68918100 | 68920050 | EDA | ED1 = EDA |
| ENST00000510681.2 | 3446 | 68840273 | 69080948 | + | seg_292 | 68918100 | 68920050 | EDA | ED1 = EDA |
| ENST00000533317.1 | 3447 | 68835911 | 69177327 | + | seg_292 | 68918100 | 68920050 | EDA | ED1 = EDA |
| ENST00000527388.1 | 3448 | 68835911 | 69080892 | + | seg_292 | 68918100 | 68920050 | EDA | ED1 = EDA |
| ENST00000502251.1 | 3449 | 68835911 | 69177354 | + | seg_292 | 68918100 | 68920050 | EDA | ED1 = EDA |
| ENST00000530321.1 | 3450 | 68840300 | 69080892 | + | seg_292 | 68918100 | 68920050 | EDA | ED1 = EDA |
| ENST00000503592.1 | 3451 | 68840254 | 69253260 | + | seg_292 | 68918100 | 68920050 | EDA | ED1 = EDA |
| ENST00000374552.4 | 3452 | 68835911 | 69259319 | + | seg_292 | 68918100 | 68920050 | EDA | ED1 = EDA |
| ENST00000374553.2 | 3453 | 68835911 | 69259319 | + | seg_292 | 68918100 | 68920050 | EDA | ED1 = EDA |
| ENST00000524573.1 | 3454 | 68835961 | 69255487 | + | seg_292 | 68918100 | 68920050 | EDA | ED1 = EDA |
| ENST00000342206.6 | 3455 | 69353299 | 69386174 | + | seg_293 | 69352950 | 69354000 | IGBP1 | ED1 = EDA |
| ENST00000356413.4 | 3456 | 69353313 | 69386174 | + | seg_293 | 69352950 | 69354000 | IGBP1 | ED1 = EDA |
| ENST00000374355.3 | 3457 | 69672155 | 69725337 | + | seg_294 | 69697700 | 69699050 | DLG3 | GJB1 |
| ENST00000194900.4 | 3458 | 69664711 | 69725337 | + | seg_294 | 69697700 | 69699050 | DLG3 | GJB1 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000542398.1 | 3459 | 69674946 | 69725335 | + | seg__294 | 69697700 | 69699050 | DLG3 | GJB1 |
| ENST00000466140.1 | 3460 | 69698968 | 69719753 | + | seg__294 | 69697700 | 69699050 | DLG3 | GJB1 |
| ENST00000494493.1 | 3461 | 69674957 | 69712087 | + | seg__294 | 69697700 | 69699050 | DLG3 | GJB1 |
| ENST00000489733.1 | 3462 | 69674953 | 69718408 | + | seg__294 | 69697700 | 69699050 | DLG3 | GJB1 |
| ENST00000463252.1 | 3463 | 69664986 | 69723796 | + | seg__294 | 69697700 | 69699050 | DLG3 | GJB1 |
| ENST00000374360.3 | 3464 | 69664819 | 69725337 | + | seg__294 | 69697700 | 69699050 | DLG3 | GJB1 |
| ENST00000447581.1 | 3465 | 70435109 | 70443810 | + | seg__296 | 70436000 | 70437500 | GJB1 | GJB1 |
| ENST00000374029.1 | 3466 | 70435044 | 70445050 | + | seg__296 | 70436000 | 70437500 | GJB1 | GJB1 |
| ENST00000374022.3 | 3467 | 70435062 | 70445366 | + | seg__296 | 70436000 | 70437500 | GJB1 | GJB1 |
| ENST00000373981.1 | 3468 | 70469054 | 70474425 | − | seg__297 | 70474400 | 70475600 | ZMYM3 | GJB1 |
| ENST00000373988.1 | 3469 | 70459476 | 70474910 | − | seg__297 | 70474400 | 70475600 | ZMYM3 | GJB1 |
| ENST00000373998.1 | 3470 | 70459474 | 70474996 | − | seg__297 | 70474400 | 70475600 | ZMYM3 | GJB1 |
| ENST00000353904.2 | 3471 | 70459474 | 70474499 | − | seg__297 | 70474400 | 70475600 | ZMYM3 | GJB1 |
| ENST00000422194.1 | 3472 | 70882845 | 70885603 | − | seg__298 | 70877700 | 70883450 | CXCR3 | GJB1 |
| ENST00000433410.1 | 3473 | 70882848 | 70884121 | − | seg__298 | 70877700 | 70883450 | CXCR3 | GJB1 |
| ENST00000508574.1 | 3474 | 70917046 | 70926305 | + | seg__299 | 70919900 | 70923050 | CXCR3 | GJB1 |
| ENST00000508574.1 | 3475 | 70917046 | 70926305 | + | seg__300 | 70926200 | 70950300 | CXCR3 | GJB1 |
| ENST00000417668.1 | 3476 | 70938992 | 70939460 | + | seg__300 | 70926200 | 70950300 | CXCR3 | GJB1 |
| ENST00000457716.1 | 3477 | 70939766 | 70940650 | + | seg__300 | 70926200 | 70950300 | CXCR3 | GJB1 |
| ENST00000535490.1 | 3478 | 70934224 | 70938135 | − | seg__300 | 70926200 | 70950300 | CXCR3 | GJB1 |
| ENST00000452468.1 | 3479 | 70934221 | 70936237 | − | seg__300 | 70926200 | 70950300 | CXCR3 | GJB1 |
| ENST00000456199.1 | 3480 | 70981815 | 70982283 | − | seg__301 | 70972100 | 70989450 | CXCR3 | GJB1 |
| ENST00000439926.1 | 3481 | 70980625 | 70981509 | − | seg__301 | 70972100 | 70989450 | CXCR3 | GJB1 |
| ENST00000440412.1 | 3482 | 70985038 | 70987054 | + | seg__301 | 70972100 | 70989450 | CXCR3 | GJB1 |
| ENST00000542739.1 | 3483 | 70983140 | 70987051 | + | seg__301 | 70972100 | 70989450 | CXCR3 | GJB1 |
| ENST00000408757.1 | 3484 | 70979235 | 70979305 | − | seg__301 | 70972100 | 70989450 | CXCR3 | GJB1 |
| ENST00000515698.1 | 3485 | 70994970 | 71004228 | − | seg__303 | 70997850 | 70999500 | NHSL2 | GJB1 |
| ENST00000515698.1 | 3486 | 70994970 | 71004228 | − | seg__304 | 71003450 | 71005550 | NHSL2 | GJB1 |
| ENST00000540800.1 | 3487 | 71130938 | 71363424 | + | seg__307 | 71238100 | 71239150 | NHSL2 | GJB1 |
| ENST00000540800.1 | 3488 | 71130938 | 71363424 | + | seg__308 | 71261650 | 71263400 | RGAG4 | GJB1 |
| ENST00000540800.1 | 3489 | 71130938 | 71363424 | + | seg__309 | 71319750 | 71321300 | RGAG4 | GJB1 |
| ENST00000479991.1 | 3490 | 71346960 | 71351751 | − | seg__310 | 71348750 | 71353050 | RGAG4 | GJB1 |
| ENST00000545866.1 | 3491 | 71346958 | 71351758 | − | seg__310 | 71348750 | 71353050 | RGAG4 | GJB1 |
| ENST00000513469.1 | 3492 | 71352000 | 71354556 | + | seg__310 | 71348750 | 71353050 | RGAG4 | GJB1 |
| ENST00000540800.1 | 3493 | 71130938 | 71363424 | + | seg__310 | 71348750 | 71353050 | RGAG4 | GJB1 |
| ENST00000439980.2 | 3494 | 71401615 | 71522776 | + | seg__311 | 71503150 | 71504200 | RPS4X | GJB1 |
| ENST00000439980.2 | 3495 | 71401615 | 71522776 | + | seg__312 | 71512450 | 71513550 | CITED1 | GJB1 |
| ENST00000246139.5 | 3496 | 71521500 | 71526837 | − | seg__313 | 71526450 | 71528800 | CITED1 | GJB1 |
| ENST00000453707.2 | 3497 | 71521488 | 71527000 | − | seg__313 | 71526450 | 71528800 | CITED1 | GJB1 |
| ENST00000454225.1 | 3498 | 71522056 | 71526757 | − | seg__313 | 71526450 | 71528800 | CITED1 | GJB1 |
| ENST00000373619.3 | 3499 | 71521497 | 71527037 | − | seg__313 | 71526450 | 71528800 | CITED1 | GJB1 |
| ENST00000365612.1 | 3500 | 71945976 | 71946190 | − | seg__314 | 71945800 | 71946750 | PHKA1 | GJB1 |
| ENST00000276033.4 | 3501 | 73640638 | 73753752 | + | seg__319 | 73642000 | 73643200 | SLC16A2 | ABCB7 |
| ENST00000394563.3 | 3502 | 85339719 | 85341344 | − | seg__320 | 85339200 | 85340950 | CHM | CHM |
| ENST00000372964.1 | 3503 | 100098322 | 100129198 | − | seg__321 | 100106050 | 100107200 | NOX1 | BTK |
| ENST00000372961.3 | 3504 | 100098334 | 100129334 | − | seg__321 | 100106050 | 100107200 | NOX1 | BTK |
| ENST00000372966.3 | 3505 | 100098313 | 100129334 | − | seg__321 | 100106050 | 100107200 | NOX1 | BTK |
| ENST00000217885.5 | 3506 | 100098825 | 100129198 | − | seg__321 | 100106050 | 100107200 | NOX1 | BTK |
| ENST00000372960.4 | 3507 | 100098941 | 100129128 | − | seg__321 | 100106050 | 100107200 | NOX1 | BTK |
| ENST00000372957.2 | 3508 | 100098941 | 100129334 | − | seg__321 | 100106050 | 100107200 | NOX1 | BTK |
| ENST00000372964.1 | 3509 | 100098322 | 100129198 | − | seg__322 | 100119950 | 100121600 | NOX1 | BTK |
| ENST00000372961.3 | 3510 | 100098334 | 100129334 | − | seg__322 | 100119950 | 100121600 | NOX1 | BTK |
| ENST00000372966.3 | 3511 | 100098313 | 100129334 | − | seg__322 | 100119950 | 100121600 | NOX1 | BTK |
| ENST00000217885.5 | 3512 | 100098825 | 100129198 | − | seg__322 | 100119950 | 100121600 | NOX1 | BTK |
| ENST00000372960.4 | 3513 | 100098941 | 100129128 | − | seg__322 | 100119950 | 100121600 | NOX1 | BTK |
| ENST00000372957.2 | 3514 | 100098941 | 100129334 | − | seg__322 | 100119950 | 100121600 | NOX1 | BTK |
| ENST00000538510.1 | 3515 | 100486534 | 100519485 | + | seg__325 | 100514900 | 100516350 | DRP2 | BTK |
| ENST00000541709.1 | 3516 | 100474933 | 100519485 | + | seg__325 | 100514900 | 100516350 | DRP2 | BTK |
| ENST00000402866.1 | 3517 | 100474758 | 100519486 | + | seg__325 | 100514900 | 100516350 | DRP2 | BTK |
| ENST00000395209.3 | 3518 | 100474775 | 100519486 | + | seg__325 | 100514900 | 100516350 | DRP2 | BTK |
| ENST00000324762.6 | 3519 | 100523245 | 100542793 | − | seg__326 | 100532400 | 100533600 | TAF7L | BTK |
| ENST00000372907.3 | 3520 | 100523241 | 100548045 | − | seg__326 | 100532400 | 100533600 | TAF7L | BTK |
| ENST00000356784.1 | 3521 | 100523848 | 100546324 | − | seg__326 | 100532400 | 100533600 | TAF7L | BTK |
| ENST00000372905.2 | 3522 | 100523242 | 100548059 | − | seg__326 | 100532400 | 100533600 | TAF7L | BTK |
| ENST00000325117.7 | 3523 | 101801665 | 101803141 | − | seg__327 | 101800900 | 101804000 | TMSB15A | GLA |
| ENST00000372680.1 | 3524 | 102528619 | 102531800 | − | seg__330 | 102530950 | 102533100 | TCEAL5 | GLA |
| ENST00000449185.1 | 3525 | 102564600 | 102565863 | − | seg__331 | 102564900 | 102566400 | BEX2 | GLA |
| ENST00000372674.1 | 3526 | 102564430 | 102565935 | − | seg__331 | 102564900 | 102566400 | BEX2 | GLA |
| ENST00000372677.3 | 3527 | 102564274 | 102565974 | − | seg__331 | 102564900 | 102566400 | BEX2 | GLA |
| ENST00000536889.1 | 3528 | 102564282 | 102565883 | − | seg__331 | 102564900 | 102566400 | BEX2 | GLA |
| ENST00000332431.4 | 3529 | 102585124 | 102587254 | + | seg__332 | 102584350 | 102585450 | TCEAL7 | GLA |
| ENST00000372666.1 | 3530 | 102585157 | 102587016 | + | seg__332 | 102584350 | 102585450 | TCEAL7 | GLA |
| ENST00000372628.1 | 3531 | 102862379 | 102864855 | + | seg__333 | 102861350 | 102862700 | TCEAL3 | GLA |
| ENST00000447281.1 | 3532 | 103172005 | 103174131 | − | seg__337 | 103172500 | 103174800 | TMSB15B | TBG = SERPINA7 |
| ENST00000455723.1 | 3533 | 103173770 | 103187485 | + | seg__337 | 103172500 | 103174800 | TMSB15B | TBG = SERPINA7 |
| ENST00000419165.1 | 3534 | 103173479 | 103220554 | + | seg__337 | 103172500 | 103174800 | TMSB15B | TBG = SERPINA7 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000448050.1 | 3535 | 103216417 | 103216861 | − | seg_338 | 103216000 | 103218450 | TMSB15B | TBG = SERPINA7 |
| ENST00000451146.1 | 3536 | 103216382 | 103216864 | − | seg_338 | 103216000 | 103218450 | TMSB15B | TBG = SERPINA7 |
| ENST00000540220.1 | 3537 | 103217224 | 103220868 | + | seg_338 | 103216000 | 103218450 | TMSB15B | TBG = SERPINA7 |
| ENST00000436583.1 | 3538 | 103217242 | 103220554 | + | seg_338 | 103216000 | 103218450 | TMSB15B | TBG = SERPINA7 |
| ENST00000419165.1 | 3539 | 103173479 | 103220554 | + | seg_338 | 103216000 | 103218450 | TMSB15B | TBG = SERPINA7 |
| ENST00000422550.1 | 3540 | 103230404 | 103230880 | + | seg_339 | 103230800 | 103233250 | TMSB15B | TBG = SERPINA7 |
| ENST00000423478.1 | 3541 | 103356822 | 103357563 | + | seg_346 | 103355850 | 103358850 | SLC25A53 | TBG = SERPINA7 |
| ENST00000422784.1 | 3542 | 103357235 | 103360533 | + | seg_346 | 103355850 | 103358850 | SLC25A53 | TBG = SERPINA7 |
| ENST00000537356.1 | 3543 | 103357107 | 103360531 | + | seg_346 | 103355850 | 103358850 | SLC25A53 | TBG = SERPINA7 |
| ENST00000357421.4 | 3544 | 103343898 | 103401708 | − | seg_346 | 103355850 | 103358850 | SLC25A53 | TBG = SERPINA7 |
| ENST00000372582.1 | 3545 | 103810996 | 105011822 | + | seg_347 | 103812100 | 103813500 | IL1RAPL2 | TBG = SERPINA7 |
| ENST00000418562.1 | 3546 | 105937024 | 106033435 | + | seg_349 | 105968700 | 105970600 | RNF128 | TBG = SERPINA7 |
| ENST00000324342.3 | 3547 | 105937068 | 106040223 | + | seg_349 | 105968700 | 105970600 | RNF128 | TBG = SERPINA7 |
| ENST00000255499.2 | 3548 | 105969894 | 106040223 | + | seg_349 | 105968700 | 105970600 | RNF128 | TBG = SERPINA7 |
| ENST00000357242.5 | 3549 | 106045910 | 106119375 | + | seg_350 | 106044350 | 106046150 | TBC1D8B | TBG = SERPINA7 |
| ENST00000481617.2 | 3550 | 106045935 | 106073313 | + | seg_350 | 106044350 | 106046150 | TBC1D8B | TBG = SERPINA7 |
| ENST00000276175.3 | 3551 | 106046043 | 106117347 | + | seg_350 | 106044350 | 106046150 | TBC1D8B | TBG = SERPINA7 |
| ENST00000310452.2 | 3552 | 106045919 | 106093061 | + | seg_350 | 106044350 | 106046150 | TBC1D8B | TBG = SERPINA7 |
| ENST00000372453.3 | 3553 | 106449862 | 106487473 | + | seg_351 | 106482900 | 106485150 | PIH1D3 | PRPS1 |
| ENST00000535523.1 | 3554 | 106449862 | 106487472 | + | seg_351 | 106482900 | 106485150 | PIH1D3 | PRPS1 |
| ENST00000336387.4 | 3555 | 106450378 | 106486594 | + | seg_351 | 106482900 | 106485150 | PIH1D3 | PRPS1 |
| ENST00000415252.1 | 3556 | 106756213 | 106789051 | − | seg_353 | 106766500 | 106768400 | FRMPD3 | PRPS1 |
| ENST00000276185.4 | 3557 | 106765680 | 106846603 | + | seg_353 | 106766500 | 106768400 | FRMPD3 | PRPS1 |
| ENST00000276185.4 | 3558 | 106765680 | 106846603 | + | seg_354 | 106839200 | 106841100 | PRPS1 | PRPS1 |
| ENST00000439554.1 | 3559 | 106769876 | 106848481 | + | seg_354 | 106839200 | 106841100 | PRPS1 | PRPS1 |
| ENST00000276185.4 | 3560 | 106765680 | 106846603 | + | seg_355 | 106844750 | 106845950 | PRPS1 | PRPS1 |
| ENST00000439554.1 | 3561 | 106769876 | 106848481 | + | seg_355 | 106844750 | 106845950 | PRPS1 | PRPS1 |
| ENST00000372384.2 | 3562 | 106956454 | 107019218 | − | seg_357 | 106984400 | 106985900 | TSC22D3 | PRPS1 |
| ENST00000372383.4 | 3563 | 106956454 | 107019017 | − | seg_357 | 106984400 | 106985900 | TSC22D3 | PRPS1 |
| ENST00000394928.2 | 3564 | 106957214 | 107018890 | − | seg_357 | 106984400 | 106985900 | TSC22D3 | PRPS1 |
| ENST00000315660.4 | 3565 | 106956451 | 107019215 | − | seg_357 | 106984400 | 106985900 | TSC22D3 | PRPS1 |
| ENST00000506081.1 | 3566 | 106957600 | 107020297 | − | seg_357 | 106984400 | 106985900 | TSC22D3 | PRPS1 |
| ENST00000514426.1 | 3567 | 106957717 | 107020308 | − | seg_357 | 106984400 | 106985900 | TSC22D3 | PRPS1 |
| ENST00000510887.1 | 3568 | 106959142 | 107019944 | − | seg_357 | 106984400 | 106985900 | TSC22D3 | PRPS1 |
| ENST00000502650.1 | 3569 | 106959153 | 107019345 | − | seg_357 | 106984400 | 106985900 | TSC22D3 | PRPS1 |
| ENST00000514897.1 | 3570 | 106959128 | 107020572 | − | seg_357 | 106984400 | 106985900 | TSC22D3 | PRPS1 |
| ENST00000480691.2 | 3571 | 106959133 | 107020285 | − | seg_357 | 106984400 | 106985900 | TSC22D3 | PRPS1 |
| ENST00000372384.2 | 3572 | 106956454 | 107019218 | − | seg_358 | 107012550 | 107013950 | TSC22D3 | PRPS1 |
| ENST00000372383.4 | 3573 | 106956454 | 107019017 | − | seg_358 | 107012550 | 107013950 | TSC22D3 | PRPS1 |
| ENST00000394928.2 | 3574 | 106957214 | 107018890 | − | seg_358 | 107012550 | 107013950 | TSC22D3 | PRPS1 |
| ENST00000315660.4 | 3575 | 106956451 | 107019215 | − | seg_358 | 107012550 | 107013950 | TSC22D3 | PRPS1 |
| ENST00000506081.1 | 3576 | 106957600 | 107020297 | − | seg_358 | 107012550 | 107013950 | TSC22D3 | PRPS1 |
| ENST00000514426.1 | 3577 | 106957717 | 107020308 | − | seg_358 | 107012550 | 107013950 | TSC22D3 | PRPS1 |
| ENST00000510887.1 | 3578 | 106959142 | 107019944 | − | seg_358 | 107012550 | 107013950 | TSC22D3 | PRPS1 |
| ENST00000502650.1 | 3579 | 106959153 | 107019345 | − | seg_358 | 107012550 | 107013950 | TSC22D3 | PRPS1 |
| ENST00000514897.1 | 3580 | 106959128 | 107020572 | − | seg_358 | 107012550 | 107013950 | TSC22D3 | PRPS1 |
| ENST00000480691.2 | 3581 | 106959133 | 107020285 | − | seg_358 | 107012550 | 107013950 | TSC22D3 | PRPS1 |
| ENST00000506724.1 | 3582 | 107018348 | 107019488 | − | seg_359 | 107015700 | 107021050 | TSC22D3 | PRPS1 |
| ENST00000509000.1 | 3583 | 107020963 | 107037689 | + | seg_359 | 107015700 | 107021050 | TSC22D3 | PRPS1 |
| ENST00000372384.2 | 3584 | 106956454 | 107019218 | − | seg_359 | 107015700 | 107021050 | TSC22D3 | PRPS1 |
| ENST00000505965.1 | 3585 | 107018397 | 107020567 | − | seg_359 | 107015700 | 107021050 | TSC22D3 | PRPS1 |
| ENST00000372383.4 | 3586 | 106956454 | 107019017 | − | seg_359 | 107015700 | 107021050 | TSC22D3 | PRPS1 |
| ENST00000394928.2 | 3587 | 106957214 | 107018890 | − | seg_359 | 107015700 | 107021050 | TSC22D3 | PRPS1 |
| ENST00000315660.4 | 3588 | 106956451 | 107019215 | − | seg_359 | 107015700 | 107021050 | TSC22D3 | PRPS1 |
| ENST00000506081.1 | 3589 | 106957600 | 107020297 | − | seg_359 | 107015700 | 107021050 | TSC22D3 | PRPS1 |
| ENST00000514426.1 | 3590 | 106957717 | 107020308 | − | seg_359 | 107015700 | 107021050 | TSC22D3 | PRPS1 |
| ENST00000502961.1 | 3591 | 107018476 | 107020559 | − | seg_359 | 107015700 | 107021050 | TSC22D3 | PRPS1 |
| ENST00000510887.1 | 3592 | 106959142 | 107019944 | − | seg_359 | 107015700 | 107021050 | TSC22D3 | PRPS1 |
| ENST00000502650.1 | 3593 | 106959153 | 107019345 | − | seg_359 | 107015700 | 107021050 | TSC22D3 | PRPS1 |
| ENST00000514897.1 | 3594 | 106959128 | 107020572 | − | seg_359 | 107015700 | 107021050 | TSC22D3 | PRPS1 |
| ENST00000480691.2 | 3595 | 106959133 | 107020285 | − | seg_359 | 107015700 | 107021050 | TSC22D3 | PRPS1 |
| ENST00000451923.1 | 3596 | 107068985 | 107084611 | + | seg_360 | 107067200 | 107071350 | MID2 | PRPS1 |
| ENST00000443968.2 | 3597 | 107069644 | 107170423 | + | seg_360 | 107067200 | 107071350 | MID2 | PRPS1 |
| ENST00000262843.6 | 3598 | 107069109 | 107170423 | + | seg_360 | 107067200 | 107071350 | MID2 | PRPS1 |
| ENST00000430140.1 | 3599 | 107137827 | 107179210 | − | seg_361 | 107167050 | 107168350 | TEX13B | PRPS1 |
| ENST00000474517.1 | 3600 | 107160732 | 107169702 | + | seg_361 | 107167050 | 107168350 | TEX13B | PRPS1 |
| ENST00000443968.2 | 3601 | 107069644 | 107170423 | + | seg_361 | 107167050 | 107168350 | TEX13B | PRPS1 |
| ENST00000262843.6 | 3602 | 107069109 | 107170423 | + | seg_361 | 107167050 | 107168350 | TEX13B | PRPS1 |
| ENST00000415430.3 | 3603 | 107288200 | 107322414 | + | seg_362 | 107318400 | 107320100 | PSMD10 | COL4A5 |
| ENST00000217957.5 | 3604 | 107288244 | 107322327 | + | seg_362 | 107318400 | 107320100 | PSMD10 | COL4A5 |
| ENST00000545689.1 | 3605 | 107399275 | 107681556 | − | seg_363 | 107680300 | 107682050 | COL4A6 | COL4A5 |
| ENST00000538570.1 | 3606 | 107399275 | 107681556 | − | seg_363 | 107680300 | 107682050 | COL4A6 | COL4A5 |
| ENST00000394872.2 | 3607 | 107398838 | 107681658 | − | seg_363 | 107680300 | 107682050 | COL4A6 | COL4A5 |
| ENST00000461897.1 | 3608 | 107510872 | 107681660 | − | seg_363 | 107680300 | 107682050 | COL4A6 | COL4A5 |
| ENST00000468338.1 | 3609 | 107457022 | 107682702 | − | seg_363 | 107680300 | 107682050 | COL4A6 | COL4A5 |
| ENST00000541389.1 | 3610 | 107399121 | 107681660 | − | seg_363 | 107680300 | 107682050 | COL4A6 | COL4A5 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000334504.7 | 3611 | 107398837 | 107681660 | − | seg_363 | 107680300 | 107682050 | COL4A6 | COL4A5 |
| ENST00000372216.4 | 3612 | 107398837 | 107682702 | − | seg_363 | 107680300 | 107682050 | COL4A6 | COL4A5 |
| ENST00000477085.1 | 3613 | 107510872 | 107682727 | − | seg_363 | 107680300 | 107682050 | COL4A6 | COL4A5 |
| ENST00000508186.1 | 3614 | 107683236 | 107940014 | + | seg_364 | 107800800 | 107802650 | COL4A5 | COL4A5 |
| ENST00000470339.1 | 3615 | 107683172 | 107812265 | + | seg_364 | 107800800 | 107802650 | COL4A5 | COL4A5 |
| ENST00000328300.6 | 3616 | 107683112 | 107940771 | + | seg_364 | 107800800 | 107802650 | COL4A5 | COL4A5 |
| ENST00000361603.2 | 3617 | 107683112 | 107940775 | + | seg_364 | 107800800 | 107802650 | COL4A5 | COL4A5 |
| ENST00000520821.1 | 3618 | 109602044 | 109694109 | + | seg_367 | 109664500 | 109668200 | RGAG1 | COL4A5 |
| ENST00000465301.2 | 3619 | 109662285 | 109699562 | + | seg_367 | 109664500 | 109668200 | RGAG1 | COL4A5 |
| ENST00000372057.1 | 3620 | 109439638 | 109683461 | − | seg_367 | 109664500 | 109668200 | RGAG1 | COL4A5 |
| ENST00000520821.1 | 3621 | 109602044 | 109694109 | + | seg_368 | 109675200 | 109677300 | RGAG1 | COL4A5 |
| ENST00000465301.2 | 3622 | 109662285 | 109699562 | + | seg_368 | 109675200 | 109677300 | RGAG1 | COL4A5 |
| ENST00000372057.1 | 3623 | 109439638 | 109683461 | − | seg_368 | 109675200 | 109677300 | RGAG1 | COL4A5 |
| ENST00000520821.1 | 3624 | 109602044 | 109694109 | + | seg_369 | 109681600 | 109683350 | RGAG1 | COL4A5 |
| ENST00000465301.2 | 3625 | 109662285 | 109699562 | + | seg_369 | 109681600 | 109683350 | RGAG1 | COL4A5 |
| ENST00000372057.1 | 3626 | 109439638 | 109683461 | − | seg_369 | 109681600 | 109683350 | RGAG1 | COL4A5 |
| ENST00000520821.1 | 3627 | 109602044 | 109694109 | + | seg_370 | 109687600 | 109689250 | RGAG1 | COL4A5 |
| ENST00000465301.2 | 3628 | 109662285 | 109699562 | + | seg_370 | 109687600 | 109689250 | RGAG1 | COL4A5 |
| ENST00000493351.1 | 3629 | 109764358 | 109764924 | + | seg_371 | 109763200 | 109764700 | RGAG1 | COL4A5 |
| ENST00000218054.4 | 3630 | 109917092 | 110039076 | − | seg_372 | 110037400 | 110040400 | CHRDL1 | COL4A5 |
| ENST00000394797.4 | 3631 | 109918473 | 110038993 | − | seg_372 | 110037400 | 110040400 | CHRDL1 | COL4A5 |
| ENST00000434224.1 | 3632 | 109917092 | 110039286 | − | seg_372 | 110037400 | 110040400 | CHRDL1 | COL4A5 |
| ENST00000372045.1 | 3633 | 109917084 | 110038993 | − | seg_372 | 110037400 | 110040400 | CHRDL1 | COL4A5 |
| ENST00000482160.1 | 3634 | 109919169 | 110039047 | − | seg_372 | 110037400 | 110040400 | CHRDL1 | COL4A5 |
| ENST00000372042.1 | 3635 | 109919004 | 110039039 | − | seg_372 | 110037400 | 110040400 | CHRDL1 | COL4A5 |
| ENST00000444321.2 | 3636 | 109919285 | 110039047 | − | seg_372 | 110037400 | 110040400 | CHRDL1 | COL4A5 |
| ENST00000446737.1 | 3637 | 110187513 | 110464146 | + | seg_374 | 110338150 | 110339500 | PAK3 | COL4A5 |
| ENST00000425146.1 | 3638 | 110187513 | 110464146 | + | seg_374 | 110338150 | 110339500 | PAK3 | COL4A5 |
| ENST00000317135.8 | 3639 | 114345185 | 114468635 | − | seg_381 | 114467100 | 114468700 | LRCH2 | COL4A5 |
| ENST00000536655.1 | 3640 | 114345189 | 114468627 | − | seg_381 | 114467100 | 114468700 | LRCH2 | COL4A5 |
| ENST00000538422.1 | 3641 | 114345686 | 114468628 | − | seg_381 | 114467100 | 114468700 | LRCH2 | COL4A5 |
| ENST00000451869.1 | 3642 | 114957297 | 114959381 | + | seg_382 | 114956100 | 114958000 | RP1-241P17.4 | COL4A5 |
| ENST00000415394.1 | 3643 | 114957343 | 114959383 | + | seg_382 | 114956100 | 114958000 | RP1-241P17.4 | COL4A5 |
| ENST00000436163.1 | 3644 | 117250225 | 117250763 | − | seg_383 | 117249800 | 117250800 | KLHL13 | COL4A5 |
| ENST00000371882.1 | 3645 | 117031776 | 117250761 | − | seg_383 | 117249800 | 117250800 | KLHL13 | COL4A5 |
| ENST00000540167.1 | 3646 | 117031777 | 117250828 | − | seg_383 | 117249800 | 117250800 | KLHL13 | COL4A5 |
| ENST00000541812.1 | 3647 | 117031777 | 117251303 | − | seg_383 | 117249800 | 117250800 | KLHL13 | COL4A5 |
| ENST00000545703.1 | 3648 | 117031777 | 117250828 | − | seg_383 | 117249800 | 117250800 | KLHL13 | COL4A5 |
| ENST00000371642.1 | 3649 | 117861565 | 117895483 | + | seg_384 | 117862300 | 117863400 | IL13RA1 | COL4A5 |
| ENST00000371666.3 | 3650 | 117861535 | 117928502 | + | seg_384 | 117862300 | 117863400 | IL13RA1 | COL4A5 |
| ENST00000310164.2 | 3651 | 117957753 | 117960931 | + | seg_386 | 117956850 | 117963900 | ZCCHC12 | COL4A5 |
| ENST00000481285.1 | 3652 | 118108581 | 118151946 | + | seg_390 | 118109050 | 118110300 | LONRF3 | COL4A5 |
| ENST00000304778.7 | 3653 | 118108581 | 118152318 | + | seg_390 | 118109050 | 118110300 | LONRF3 | COL4A5 |
| ENST00000439603.1 | 3654 | 118109325 | 118151950 | + | seg_390 | 118109050 | 118110300 | LONRF3 | COL4A5 |
| ENST00000371628.3 | 3655 | 118108713 | 118151892 | + | seg_390 | 118109050 | 118110300 | LONRF3 | COL4A5 |
| ENST00000422289.2 | 3656 | 118110295 | 118151947 | + | seg_390 | 118109050 | 118110300 | LONRF3 | COL4A5 |
| ENST00000472173.1 | 3657 | 118110295 | 118151946 | + | seg_390 | 118109050 | 118110300 | LONRF3 | COL4A5 |
| ENST00000365713.2 | 3658 | 118108581 | 118156888 | + | seg_390 | 118109050 | 118110300 | LONRF3 | COL4A5 |
| ENST00000440399.1 | 3659 | 118212598 | 118223411 | − | seg_392 | 118212900 | 118215850 | KIAA1210 | OCRL |
| ENST00000402510.2 | 3660 | 118212598 | 118284542 | − | seg_392 | 118212900 | 118215850 | KIAA1210 | OCRL |
| ENST00000402510.2 | 3661 | 118212598 | 118284542 | − | seg_393 | 118282850 | 118287450 | KIAA1210 | OCRL |
| ENST00000535419.1 | 3662 | 118370288 | 118378428 | + | seg_396 | 118366950 | 118370450 | PGRMC1 | OCRL |
| ENST00000217971.7 | 3663 | 118370216 | 118378429 | + | seg_396 | 118366950 | 118370450 | PGRMC1 | OCRL |
| ENST00000428222.1 | 3664 | 118425492 | 118469573 | + | seg_397 | 118441450 | 118445300 | PGRMC1 | OCRL |
| ENST00000428222.1 | 3665 | 118425492 | 118469573 | + | seg_398 | 118449700 | 118451000 | PGRMC1 | OCRL |
| ENST00000428222.1 | 3666 | 118425492 | 118469573 | + | seg_399 | 118457400 | 118458500 | SLC25A43 | OCRL |
| ENST00000413240.1 | 3667 | 118490264 | 118527558 | − | seg_401 | 118493600 | 118495250 | SLC25A43 | OCRL |
| ENST00000413240.1 | 3668 | 118490264 | 118527558 | − | seg_402 | 118496550 | 118498200 | SLC25A43 | OCRL |
| ENST00000413240.1 | 3669 | 118490264 | 118527558 | − | seg_403 | 118503050 | 118504750 | SLC25A43 | OCRL |
| ENST00000511924.1 | 3670 | 118513675 | 118514067 | + | seg_404 | 118513250 | 118514500 | SLC25A43 | OCRL |
| ENST00000413240.1 | 3671 | 118490264 | 118527558 | − | seg_404 | 118513250 | 118514500 | SLC25A43 | OCRL |
| ENST00000454625.1 | 3672 | 119144675 | 119149501 | − | seg_409 | 119146350 | 119147850 | RHOXF2B | OCRL |
| ENST00000454625.1 | 3673 | 119144675 | 119149501 | − | seg_410 | 119149700 | 119157100 | RHOXF2B | OCRL |
| ENST00000218008.3 | 3674 | 119495967 | 119516226 | + | seg_412 | 119504000 | 119505500 | ATP1B4 | OCRL |
| ENST00000539306.1 | 3675 | 119495997 | 119513514 | + | seg_412 | 119504000 | 119505500 | ATP1B4 | OCRL |
| ENST00000361319.3 | 3676 | 119495967 | 119516226 | + | seg_412 | 119504000 | 119505500 | ATP1B4 | OCRL |
| ENST00000218008.3 | 3677 | 119495967 | 119516226 | + | seg_413 | 119514900 | 119515950 | ATP1B4 | OCRL |
| ENST00000361319.3 | 3678 | 119495967 | 119516226 | + | seg_413 | 119514900 | 119515950 | ATP1B4 | OCRL |
| ENST00000427955.1 | 3679 | 119866948 | 119867250 | + | seg_414 | 119865950 | 119867450 | C1GALT1C1 | OCRL |
| ENST00000479118.1 | 3680 | 122318412 | 122387553 | + | seg_416 | 122316650 | 122320500 | GRIA3 | OCRL |
| ENST00000371264.3 | 3681 | 122318152 | 122338534 | + | seg_416 | 122316650 | 122320500 | GRIA3 | OCRL |
| ENST00000371266.1 | 3682 | 122318006 | 122338534 | + | seg_416 | 122316650 | 122320500 | GRIA3 | OCRL |
| ENST00000335161.8 | 3683 | 122318224 | 122338270 | + | seg_416 | 122316650 | 122320500 | GRIA3 | OCRL |
| ENST00000541091.1 | 3684 | 122318765 | 122551942 | + | seg_416 | 122316650 | 122320500 | GRIA3 | OCRL |
| ENST00000371251.1 | 3685 | 122318336 | 122616897 | + | seg_416 | 122316650 | 122320500 | GRIA3 | OCRL |
| ENST00000264357.5 | 3686 | 122318096 | 122624756 | + | seg_416 | 122316650 | 122320500 | GRIA3 | OCRL |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000371256.5 | 3687 | 122318336 | 122624766 | + | seg_416 | 122316650 | 122320500 | GRIA3 | OCRL |
| ENST00000542149.1 | 3688 | 122318224 | 122622587 | + | seg_416 | 122316650 | 122320500 | GRIA3 | OCRL |
| ENST00000541091.1 | 3689 | 122318765 | 122551942 | + | seg_417 | 122402300 | 122404250 | GRIA3 | OCRL |
| ENST00000371251.1 | 3690 | 122318336 | 122616897 | + | seg_417 | 122402300 | 122404250 | GRIA3 | OCRL |
| ENST00000264357.5 | 3691 | 122318096 | 122624756 | + | seg_417 | 122402300 | 122404250 | GRIA3 | OCRL |
| ENST00000371256.5 | 3692 | 122318336 | 122624766 | + | seg_417 | 122402300 | 122404250 | GRIA3 | OCRL |
| ENST00000542149.1 | 3693 | 122318224 | 122622587 | + | seg_417 | 122402300 | 122404250 | GRIA3 | OCRL |
| ENST00000469481.1 | 3694 | 123094545 | 123556514 | + | seg_418 | 123373100 | 123375500 | SH2D1A | OCRL |
| ENST00000429967.1 | 3695 | 128779786 | 128788914 | − | seg_420 | 128781700 | 128784050 | APLN | OCRL |
| ENST00000427399.1 | 3696 | 128781653 | 128782742 | − | seg_420 | 128781700 | 128784050 | APLN | OCRL |
| ENST00000307484.6 | 3697 | 128779240 | 128788933 | − | seg_420 | 128781700 | 128784050 | APLN | OCRL |
| ENST00000429967.1 | 3698 | 128779786 | 128788914 | − | seg_421 | 128788300 | 128792400 | APLN | OCRL |
| ENST00000307484.6 | 3699 | 128779240 | 128788933 | − | seg_421 | 128788300 | 128792400 | APLN | OCRL |
| ENST00000257017.4 | 3700 | 129305623 | 129318844 | + | seg_427 | 129312750 | 129314600 | RAB33A | OCRL |
| ENST00000276218.2 | 3701 | 129518319 | 129519511 | − | seg_429 | 129518000 | 129519450 | GPR119 | OCRL |
| ENST00000412420.1 | 3702 | 130150443 | 130192120 | − | seg_431 | 130182350 | 130183950 | ARHGAP36 | NYS1 = FRMD7 |
| ENST00000370922.1 | 3703 | 130192331 | 130223857 | + | seg_432 | 130192100 | 130193800 | ARHGAP36 | NYS1 = FRMD7 |
| ENST00000276211.5 | 3704 | 130192216 | 130223853 | + | seg_432 | 130192100 | 130193800 | ARHGAP36 | NYS1 = FRMD7 |
| ENST00000412420.1 | 3705 | 130150443 | 130192120 | − | seg_432 | 130192100 | 130193800 | ARHGAP36 | NYS1 = FRMD7 |
| ENST00000464296.1 | 3706 | 131211900 | 131261872 | − | seg_435 | 131217450 | 131219600 | FRMD7 | NYS1 = FRMD7 |
| ENST00000298542.4 | 3707 | 131211023 | 131262048 | − | seg_435 | 131217450 | 131219600 | FRMD7 | NYS1 = FRMD7 |
| ENST00000370879.1 | 3708 | 131211021 | 131228291 | − | seg_435 | 131217450 | 131219600 | FRMD7 | NYS1 = FRMD7 |
| ENST00000464296.1 | 3709 | 131211900 | 131261872 | − | seg_436 | 131226100 | 131227550 | FRMD7 | NYS1 = FRMD7 |
| ENST00000298542.4 | 3710 | 131211023 | 131262048 | − | seg_436 | 131226100 | 131227550 | FRMD7 | NYS1 = FRMD7 |
| ENST00000370879.1 | 3711 | 131211021 | 131228291 | − | seg_436 | 131226100 | 131227550 | FRMD7 | NYS1 = FRMD7 |
| ENST00000464296.1 | 3712 | 131211900 | 131261872 | − | seg_437 | 131234500 | 131238250 | FRMD7 | NYS1 = FRMD7 |
| ENST00000298542.4 | 3713 | 131211023 | 131262048 | − | seg_437 | 131234500 | 131238250 | FRMD7 | NYS1 = FRMD7 |
| ENST00000513703.1 | 3714 | 131234662 | 131261900 | − | seg_437 | 131234500 | 131238250 | FRMD7 | NYS1 = FRMD7 |
| ENST00000370853.3 | 3715 | 131512177 | 131573718 | − | seg_438 | 131552950 | 131554550 | MBNL3 | NYS1 = FRMD7 |
| ENST00000370857.3 | 3716 | 131506029 | 131573705 | − | seg_438 | 131552950 | 131554550 | MBNL3 | NYS1 = FRMD7 |
| ENST00000370839.3 | 3717 | 131513232 | 131573718 | − | seg_438 | 131552950 | 131554550 | MBNL3 | NYS1 = FRMD7 |
| ENST00000370844.1 | 3718 | 131513232 | 131623996 | − | seg_438 | 131552950 | 131554550 | MBNL3 | NYS1 = FRMD7 |
| ENST00000421707.1 | 3719 | 131518691 | 131623043 | − | seg_438 | 131552950 | 131554550 | MBNL3 | NYS1 = FRMD7 |
| ENST00000421483.1 | 3720 | 131351175 | 131564190 | + | seg_438 | 131552950 | 131554550 | MBNL3 | NYS1 = FRMD7 |
| ENST00000436215.1 | 3721 | 131516244 | 131623894 | − | seg_438 | 131552950 | 131554550 | MBNL3 | NYS1 = FRMD7 |
| ENST00000441399.1 | 3722 | 131352535 | 131566890 | + | seg_438 | 131552950 | 131554550 | MBNL3 | NYS1 = FRMD7 |
| ENST00000370853.3 | 3723 | 131512177 | 131573718 | − | seg_439 | 131555800 | 131556900 | MBNL3 | NYS1 = FRMD7 |
| ENST00000370857.3 | 3724 | 131506029 | 131573705 | − | seg_439 | 131555800 | 131556900 | MBNL3 | NYS1 = FRMD7 |
| ENST00000370839.3 | 3725 | 131513232 | 131573718 | − | seg_439 | 131555800 | 131556900 | MBNL3 | NYS1 = FRMD7 |
| ENST00000370844.1 | 3726 | 131513232 | 131623996 | − | seg_439 | 131555800 | 131556900 | MBNL3 | NYS1 = FRMD7 |
| ENST00000421707.1 | 3727 | 131518691 | 131623043 | − | seg_439 | 131555800 | 131556900 | MBNL3 | NYS1 = FRMD7 |
| ENST00000421483.1 | 3728 | 131351175 | 131564190 | + | seg_439 | 131555800 | 131556900 | MBNL3 | NYS1 = FRMD7 |
| ENST00000436215.1 | 3729 | 131516244 | 131623894 | − | seg_439 | 131555800 | 131556900 | MBNL3 | NYS1 = FRMD7 |
| ENST00000441399.1 | 3730 | 131352535 | 131566890 | + | seg_439 | 131555800 | 131556900 | MBNL3 | NYS1 = FRMD7 |
| ENST00000517294.1 | 3731 | 133371077 | 133380237 | + | seg_443 | 133370100 | 133372950 | CCDC160 | HPRT1 = HPRT |
| ENST00000370809.1 | 3732 | 133371077 | 133379808 | + | seg_443 | 133370100 | 133372950 | CCDC160 | HPRT1 = HPRT |
| ENST00000359237.4 | 3733 | 133699868 | 133792513 | − | seg_444 | 133751450 | 133752450 | PLAC1 | HPRT1 = HPRT |
| ENST00000476971.1 | 3734 | 133699907 | 133867666 | − | seg_444 | 133751450 | 133752450 | PLAC1 | HPRT1 = HPRT |
| ENST00000466797.1 | 3735 | 133735587 | 133898352 | − | seg_444 | 133751450 | 133752450 | PLAC1 | HPRT1 = HPRT |
| ENST00000473897.1 | 3736 | 133700540 | 133898293 | − | seg_444 | 133751450 | 133752450 | PLAC1 | HPRT1 = HPRT |
| ENST00000359237.4 | 3737 | 133699868 | 133792513 | − | seg_445 | 133779700 | 133780700 | PLAC1 | HPRT1 = HPRT |
| ENST00000476971.1 | 3738 | 133699907 | 133867666 | − | seg_445 | 133779700 | 133780700 | PLAC1 | HPRT1 = HPRT |
| ENST00000466797.1 | 3739 | 133735587 | 133898352 | − | seg_445 | 133779700 | 133780700 | PLAC1 | HPRT1 = HPRT |
| ENST00000473897.1 | 3740 | 133700540 | 133898293 | − | seg_445 | 133779700 | 133780700 | PLAC1 | HPRT1 = HPRT |
| ENST00000390132.2 | 3741 | 133811215 | 133811301 | + | seg_446 | 133810300 | 133811300 | PLAC1 | HPRT1 = HPRT |
| ENST00000476971.1 | 3742 | 133699907 | 133867666 | − | seg_446 | 133810300 | 133811300 | PLAC1 | HPRT1 = HPRT |
| ENST00000466797.1 | 3743 | 133735587 | 133898352 | − | seg_446 | 133810300 | 133811300 | PLAC1 | HPRT1 = HPRT |
| ENST00000473897.1 | 3744 | 133700540 | 133898293 | − | seg_446 | 133810300 | 133811300 | PLAC1 | HPRT1 = HPRT |
| ENST00000414371.2 | 3745 | 133930819 | 133957005 | + | seg_447 | 133937450 | 133939700 | FAM122C | HPRT1 = HPRT |
| ENST00000463842.1 | 3746 | 133979255 | 133988320 | + | seg_448 | 133984050 | 133985200 | FAM122C | HPRT1 = HPRT |
| ENST00000460216.1 | 3747 | 133973203 | 133988213 | + | seg_448 | 133984050 | 133985200 | FAM122C | HPRT1 = HPRT |
| ENST00000470657.1 | 3748 | 133941283 | 133986921 | + | seg_448 | 133984050 | 133985200 | FAM122C | HPRT1 = HPRT |
| ENST00000370784.4 | 3749 | 133941223 | 133988640 | + | seg_448 | 133984050 | 133985200 | FAM122C | HPRT1 = HPRT |
| ENST00000370785.3 | 3750 | 133941224 | 133988621 | + | seg_448 | 133984050 | 133985200 | FAM122C | HPRT1 = HPRT |
| ENST00000445123.1 | 3751 | 133941267 | 133988640 | + | seg_448 | 133984050 | 133985200 | FAM122C | HPRT1 = HPRT |
| ENST00000538706.1 | 3752 | 134155544 | 134156172 | − | seg_454 | 134153750 | 134155600 | FAM127C | HPRT1 = HPRT |
| ENST00000391440.1 | 3753 | 134154543 | 134156559 | − | seg_454 | 134153750 | 134155600 | FAM127C | HPRT1 = HPRT |
| ENST00000455568.1 | 3754 | 134229143 | 134232388 | − | seg_455 | 134232350 | 134234600 | FAM127B | HPRT1 = HPRT |
| ENST00000433425.1 | 3755 | 134230877 | 134232654 | − | seg_455 | 134232350 | 134234600 | FAM127B | HPRT1 = HPRT |
| ENST00000535837.1 | 3756 | 134232427 | 134232630 | − | seg_455 | 134232350 | 134234600 | FAM127B | HPRT1 = HPRT |
| ENST00000454984.1 | 3757 | 134269077 | 134269698 | − | seg_457 | 134267150 | 134272000 | CXorf48 | HPRT1 = HPRT |
| ENST00000461224.1 | 3758 | 134317162 | 134317234 | − | seg_458 | 134313200 | 134319300 | CXorf48 | HPRT1 = HPRT |
| ENST00000441416.1 | 3759 | 134314179 | 134328610 | − | seg_458 | 134313200 | 134319300 | CXorf48 | HPRT1 = HPRT |
| ENST00000441416.1 | 3760 | 134314179 | 134328610 | − | seg_459 | 134322900 | 134324600 | CXorf48 | HPRT1 = HPRT |
| ENST00000445718.1 | 3761 | 134335662 | 134349163 | + | seg_460 | 134342600 | 134344200 | CXorf48 | HPRT1 = HPRT |
| ENST00000445718.1 | 3762 | 134335662 | 134349163 | + | seg_461 | 134345900 | 134351900 | CXorf48 | HPRT1 = HPRT |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000442950.1 | 3763 | 134370740 | 134371295 | + | seg_462 | 134368650 | 134375600 | ZNF75D | HPRT1 = HPRT |
| ENST00000494295.1 | 3764 | 134382867 | 134478012 | − | seg_463 | 134383050 | 134384100 | ZNF75D | HPRT1 = HPRT |
| ENST00000417443.1 | 3765 | 134555868 | 134559682 | + | seg_464 | 134557050 | 134558100 | ZNF449 | HPRT1 = HPRT |
| ENST00000426910.1 | 3766 | 134566885 | 134572559 | + | seg_465 | 134567350 | 134570450 | DDX26B | HPRT1 = HPRT |
| ENST00000537770.1 | 3767 | 134975885 | 134995175 | + | seg_471 | 134974900 | 134976100 | SAGE1 | HPRT1 = HPRT |
| ENST00000324447.3 | 3768 | 134971374 | 134995175 | + | seg_471 | 134974900 | 134976100 | SAGE1 | HPRT1 = HPRT |
| ENST00000535938.1 | 3769 | 134975785 | 134995219 | + | seg_471 | 134974900 | 134976100 | SAGE1 | HPRT1 = HPRT |
| ENST00000536581.1 | 3770 | 135229692 | 135292637 | + | seg_477 | 135230550 | 135237050 | FHL1 | HPRT1 = HPRT |
| ENST00000420362.1 | 3771 | 135229825 | 135290725 | + | seg_477 | 135230550 | 135237050 | FHL1 | HPRT1 = HPRT |
| ENST00000370690.3 | 3772 | 135229624 | 135293518 | + | seg_477 | 135230550 | 135237050 | FHL1 | HPRT1 = HPRT |
| ENST00000535737.1 | 3773 | 135230737 | 135293518 | + | seg_477 | 135230550 | 135237050 | FHL1 | HPRT1 = HPRT |
| ENST00000394155.2 | 3774 | 135229559 | 135293518 | + | seg_477 | 135230550 | 135237050 | FHL1 | HPRT1 = HPRT |
| ENST00000458357.1 | 3775 | 135230270 | 135290084 | + | seg_477 | 135230550 | 135237050 | FHL1 | HPRT1 = HPRT |
| ENST00000536581.1 | 3776 | 135229692 | 135292637 | + | seg_478 | 135238700 | 135240650 | FHL1 | HPRT1 = HPRT |
| ENST00000420362.1 | 3777 | 135229825 | 135290725 | + | seg_478 | 135238700 | 135240650 | FHL1 | HPRT1 = HPRT |
| ENST00000370690.3 | 3778 | 135229624 | 135293518 | + | seg_478 | 135238700 | 135240650 | FHL1 | HPRT1 = HPRT |
| ENST00000535737.1 | 3779 | 135230737 | 135293518 | + | seg_478 | 135238700 | 135240650 | FHL1 | HPRT1 = HPRT |
| ENST00000394155.2 | 3780 | 135229559 | 135293518 | + | seg_478 | 135238700 | 135240650 | FHL1 | HPRT1 = HPRT |
| ENST00000458357.1 | 3781 | 135230270 | 135290084 | + | seg_478 | 135238700 | 135240650 | FHL1 | HPRT1 = HPRT |
| ENST00000345434.3 | 3782 | 135252085 | 135293518 | + | seg_479 | 135247650 | 135253150 | FHL1 | HPRT1 = HPRT |
| ENST00000536581.1 | 3783 | 135229692 | 135292637 | + | seg_479 | 135247650 | 135253150 | FHL1 | HPRT1 = HPRT |
| ENST00000434885.1 | 3784 | 135250353 | 135290734 | + | seg_479 | 135247650 | 135253150 | FHL1 | HPRT1 = HPRT |
| ENST00000543669.1 | 3785 | 135251455 | 135293518 | + | seg_479 | 135247650 | 135253150 | FHL1 | HPRT1 = HPRT |
| ENST00000449474.1 | 3786 | 135252050 | 135290042 | + | seg_479 | 135247650 | 135253150 | FHL1 | HPRT1 = HPRT |
| ENST00000420362.1 | 3787 | 135229825 | 135290725 | + | seg_479 | 135247650 | 135253150 | FHL1 | HPRT1 = HPRT |
| ENST00000452016.1 | 3788 | 135249163 | 135290734 | + | seg_479 | 135247650 | 135253150 | FHL1 | HPRT1 = HPRT |
| ENST00000456218.2 | 3789 | 135251962 | 135293518 | + | seg_479 | 135247650 | 135253150 | FHL1 | HPRT1 = HPRT |
| ENST00000394153.2 | 3790 | 135251796 | 135293518 | + | seg_479 | 135247650 | 135253150 | FHL1 | HPRT1 = HPRT |
| ENST00000370690.3 | 3791 | 135229624 | 135293518 | + | seg_479 | 135247650 | 135253150 | FHL1 | HPRT1 = HPRT |
| ENST00000535737.1 | 3792 | 135230737 | 135293518 | + | seg_479 | 135247650 | 135253150 | FHL1 | HPRT1 = HPRT |
| ENST00000456445.1 | 3793 | 135251835 | 135290729 | + | seg_479 | 135247650 | 135253150 | FHL1 | HPRT1 = HPRT |
| ENST00000394155.2 | 3794 | 135229559 | 135293518 | + | seg_479 | 135247650 | 135253150 | FHL1 | HPRT1 = HPRT |
| ENST00000458357.1 | 3795 | 135230270 | 135290084 | + | seg_479 | 135247650 | 135253150 | FHL1 | HPRT1 = HPRT |
| ENST00000345434.3 | 3796 | 135252085 | 135293518 | + | seg_480 | 135255700 | 135257250 | FHL1 | HPRT1 = HPRT |
| ENST00000536581.1 | 3797 | 135229692 | 135292637 | + | seg_480 | 135255700 | 135257250 | FHL1 | HPRT1 = HPRT |
| ENST00000434885.1 | 3798 | 135250353 | 135290734 | + | seg_480 | 135255700 | 135257250 | FHL1 | HPRT1 = HPRT |
| ENST00000543669.1 | 3799 | 135251455 | 135293518 | + | seg_480 | 135255700 | 135257250 | FHL1 | HPRT1 = HPRT |
| ENST00000449474.1 | 3800 | 135252050 | 135290042 | + | seg_480 | 135255700 | 135257250 | FHL1 | HPRT1 = HPRT |
| ENST00000420362.1 | 3801 | 135229825 | 135290725 | + | seg_480 | 135255700 | 135257250 | FHL1 | HPRT1 = HPRT |
| ENST00000452016.1 | 3802 | 135249163 | 135290734 | + | seg_480 | 135255700 | 135257250 | FHL1 | HPRT1 = HPRT |
| ENST00000456218.2 | 3803 | 135251962 | 135293518 | + | seg_480 | 135255700 | 135257250 | FHL1 | HPRT1 = HPRT |
| ENST00000394153.2 | 3804 | 135251796 | 135293518 | + | seg_480 | 135255700 | 135257250 | FHL1 | HPRT1 = HPRT |
| ENST00000370690.3 | 3805 | 135229624 | 135293518 | + | seg_480 | 135255700 | 135257250 | FHL1 | HPRT1 = HPRT |
| ENST00000535737.1 | 3806 | 135230737 | 135293518 | + | seg_480 | 135255700 | 135257250 | FHL1 | HPRT1 = HPRT |
| ENST00000456445.1 | 3807 | 135251835 | 135290729 | + | seg_480 | 135255700 | 135257250 | FHL1 | HPRT1 = HPRT |
| ENST00000394155.2 | 3808 | 135229559 | 135293518 | + | seg_480 | 135255700 | 135257250 | FHL1 | HPRT1 = HPRT |
| ENST00000458357.1 | 3809 | 135230270 | 135290084 | + | seg_480 | 135255700 | 135257250 | FHL1 | HPRT1 = HPRT |
| ENST00000345434.3 | 3810 | 135252085 | 135293518 | + | seg_481 | 135261000 | 135263500 | FHL1 | HPRT1 = HPRT |
| ENST00000536581.1 | 3811 | 135229692 | 135292637 | + | seg_481 | 135261000 | 135263500 | FHL1 | HPRT1 = HPRT |
| ENST00000434885.1 | 3812 | 135250353 | 135290734 | + | seg_481 | 135261000 | 135263500 | FHL1 | HPRT1 = HPRT |
| ENST00000543669.1 | 3813 | 135251455 | 135293518 | + | seg_481 | 135261000 | 135263500 | FHL1 | HPRT1 = HPRT |
| ENST00000449474.1 | 3814 | 135252050 | 135290042 | + | seg_481 | 135261000 | 135263500 | FHL1 | HPRT1 = HPRT |
| ENST00000420362.1 | 3815 | 135229825 | 135290725 | + | seg_481 | 135261000 | 135263500 | FHL1 | HPRT1 = HPRT |
| ENST00000452016.1 | 3816 | 135249163 | 135290734 | + | seg_481 | 135261000 | 135263500 | FHL1 | HPRT1 = HPRT |
| ENST00000456218.2 | 3817 | 135251962 | 135293518 | + | seg_481 | 135261000 | 135263500 | FHL1 | HPRT1 = HPRT |
| ENST00000394153.2 | 3818 | 135251796 | 135293518 | + | seg_481 | 135261000 | 135263500 | FHL1 | HPRT1 = HPRT |
| ENST00000370690.3 | 3819 | 135229624 | 135293518 | + | seg_481 | 135261000 | 135263500 | FHL1 | HPRT1 = HPRT |
| ENST00000535737.1 | 3820 | 135230737 | 135293518 | + | seg_481 | 135261000 | 135263500 | FHL1 | HPRT1 = HPRT |
| ENST00000456445.1 | 3821 | 135251835 | 135290729 | + | seg_481 | 135261000 | 135263500 | FHL1 | HPRT1 = HPRT |
| ENST00000394155.2 | 3822 | 135229559 | 135293518 | + | seg_481 | 135261000 | 135263500 | FHL1 | HPRT1 = HPRT |
| ENST00000458357.1 | 3823 | 135230270 | 135290084 | + | seg_481 | 135261000 | 135263500 | FHL1 | HPRT1 = HPRT |
| ENST00000542704.1 | 3824 | 135279212 | 135292265 | + | seg_482 | 135278300 | 135279400 | FHL1 | HPRT1 = HPRT |
| ENST00000477204.1 | 3825 | 135279222 | 135289710 | + | seg_482 | 135278300 | 135279400 | FHL1 | HPRT1 = HPRT |
| ENST00000370676.3 | 3826 | 135279185 | 135292226 | + | seg_482 | 135278300 | 135279400 | FHL1 | HPRT1 = HPRT |
| ENST00000539015.1 | 3827 | 135278913 | 135293518 | + | seg_482 | 135278300 | 135279400 | FHL1 | HPRT1 = HPRT |
| ENST00000370683.1 | 3828 | 135278932 | 135293518 | + | seg_482 | 135278300 | 135279400 | FHL1 | HPRT1 = HPRT |
| ENST00000345434.3 | 3829 | 135252085 | 135293518 | + | seg_482 | 135278300 | 135279400 | FHL1 | HPRT1 = HPRT |
| ENST00000536581.1 | 3830 | 135229692 | 135292637 | + | seg_482 | 135278300 | 135279400 | FHL1 | HPRT1 = HPRT |
| ENST00000434885.1 | 3831 | 135250353 | 135290734 | + | seg_482 | 135278300 | 135279400 | FHL1 | HPRT1 = HPRT |
| ENST00000543669.1 | 3832 | 135251455 | 135293518 | + | seg_482 | 135278300 | 135279400 | FHL1 | HPRT1 = HPRT |
| ENST00000449474.1 | 3833 | 135252050 | 135290042 | + | seg_482 | 135278300 | 135279400 | FHL1 | HPRT1 = HPRT |
| ENST00000420362.1 | 3834 | 135229825 | 135290725 | + | seg_482 | 135278300 | 135279400 | FHL1 | HPRT1 = HPRT |
| ENST00000452016.1 | 3835 | 135249163 | 135290734 | + | seg_482 | 135278300 | 135279400 | FHL1 | HPRT1 = HPRT |
| ENST00000456218.2 | 3836 | 135251962 | 135293518 | + | seg_482 | 135278300 | 135279400 | FHL1 | HPRT1 = HPRT |
| ENST00000394153.2 | 3837 | 135251796 | 135293518 | + | seg_482 | 135278300 | 135279400 | FHL1 | HPRT1 = HPRT |
| ENST00000370690.3 | 3838 | 135229624 | 135293518 | + | seg_482 | 135278300 | 135279400 | FHL1 | HPRT1 = HPRT |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000535737.1 | 3839 | 135230737 | 135293518 | + | seg_482 | 135278300 | 135279400 | FHL1 | HPRT1 = HPRT |
| ENST00000456445.1 | 3840 | 135251835 | 135290729 | + | seg_482 | 135278300 | 135279400 | FHL1 | HPRT1 = HPRT |
| ENST00000394155.2 | 3841 | 135229559 | 135293518 | + | seg_482 | 135278300 | 135279400 | FHL1 | HPRT1 = HPRT |
| ENST00000458357.1 | 3842 | 135230270 | 135290084 | + | seg_482 | 135278300 | 135279400 | FHL1 | HPRT1 = HPRT |
| ENST00000542704.1 | 3843 | 135279212 | 135292265 | + | seg_483 | 135280500 | 135283000 | FHL1 | HPRT1 = HPRT |
| ENST00000477204.1 | 3844 | 135279222 | 135289710 | + | seg_483 | 135280500 | 135283000 | FHL1 | HPRT1 = HPRT |
| ENST00000370676.3 | 3845 | 135279185 | 135292226 | + | seg_483 | 135280500 | 135283000 | FHL1 | HPRT1 = HPRT |
| ENST00000539015.1 | 3846 | 135278913 | 135293518 | + | seg_483 | 135280500 | 135283000 | FHL1 | HPRT1 = HPRT |
| ENST00000370683.1 | 3847 | 135278932 | 135293518 | + | seg_483 | 135280500 | 135283000 | FHL1 | HPRT1 = HPRT |
| ENST00000345434.3 | 3848 | 135252085 | 135293518 | + | seg_483 | 135280500 | 135283000 | FHL1 | HPRT1 = HPRT |
| ENST00000536581.1 | 3849 | 135229692 | 135292637 | + | seg_483 | 135280500 | 135283000 | FHL1 | HPRT1 = HPRT |
| ENST00000434885.1 | 3850 | 135250353 | 135290734 | + | seg_483 | 135280500 | 135283000 | FHL1 | HPRT1 = HPRT |
| ENST00000543669.1 | 3851 | 135251455 | 135293518 | + | seg_483 | 135280500 | 135283000 | FHL1 | HPRT1 = HPRT |
| ENST00000449474.1 | 3852 | 135252050 | 135290042 | + | seg_483 | 135280500 | 135283000 | FHL1 | HPRT1 = HPRT |
| ENST00000420362.1 | 3853 | 135229825 | 135290725 | + | seg_483 | 135280500 | 135283000 | FHL1 | HPRT1 = HPRT |
| ENST00000452016.1 | 3854 | 135249163 | 135290734 | + | seg_483 | 135280500 | 135283000 | FHL1 | HPRT1 = HPRT |
| ENST00000456218.2 | 3855 | 135251962 | 135293518 | + | seg_483 | 135280500 | 135283000 | FHL1 | HPRT1 = HPRT |
| ENST00000394153.2 | 3856 | 135251796 | 135293518 | + | seg_483 | 135280500 | 135283000 | FHL1 | HPRT1 = HPRT |
| ENST00000370690.3 | 3857 | 135229624 | 135293518 | + | seg_483 | 135280500 | 135283000 | FHL1 | HPRT1 = HPRT |
| ENST00000535737.1 | 3858 | 135230737 | 135293518 | + | seg_483 | 135280500 | 135283000 | FHL1 | HPRT1 = HPRT |
| ENST00000456445.1 | 3859 | 135251835 | 135290729 | + | seg_483 | 135280500 | 135283000 | FHL1 | HPRT1 = HPRT |
| ENST00000394155.2 | 3860 | 135229559 | 135293518 | + | seg_483 | 135280500 | 135283000 | FHL1 | HPRT1 = HPRT |
| ENST00000458357.1 | 3861 | 135230270 | 135290084 | + | seg_483 | 135280500 | 135283000 | FHL1 | HPRT1 = HPRT |
| ENST00000477080.1 | 3862 | 135287068 | 135289820 | + | seg_484 | 135286200 | 135288850 | FHL1 | HPRT1 = HPRT |
| ENST00000370674.1 | 3863 | 135286880 | 135292113 | + | seg_484 | 135286200 | 135288850 | FHL1 | HPRT1 = HPRT |
| ENST00000542704.1 | 3864 | 135279212 | 135292265 | + | seg_484 | 135286200 | 135288850 | FHL1 | HPRT1 = HPRT |
| ENST00000477204.1 | 3865 | 135279222 | 135289710 | + | seg_484 | 135286200 | 135288850 | FHL1 | HPRT1 = HPRT |
| ENST00000370676.3 | 3866 | 135279185 | 135292226 | + | seg_484 | 135286200 | 135288850 | FHL1 | HPRT1 = HPRT |
| ENST00000539015.1 | 3867 | 135278913 | 135293518 | + | seg_484 | 135286200 | 135288850 | FHL1 | HPRT1 = HPRT |
| ENST00000370683.1 | 3868 | 135278932 | 135293518 | + | seg_484 | 135286200 | 135288850 | FHL1 | HPRT1 = HPRT |
| ENST00000345434.3 | 3869 | 135252085 | 135293518 | + | seg_484 | 135286200 | 135288850 | FHL1 | HPRT1 = HPRT |
| ENST00000536581.1 | 3870 | 135229692 | 135292637 | + | seg_484 | 135286200 | 135288850 | FHL1 | HPRT1 = HPRT |
| ENST00000434885.1 | 3871 | 135250353 | 135290734 | + | seg_484 | 135286200 | 135288850 | FHL1 | HPRT1 = HPRT |
| ENST00000543669.1 | 3872 | 135251455 | 135293518 | + | seg_484 | 135286200 | 135288850 | FHL1 | HPRT1 = HPRT |
| ENST00000449474.1 | 3873 | 135252050 | 135290042 | + | seg_484 | 135286200 | 135288850 | FHL1 | HPRT1 = HPRT |
| ENST00000420362.1 | 3874 | 135229825 | 135290725 | + | seg_484 | 135286200 | 135288850 | FHL1 | HPRT1 = HPRT |
| ENST00000452016.1 | 3875 | 135249163 | 135290734 | + | seg_484 | 135286200 | 135288850 | FHL1 | HPRT1 = HPRT |
| ENST00000456218.2 | 3876 | 135251962 | 135293518 | + | seg_484 | 135286200 | 135288850 | FHL1 | HPRT1 = HPRT |
| ENST00000394153.2 | 3877 | 135251796 | 135293518 | + | seg_484 | 135286200 | 135288850 | FHL1 | HPRT1 = HPRT |
| ENST00000370690.3 | 3878 | 135229624 | 135293518 | + | seg_484 | 135286200 | 135288850 | FHL1 | HPRT1 = HPRT |
| ENST00000535737.1 | 3879 | 135230737 | 135293518 | + | seg_484 | 135286200 | 135288850 | FHL1 | HPRT1 = HPRT |
| ENST00000456445.1 | 3880 | 135251835 | 135290729 | + | seg_484 | 135286200 | 135288850 | FHL1 | HPRT1 = HPRT |
| ENST00000394155.2 | 3881 | 135229559 | 135293518 | + | seg_484 | 135286200 | 135288850 | FHL1 | HPRT1 = HPRT |
| ENST00000458357.1 | 3882 | 135230270 | 135290084 | + | seg_484 | 135286200 | 135288850 | FHL1 | HPRT1 = HPRT |
| ENST00000370648.3 | 3883 | 135570046 | 135575939 | + | seg_485 | 135570450 | 135571950 | BRS3 | HPRT1 = HPRT |
| ENST00000370648.3 | 3884 | 135570046 | 135575939 | + | seg_486 | 135573250 | 135575700 | BRS3 | HPRT1 = HPRT |
| ENST00000440515.1 | 3885 | 135618287 | 135638655 | + | seg_488 | 135623250 | 135624500 | VGLL1 | HPRT1 = HPRT |
| ENST00000370634.3 | 3886 | 135614311 | 135638966 | + | seg_488 | 135623250 | 135624500 | VGLL1 | HPRT1 = HPRT |
| ENST00000456412.1 | 3887 | 135618354 | 135638966 | + | seg_488 | 135623250 | 135624500 | VGLL1 | HPRT1 = HPRT |
| ENST00000430688.2 | 3888 | 135614311 | 135638965 | + | seg_488 | 135623250 | 135624500 | VGLL1 | HPRT1 = HPRT |
| ENST00000470358.1 | 3889 | 135632601 | 135638966 | + | seg_489 | 135635700 | 135637100 | VGLL1 | HPRT1 = HPRT |
| ENST00000440515.1 | 3890 | 135618287 | 135638655 | + | seg_489 | 135635700 | 135637100 | VGLL1 | HPRT1 = HPRT |
| ENST00000370634.3 | 3891 | 135614311 | 135638966 | + | seg_489 | 135635700 | 135637100 | VGLL1 | HPRT1 = HPRT |
| ENST00000456412.1 | 3892 | 135618354 | 135638966 | + | seg_489 | 135635700 | 135637100 | VGLL1 | HPRT1 = HPRT |
| ENST00000430688.2 | 3893 | 135614311 | 135638965 | + | seg_489 | 135635700 | 135637100 | VGLL1 | HPRT1 = HPRT |
| ENST00000370628.2 | 3894 | 135730386 | 135742549 | + | seg_492 | 135736900 | 135741150 | CD40LG | HPRT1 = HPRT |
| ENST00000370629.2 | 3895 | 135730352 | 135742549 | + | seg_492 | 135736900 | 135741150 | CD40LG | HPRT1 = HPRT |
| ENST00000298110.1 | 3896 | 136112307 | 136113833 | − | seg_493 | 136111350 | 136117550 | GPR101 | F9 |
| ENST00000287538.5 | 3897 | 136648301 | 136653744 | + | seg_497 | 136650650 | 136652500 | ZIC3 | F9 |
| ENST00000478471.1 | 3898 | 136650964 | 136652154 | + | seg_497 | 136650650 | 136652500 | ZIC3 | F9 |
| ENST00000370606.3 | 3899 | 136648677 | 136659850 | + | seg_497 | 136650650 | 136652500 | ZIC3 | F9 |
| ENST00000545711.1 | 3900 | 138638452 | 138638784 | − | seg_498 | 138637250 | 138639450 | F9 | F9 |
| ENST00000218099.2 | 3901 | 138612917 | 138645617 | + | seg_498 | 138637250 | 138639450 | F9 | F9 |
| ENST00000394090.2 | 3902 | 138612924 | 138644230 | + | seg_498 | 138637250 | 138639450 | F9 | F9 |
| ENST00000519895.1 | 3903 | 138664456 | 138790386 | − | seg_499 | 138772500 | 138776000 | MCF2 | F9 |
| ENST00000520602.1 | 3904 | 138663929 | 138774315 | − | seg_499 | 138772500 | 138776000 | MCF2 | F9 |
| ENST00000370578.4 | 3905 | 138663930 | 138774284 | − | seg_499 | 138772500 | 138776000 | MCF2 | F9 |
| ENST00000414978.1 | 3906 | 138663930 | 138790375 | − | seg_499 | 138772500 | 138776000 | MCF2 | F9 |
| ENST00000485626.1 | 3907 | 138884461 | 139027435 | − | seg_500 | 139024650 | 139025850 | ATP11C | F9 |
| ENST00000543618.1 | 3908 | 148678217 | 148683886 | − | seg_503 | 148673150 | 148680900 | HSFX2 | MTM1 |
| ENST00000522155.1 | 3909 | 148674868 | 148676436 | − | seg_503 | 148673150 | 148680900 | HSFX2 | MTM1 |
| ENST00000524178.1 | 3910 | 148674172 | 148676974 | − | seg_503 | 148673150 | 148680900 | HSFX2 | MTM1 |
| ENST00000519015.1 | 3911 | 148678217 | 148683886 | − | seg_503 | 148673150 | 148680900 | HSFX2 | MTM1 |
| ENST00000316916.8 | 3912 | 148678216 | 148713568 | − | seg_503 | 148673150 | 148680900 | HSFX2 | MTM1 |
| ENST00000502858.2 | 3913 | 148679625 | 148690438 | − | seg_503 | 148673150 | 148680900 | HSFX2 | MTM1 |
| ENST00000536359.1 | 3914 | 148678216 | 148713487 | − | seg_503 | 148673150 | 148680900 | HSFX2 | MTM1 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000513505.2 | 3915 | 148678216 | 148713402 | − | seg_503 | 148673150 | 148680900 | HSFX2 | MTM1 |
| ENST00000543618.1 | 3916 | 148678217 | 148683886 | − | seg_504 | 148682650 | 148684100 | HSFX2 | MTM1 |
| ENST00000519015.1 | 3917 | 148678217 | 148683886 | − | seg_504 | 148682650 | 148684100 | HSFX2 | MTM1 |
| ENST00000316916.8 | 3918 | 148678216 | 148713568 | − | seg_504 | 148682650 | 148684100 | HSFX2 | MTM1 |
| ENST00000502858.2 | 3919 | 148679625 | 148690438 | − | seg_504 | 148682650 | 148684100 | HSFX2 | MTM1 |
| ENST00000536359.1 | 3920 | 148678216 | 148713487 | − | seg_504 | 148682650 | 148684100 | HSFX2 | MTM1 |
| ENST00000513505.2 | 3921 | 148678216 | 148713402 | − | seg_504 | 148682650 | 148684100 | HSFX2 | MTM1 |
| ENST00000502618.1 | 3922 | 148681969 | 148693146 | − | seg_504 | 148682650 | 148684100 | HSFX2 | MTM1 |
| ENST00000316916.8 | 3923 | 148678216 | 148713568 | − | seg_505 | 148711650 | 148713850 | TMEM185A | MTM1 |
| ENST00000502900.1 | 3924 | 148686838 | 148713403 | − | seg_505 | 148711650 | 148713850 | TMEM185A | MTM1 |
| ENST00000536359.1 | 3925 | 148678216 | 148713487 | − | seg_505 | 148711650 | 148713850 | TMEM185A | MTM1 |
| ENST00000511776.1 | 3926 | 148690379 | 148713365 | − | seg_505 | 148711650 | 148713850 | TMEM185A | MTM1 |
| ENST00000513505.2 | 3927 | 148678216 | 148713402 | − | seg_505 | 148711650 | 148713850 | TMEM185A | MTM1 |
| ENST00000507237.1 | 3928 | 148685375 | 148713381 | − | seg_505 | 148711650 | 148713850 | TMEM185A | MTM1 |
| ENST00000428022.1 | 3929 | 148848815 | 148854483 | + | seg_509 | 148852950 | 148862150 | HSFX1 | MTM1 |
| ENST00000370416.4 | 3930 | 148855726 | 148858525 | + | seg_509 | 148852950 | 148862150 | HSFX1 | MTM1 |
| ENST00000524311.1 | 3931 | 148850558 | 148853029 | + | seg_509 | 148852950 | 148862150 | HSFX1 | MTM1 |
| ENST00000458274.1 | 3932 | 149107957 | 149109050 | + | seg_510 | 149108000 | 149109350 | CXorf40B | MTM1 |
| ENST00000444489.1 | 3933 | 149108374 | 149185018 | + | seg_510 | 149108000 | 149109350 | CXorf40B | MTM1 |
| ENST00000449111.1 | 3934 | 149106846 | 149392815 | + | seg_510 | 149108000 | 149109350 | CXorf40B | MTM1 |
| ENST00000468306.1 | 3935 | 149529689 | 149638367 | + | seg_511 | 149530200 | 149534000 | MAMLD1 | MTM1 |
| ENST00000432680.2 | 3936 | 149531686 | 149681395 | + | seg_511 | 149530200 | 149534000 | MAMLD1 | MTM1 |
| ENST00000445612.2 | 3937 | 149529836 | 149680503 | + | seg_511 | 149530200 | 149534000 | MAMLD1 | MTM1 |
| ENST00000370401.2 | 3938 | 149531551 | 149682448 | + | seg_511 | 149530200 | 149534000 | MAMLD1 | MTM1 |
| ENST00000426613.2 | 3939 | 149613720 | 149682448 | + | seg_512 | 149646300 | 149649450 | MAMLD1 | MTM1 |
| ENST00000455522.2 | 3940 | 149639280 | 149680512 | + | seg_512 | 149646300 | 149649450 | MAMLD1 | MTM1 |
| ENST00000262858.5 | 3941 | 149613720 | 149682448 | + | seg_512 | 149646300 | 149649450 | MAMLD1 | MTM1 |
| ENST00000432680.2 | 3942 | 149531686 | 149681395 | + | seg_512 | 149646300 | 149649450 | MAMLD1 | MTM1 |
| ENST00000445612.2 | 3943 | 149529836 | 149680503 | + | seg_512 | 149646300 | 149649450 | MAMLD1 | MTM1 |
| ENST00000370401.2 | 3944 | 149531551 | 149682448 | + | seg_512 | 149646300 | 149649450 | MAMLD1 | MTM1 |
| ENST00000426613.2 | 3945 | 149613720 | 149682448 | + | seg_513 | 149650500 | 149652300 | MAMLD1 | MTM1 |
| ENST00000455522.2 | 3946 | 149639280 | 149680512 | + | seg_513 | 149650500 | 149652300 | MAMLD1 | MTM1 |
| ENST00000262858.5 | 3947 | 149613720 | 149682448 | + | seg_513 | 149650500 | 149652300 | MAMLD1 | MTM1 |
| ENST00000432680.2 | 3948 | 149531686 | 149681395 | + | seg_513 | 149650500 | 149652300 | MAMLD1 | MTM1 |
| ENST00000445612.2 | 3949 | 149529836 | 149680503 | + | seg_513 | 149650500 | 149652300 | MAMLD1 | MTM1 |
| ENST00000370401.2 | 3950 | 149531551 | 149682448 | + | seg_513 | 149650500 | 149652300 | MAMLD1 | MTM1 |
| ENST00000426613.2 | 3951 | 149613720 | 149682448 | + | seg_514 | 149673500 | 149676800 | MAMLD1 | MTM1 |
| ENST00000455522.2 | 3952 | 149639280 | 149680512 | + | seg_514 | 149673500 | 149676800 | MAMLD1 | MTM1 |
| ENST00000262858.5 | 3953 | 149613720 | 149682448 | + | seg_514 | 149673500 | 149676800 | MAMLD1 | MTM1 |
| ENST00000432680.2 | 3954 | 149531686 | 149681395 | + | seg_514 | 149673500 | 149676800 | MAMLD1 | MTM1 |
| ENST00000445612.2 | 3955 | 149529836 | 149680503 | + | seg_514 | 149673500 | 149676800 | MAMLD1 | MTM1 |
| ENST00000370401.2 | 3956 | 149531551 | 149682448 | + | seg_514 | 149673500 | 149676800 | MAMLD1 | MTM1 |
| ENST00000464149.1 | 3957 | 149677595 | 149682439 | + | seg_515 | 149680400 | 149683100 | MAMLD1 | MTM1 |
| ENST00000426613.2 | 3958 | 149613720 | 149682448 | + | seg_515 | 149680400 | 149683100 | MAMLD1 | MTM1 |
| ENST00000455522.2 | 3959 | 149639280 | 149680512 | + | seg_515 | 149680400 | 149683100 | MAMLD1 | MTM1 |
| ENST00000262858.5 | 3960 | 149613720 | 149682448 | + | seg_515 | 149680400 | 149683100 | MAMLD1 | MTM1 |
| ENST00000432680.2 | 3961 | 149531686 | 149681395 | + | seg_515 | 149680400 | 149683100 | MAMLD1 | MTM1 |
| ENST00000445612.2 | 3962 | 149529836 | 149680503 | + | seg_515 | 149680400 | 149683100 | MAMLD1 | MTM1 |
| ENST00000370401.2 | 3963 | 149531551 | 149682448 | + | seg_515 | 149680400 | 149683100 | MAMLD1 | MTM1 |
| ENST00000454196.1 | 3964 | 150343664 | 150346308 | − | seg_521 | 150341400 | 150347800 | GPR50 | MTM1 |
| ENST00000535473.1 | 3965 | 150345056 | 150348932 | − | seg_521 | 150341400 | 150347800 | GPR50 | MTM1 |
| ENST00000218316.3 | 3966 | 150345125 | 150349937 | + | seg_521 | 150341400 | 150347800 | GPR50 | MTM1 |
| ENST00000458074.1 | 3967 | 150394701 | 150396187 | − | seg_522 | 150394350 | 150398150 | GPR50 | MTM1 |
| ENST00000464219.1 | 3968 | 150732201 | 150844987 | + | seg_525 | 150765850 | 150766900 | PASD1 | MTM1 |
| ENST00000370357.4 | 3969 | 150732094 | 150845211 | + | seg_525 | 150765850 | 150766900 | PASD1 | MTM1 |
| ENST00000413236.1 | 3970 | 150780136 | 150839668 | + | seg_526 | 150827300 | 150828750 | PRRG3 | MTM1 |
| ENST00000464219.1 | 3971 | 150732201 | 150844987 | + | seg_526 | 150827300 | 150828750 | PRRG3 | MTM1 |
| ENST00000370357.4 | 3972 | 150732094 | 150845211 | + | seg_526 | 150827300 | 150828750 | PRRG3 | MTM1 |
| ENST00000448324.1 | 3973 | 150869023 | 150873975 | + | seg_527 | 150871800 | 150872900 | PRRG3 | MTM1 |
| ENST00000370353.3 | 3974 | 150866779 | 150874396 | + | seg_527 | 150871800 | 150872900 | PRRG3 | MTM1 |
| ENST00000329903.4 | 3975 | 150906923 | 150913776 | + | seg_528 | 150911500 | 150912750 | CNGA2 | MTM1 |
| ENST00000535156.1 | 3976 | 152082986 | 152142024 | + | seg_538 | 152101250 | 152104800 | ZNF185 | ABCD1 |
| ENST00000539731.1 | 3977 | 152082986 | 152142024 | + | seg_538 | 152101250 | 152104800 | ZNF185 | ABCD1 |
| ENST00000447088.1 | 3978 | 152088893 | 152106707 | + | seg_538 | 152101250 | 152104800 | ZNF185 | ABCD1 |
| ENST00000318504.7 | 3979 | 152082986 | 152142024 | + | seg_538 | 152101250 | 152104800 | ZNF185 | ABCD1 |
| ENST00000436731.1 | 3980 | 152100283 | 152128354 | + | seg_538 | 152101250 | 152104800 | ZNF185 | ABCD1 |
| ENST00000370270.1 | 3981 | 152086665 | 152142025 | + | seg_538 | 152101250 | 152104800 | ZNF185 | ABCD1 |
| ENST00000324823.6 | 3982 | 152082986 | 152142024 | + | seg_538 | 152101250 | 152104800 | ZNF185 | ABCD1 |
| ENST00000426821.1 | 3983 | 152087545 | 152142017 | + | seg_538 | 152101250 | 152104800 | ZNF185 | ABCD1 |
| ENST00000447792.1 | 3984 | 152089251 | 152106707 | + | seg_538 | 152101250 | 152104800 | ZNF185 | ABCD1 |
| ENST00000449285.2 | 3985 | 152082986 | 152142024 | + | seg_538 | 152101250 | 152104800 | ZNF185 | ABCD1 |
| ENST00000318529.8 | 3986 | 152086409 | 152142024 | + | seg_538 | 152101250 | 152104800 | ZNF185 | ABCD1 |
| ENST00000535861.1 | 3987 | 152082986 | 152142024 | + | seg_538 | 152101250 | 152104800 | ZNF185 | ABCD1 |
| ENST00000433245.2 | 3988 | 152082986 | 152128407 | + | seg_538 | 152101250 | 152104800 | ZNF185 | ABCD1 |
| ENST00000370268.4 | 3989 | 152082997 | 152142015 | + | seg_538 | 152101250 | 152104800 | ZNF185 | ABCD1 |
| ENST00000456193.1 | 3990 | 152387940 | 152393740 | − | seg_539 | 152393100 | 152402450 | PNMA6B | ABCD1 |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000415779.1 | 3991 | 152537078 | 152543256 | + | seg__541 | 152529100 | 152538150 | MAGEA1 | ABCD1 |
| ENST00000421080.2 | 3992 | 152713128 | 152760978 | − | seg__544 | 152749250 | 152750350 | U82695.9 | ABCD1 |
| ENST00000453918.2 | 3993 | 152721747 | 152760940 | − | seg__544 | 152749250 | 152750350 | U82695.9 | ABCD1 |
| ENST00000370210.1 | 3994 | 152727018 | 152760974 | − | seg__544 | 152749250 | 152750350 | U82695.9 | ABCD1 |
| ENST00000421080.2 | 3995 | 152713128 | 152760978 | − | seg__545 | 152757900 | 152759300 | U82695.9 | ABCD1 |
| ENST00000453918.2 | 3996 | 152721747 | 152760940 | − | seg__545 | 152757900 | 152759300 | U82695.9 | ABCD1 |
| ENST00000370210.1 | 3997 | 152727018 | 152760974 | − | seg__545 | 152757900 | 152759300 | U82695.9 | ABCD1 |
| ENST00000349466.2 | 3998 | 152783134 | 152846047 | + | seg__546 | 152786250 | 152787250 | ATP2B3 | ABCD1 |
| ENST00000370186.1 | 3999 | 152783134 | 152848397 | + | seg__546 | 152786250 | 152787250 | ATP2B3 | ABCD1 |
| ENST00000349466.2 | 4000 | 152783134 | 152846047 | + | seg__547 | 152788650 | 152794100 | ATP2B3 | ABCD1 |
| ENST00000370186.1 | 4001 | 152783134 | 152848397 | + | seg__547 | 152788650 | 152794100 | ATP2B3 | ABCD1 |
| ENST00000263519.4 | 4002 | 152801580 | 152848387 | + | seg__548 | 152800850 | 152804450 | ATP2B3 | ABCD1 |
| ENST00000349466.2 | 4003 | 152783134 | 152846047 | + | seg__548 | 152800850 | 152804450 | ATP2B3 | ABCD1 |
| ENST00000359149.3 | 4004 | 152801580 | 152846047 | + | seg__548 | 152800850 | 152804450 | ATP2B3 | ABCD1 |
| ENST00000370181.2 | 4005 | 152801580 | 152848387 | + | seg__548 | 152800850 | 152804450 | ATP2B3 | ABCD1 |
| ENST00000393842.1 | 4006 | 152798392 | 152835420 | + | seg__548 | 152800850 | 152804450 | ATP2B3 | ABCD1 |
| ENST00000370186.1 | 4007 | 152783134 | 152848397 | + | seg__548 | 152800850 | 152804450 | ATP2B3 | ABCD1 |
| ENST00000460549.1 | 4008 | 152822404 | 152826282 | + | seg__549 | 152814800 | 152828650 | ATP2B3 | ABCD1 |
| ENST00000263519.4 | 4009 | 152801580 | 152848387 | + | seg__549 | 152814800 | 152828650 | ATP2B3 | ABCD1 |
| ENST00000349466.2 | 4010 | 152783134 | 152846047 | + | seg__549 | 152814800 | 152828650 | ATP2B3 | ABCD1 |
| ENST00000359149.3 | 4011 | 152801580 | 152846047 | + | seg__549 | 152814800 | 152828650 | ATP2B3 | ABCD1 |
| ENST00000370181.2 | 4012 | 152801580 | 152848387 | + | seg__549 | 152814800 | 152828650 | ATP2B3 | ABCD1 |
| ENST00000393842.1 | 4013 | 152798392 | 152835420 | + | seg__549 | 152814800 | 152828650 | ATP2B3 | ABCD1 |
| ENST00000370186.1 | 4014 | 152783134 | 152848397 | + | seg__549 | 152814800 | 152828650 | ATP2B3 | ABCD1 |
| ENST00000496610.1 | 4015 | 152835106 | 152846027 | + | seg__550 | 152830250 | 152836300 | FAM58A | ABCD1 |
| ENST00000263519.4 | 4016 | 152801580 | 152848387 | + | seg__550 | 152830250 | 152836300 | FAM58A | ABCD1 |
| ENST00000349466.2 | 4017 | 152783134 | 152846047 | + | seg__550 | 152830250 | 152836300 | FAM58A | ABCD1 |
| ENST00000359149.3 | 4018 | 152801580 | 152846047 | + | seg__550 | 152830250 | 152836300 | FAM58A | ABCD1 |
| ENST00000370181.2 | 4019 | 152801580 | 152848387 | + | seg__550 | 152830250 | 152836300 | FAM58A | ABCD1 |
| ENST00000393842.1 | 4020 | 152798392 | 152835420 | + | seg__550 | 152830250 | 152836300 | FAM58A | ABCD1 |
| ENST00000370186.1 | 4021 | 152783134 | 152848397 | + | seg__550 | 152830250 | 152836300 | FAM58A | ABCD1 |
| ENST00000496610.1 | 4022 | 152835106 | 152846027 | + | seg__551 | 152838450 | 152845550 | FAM58A | ABCD1 |
| ENST00000263519.4 | 4023 | 152801580 | 152848387 | + | seg__551 | 152838450 | 152845550 | FAM58A | ABCD1 |
| ENST00000349466.2 | 4024 | 152783134 | 152846047 | + | seg__551 | 152838450 | 152845550 | FAM58A | ABCD1 |
| ENST00000359149.3 | 4025 | 152801580 | 152846047 | + | seg__551 | 152838450 | 152845550 | FAM58A | ABCD1 |
| ENST00000370181.2 | 4026 | 152801580 | 152848387 | + | seg__551 | 152838450 | 152845550 | FAM58A | ABCD1 |
| ENST00000370186.1 | 4027 | 152783134 | 152848397 | + | seg__551 | 152838450 | 152845550 | FAM58A | ABCD1 |
| ENST00000406288.2 | 4028 | 152871972 | 152872343 | − | seg__552 | 152868250 | 152873400 | FAM58A | ABCD1 |
| ENST00000434763.1 | 4029 | 152869952 | 152870803 | − | seg__552 | 152868250 | 152873400 | FAM58A | ABCD1 |
| ENST00000480496.1 | 4030 | 152931688 | 152931971 | + | seg__556 | 152929350 | 152932250 | PNCK | ABCD1 |
| ENST00000468491.1 | 4031 | 153072782 | 153095125 | − | seg__557 | 153075300 | 153076350 | PDZD4 | L1CAM |
| ENST00000480418.1 | 4032 | 153071037 | 153096020 | − | seg__557 | 153075300 | 153076350 | PDZD4 | L1CAM |
| ENST00000480650.1 | 4033 | 153073438 | 153095792 | − | seg__557 | 153075300 | 153076350 | PDZD4 | L1CAM |
| ENST00000164640.4 | 4034 | 153067621 | 153095945 | − | seg__557 | 153075300 | 153076350 | PDZD4 | L1CAM |
| ENST00000544474.1 | 4035 | 153068742 | 153095813 | − | seg__557 | 153075300 | 153076350 | PDZD4 | L1CAM |
| ENST00000483693.1 | 4036 | 153071000 | 153095598 | − | seg__557 | 153075300 | 153076350 | PDZD4 | L1CAM |
| ENST00000393758.2 | 4037 | 153067623 | 153095351 | − | seg__557 | 153075300 | 153076350 | PDZD4 | L1CAM |
| ENST00000475140.1 | 4038 | 153070548 | 153095311 | − | seg__557 | 153075300 | 153076350 | PDZD4 | L1CAM |
| ENST00000468491.1 | 4039 | 153072782 | 153095125 | − | seg__558 | 153078100 | 153079800 | PDZD4 | L1CAM |
| ENST00000480418.1 | 4040 | 153071037 | 153096020 | − | seg__558 | 153078100 | 153079800 | PDZD4 | L1CAM |
| ENST00000480650.1 | 4041 | 153073438 | 153095792 | − | seg__558 | 153078100 | 153079800 | PDZD4 | L1CAM |
| ENST00000164640.4 | 4042 | 153067621 | 153095945 | − | seg__558 | 153078100 | 153079800 | PDZD4 | L1CAM |
| ENST00000544474.1 | 4043 | 153068742 | 153095813 | − | seg__558 | 153078100 | 153079800 | PDZD4 | L1CAM |
| ENST00000483693.1 | 4044 | 153071000 | 153095598 | − | seg__558 | 153078100 | 153079800 | PDZD4 | L1CAM |
| ENST00000393758.2 | 4045 | 153067623 | 153095351 | − | seg__558 | 153078100 | 153079800 | PDZD4 | L1CAM |
| ENST00000475140.1 | 4046 | 153070548 | 153095311 | − | seg__558 | 153078100 | 153079800 | PDZD4 | L1CAM |
| ENST00000468491.1 | 4047 | 153072782 | 153095125 | − | seg__559 | 153083600 | 153087450 | PDZD4 | L1CAM |
| ENST00000480418.1 | 4048 | 153071037 | 153096020 | − | seg__559 | 153083600 | 153087450 | PDZD4 | L1CAM |
| ENST00000480650.1 | 4049 | 153073438 | 153095792 | − | seg__559 | 153083600 | 153087450 | PDZD4 | L1CAM |
| ENST00000164640.4 | 4050 | 153067621 | 153095945 | − | seg__559 | 153083600 | 153087450 | PDZD4 | L1CAM |
| ENST00000544474.1 | 4051 | 153068742 | 153095813 | − | seg__559 | 153083600 | 153087450 | PDZD4 | L1CAM |
| ENST00000483693.1 | 4052 | 153071000 | 153095598 | − | seg__559 | 153083600 | 153087450 | PDZD4 | L1CAM |
| ENST00000393758.2 | 4053 | 153067623 | 153095351 | − | seg__559 | 153083600 | 153087450 | PDZD4 | L1CAM |
| ENST00000475140.1 | 4054 | 153070548 | 153095311 | − | seg__559 | 153083600 | 153087450 | PDZD4 | L1CAM |
| ENST00000468491.1 | 4055 | 153072782 | 153095125 | − | seg__560 | 153088800 | 153098300 | PDZD4 | L1CAM |
| ENST00000480418.1 | 4056 | 153071037 | 153096020 | − | seg__560 | 153088800 | 153098300 | PDZD4 | L1CAM |
| ENST00000480650.1 | 4057 | 153073438 | 153095792 | − | seg__560 | 153088800 | 153098300 | PDZD4 | L1CAM |
| ENST00000164640.4 | 4058 | 153067621 | 153095945 | − | seg__560 | 153088800 | 153098300 | PDZD4 | L1CAM |
| ENST00000544474.1 | 4059 | 153068742 | 153095813 | − | seg__560 | 153088800 | 153098300 | PDZD4 | L1CAM |
| ENST00000483693.1 | 4060 | 153071000 | 153095598 | − | seg__560 | 153088800 | 153098300 | PDZD4 | L1CAM |
| ENST00000393758.2 | 4061 | 153067623 | 153095351 | − | seg__560 | 153088800 | 153098300 | PDZD4 | L1CAM |
| ENST00000475140.1 | 4062 | 153070548 | 153095311 | − | seg__560 | 153088800 | 153098300 | PDZD4 | L1CAM |
| ENST00000455590.1 | 4063 | 153132227 | 153133832 | − | seg__563 | 153127450 | 153132350 | L1CAM | L1CAM |
| ENST00000370058.3 | 4064 | 153127888 | 153129933 | − | seg__563 | 153127450 | 153132350 | L1CAM | L1CAM |
| ENST00000491983.1 | 4065 | 153128247 | 153129424 | − | seg__563 | 153127450 | 153132350 | L1CAM | L1CAM |
| ENST00000474853.1 | 4066 | 153130419 | 153131370 | − | seg__563 | 153127450 | 153132350 | L1CAM | L1CAM |

TABLE XVI-continued paRNAs associated with EZH2 STRONG sites in K562 cells

| Transcript ID | SIN: | Start | Stop | Strand | Ezh2 ID | Ezh2 Start | Ezh2 End | Nearest gene | Disease gene |
|---|---|---|---|---|---|---|---|---|---|
| ENST00000370055.1 | 4067 | 153127408 | 153151608 | − | seg_563 | 153127450 | 153132350 | L1CAM | L1CAM |
| ENST00000370057.3 | 4068 | 153126973 | 153141399 | − | seg_563 | 153127450 | 153132350 | L1CAM | L1CAM |
| ENST00000361699.4 | 4069 | 153128003 | 153141302 | − | seg_563 | 153127450 | 153132350 | L1CAM | L1CAM |
| ENST00000540065.1 | 4070 | 153126995 | 153151569 | − | seg_563 | 153127450 | 153132350 | L1CAM | L1CAM |
| ENST00000361981.3 | 4071 | 153126973 | 153141399 | − | seg_563 | 153127450 | 153132350 | L1CAM | L1CAM |
| ENST00000538883.1 | 4072 | 153126973 | 153141399 | − | seg_563 | 153127450 | 153132350 | L1CAM | L1CAM |
| ENST00000370060.1 | 4073 | 153126969 | 153151600 | − | seg_563 | 153127450 | 153132350 | L1CAM | L1CAM |
| ENST00000543994.1 | 4074 | 153126973 | 153141399 | − | seg_563 | 153127450 | 153132350 | L1CAM | L1CAM |
| ENST00000357566.1 | 4075 | 153146127 | 153154425 | + | seg_564 | 153150300 | 153151550 | LCA10 | L1CAM |
| ENST00000484587.1 | 4076 | 153149319 | 153151615 | + | seg_564 | 153150300 | 153151550 | LCA10 | L1CAM |
| ENST00000452593.1 | 4077 | 153146127 | 153154444 | + | seg_564 | 153150300 | 153151550 | LCA10 | L1CAM |
| ENST00000370055.1 | 4078 | 153127408 | 153151608 | − | seg_564 | 153150300 | 153151550 | LCA10 | L1CAM |
| ENST00000540065.1 | 4079 | 153126995 | 153151569 | − | seg_564 | 153150300 | 153151550 | LCA10 | L1CAM |
| ENST00000460553.1 | 4080 | 153138404 | 153151596 | − | seg_564 | 153150300 | 153151550 | LCA10 | L1CAM |
| ENST00000464967.1 | 4081 | 153137676 | 153174677 | − | seg_564 | 153150300 | 153151550 | LCA10 | L1CAM |
| ENST00000420165.1 | 4082 | 153137722 | 153151627 | − | seg_564 | 153150300 | 153151550 | LCA10 | L1CAM |
| ENST00000370060.1 | 4083 | 153126969 | 153151600 | − | seg_564 | 153150300 | 153151550 | LCA10 | L1CAM |
| ENST00000464967.1 | 4084 | 153137676 | 153174677 | − | seg_565 | 153157700 | 153161200 | LCA10 | AVPR2 |
| ENST00000464967.1 | 4085 | 153137676 | 153174677 | − | seg_566 | 153162600 | 153164350 | AVPR2 | AVPR2 |
| ENST00000369941.4 | 4086 | 153424682 | 153445634 | − | seg_567 | 153438400 | 153439700 | TEX28P2 | OPN1MW |
| ENST00000430054.1 | 4087 | 153455547 | 153461628 | + | seg_568 | 153455250 | 153457100 | OPN1MW | OPN1MW |
| ENST00000468495.1 | 4088 | 153448157 | 153459002 | + | seg_568 | 153455250 | 153457100 | OPN1MW | OPN1MW |
| ENST00000369935.5 | 4089 | 153448107 | 153461633 | + | seg_568 | 153455250 | 153457100 | OPN1MW | OPN1MW |
| ENST00000463884.1 | 4090 | 153555722 | 153558038 | + | seg_569 | 153547800 | 153558950 | TKTL1 | EMD |
| ENST00000482044.1 | 4091 | 153555530 | 153556245 | + | seg_569 | 153547800 | 153558950 | TKTL1 | EMD |
| ENST00000217905.7 | 4092 | 153524152 | 153558076 | + | seg_569 | 153547800 | 153558950 | TKTL1 | EMD |
| ENST00000441970.3 | 4093 | 153524027 | 153558713 | + | seg_569 | 153547800 | 153558950 | TKTL1 | EMD |
| ENST00000369915.3 | 4094 | 153524024 | 153558700 | + | seg_569 | 153547800 | 153558950 | TKTL1 | EMD |
| ENST00000465168.1 | 4095 | 153548651 | 153553731 | + | seg_569 | 153547800 | 153558950 | TKTL1 | EMD |
| ENST00000369912.2 | 4096 | 153533409 | 153558700 | + | seg_569 | 153547800 | 153558950 | TKTL1 | EMD |
| ENST00000442033.1 | 4097 | 153882820 | 153883599 | + | seg_572 | 153883050 | 153884900 | CTAG2 | DKC1 |
| ENST00000437536.1 | 4098 | 153887064 | 153887956 | − | seg_573 | 153886450 | 153887600 | CTAG2 | DKC1 |
| ENST00000496390.1 | 4099 | 153903529 | 153979858 | − | seg_574 | 153979700 | 153981100 | GAB3 | DKC1 |
| ENST00000393517.4 | 4100 | 154065133 | 154255215 | − | seg_575 | 154129300 | 154130500 | F8A1 | F8 |
| ENST00000360256.4 | 4101 | 154064070 | 154251028 | − | seg_575 | 154129300 | 154130500 | F8A1 | F8 |
| ENST00000423959.1 | 4102 | 154212976 | 154255215 | − | seg_576 | 154214850 | 154216450 | F8 | F8 |
| ENST00000393517.4 | 4103 | 154065133 | 154255215 | − | seg_576 | 154214850 | 154216450 | F8 | F8 |
| ENST00000360256.4 | 4104 | 154064070 | 154251028 | − | seg_576 | 154214850 | 154216450 | F8 | F8 |
| ENST00000286428.5 | 4105 | 154444643 | 154468098 | + | seg_577 | 154443300 | 154445000 | VBP1 | F8 |
| ENST00000535916.1 | 4106 | 154425284 | 154467325 | + | seg_577 | 154443300 | 154445000 | VBP1 | F8 |
| ENST00000488344.1 | 4107 | 155111023 | 155171608 | + | seg_578 | 155118300 | 155119400 | VAMP7 | F8 |
| ENST00000286448.6 | 4108 | 155110956 | 155173433 | + | seg_578 | 155118300 | 155119400 | VAMP7 | F8 |
| ENST00000460621.1 | 4109 | 155111041 | 155171653 | + | seg_578 | 155118300 | 155119400 | VAMP7 | F8 |
| ENST00000479687.1 | 4110 | 155111021 | 155171573 | + | seg_578 | 155118300 | 155119400 | VAMP7 | F8 |
| ENST00000463317.1 | 4111 | 155111035 | 155169454 | + | seg_578 | 155118300 | 155119400 | VAMP7 | F8 |
| ENST00000262640.6 | 4112 | 155111038 | 155173433 | + | seg_578 | 155118300 | 155119400 | VAMP7 | F8 |

TABLE XVII paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000431238.1 | 4113 | 170410 | 172712 | + | seg_1 | 169650 | 171500 | PLCXD1 | OA1 = GPR143 |
| ENST00000334060.3 | 4114 | 585079 | 620146 | + | seg_11 | 605350 | 606900 | SHOX | OA1 = GPR143 |
| ENST00000381578.1 | 4115 | 585079 | 607558 | + | seg_11 | 605350 | 606900 | SHOX | OA1 = GPR143 |
| ENST00000381575.1 | 4116 | 591542 | 620146 | + | seg_11 | 605350 | 606900 | SHOX | OA1 = GPR143 |
| ENST00000334060.3 | 4117 | 585079 | 620146 | + | seg_12 | 610200 | 612700 | SHOX | OA1 = GPR143 |
| ENST00000381575.1 | 4118 | 591542 | 620146 | + | seg_12 | 610200 | 612700 | SHOX | OA1 = GPR143 |
| ENST00000381566.1 | 4119 | 1317790 | 1331527 | − | seg_22 | 1329250 | 1330400 | CRLF2 | OA1 = GPR143 |
| ENST00000381567.3 | 4120 | 1314890 | 1331527 | − | seg_22 | 1329250 | 1330400 | CRLF2 | OA1 = GPR143 |
| ENST00000467626.1 | 4121 | 1314894 | 1331616 | − | seg_22 | 1329250 | 1330400 | CRLF2 | OA1 = GPR143 |
| ENST00000400841.2 | 4122 | 1314894 | 1331530 | − | seg_22 | 1329250 | 1330400 | CRLF2 | OA1 = GPR143 |
| ENST00000486791.1 | 4123 | 1387738 | 1428827 | + | seg_23 | 1392750 | 1394000 | CSF2RA | OA1 = GPR143 |
| ENST00000381524.3 | 4124 | 1387701 | 1429274 | + | seg_23 | 1392750 | 1394000 | CSF2RA | OA1 = GPR143 |
| ENST00000412290.1 | 4125 | 1387711 | 1413288 | + | seg_23 | 1392750 | 1394000 | CSF2RA | OA1 = GPR143 |
| ENST00000501036.2 | 4126 | 1387693 | 1428828 | + | seg_23 | 1392750 | 1394000 | CSF2RA | OA1 = GPR143 |
| ENST00000381529.3 | 4127 | 1387693 | 1428815 | + | seg_23 | 1392750 | 1394000 | CSF2RA | OA1 = GPR143 |
| ENST00000361536.3 | 4128 | 1387693 | 1428828 | + | seg_23 | 1392750 | 1394000 | CSF2RA | OA1 = GPR143 |
| ENST00000355432.3 | 4129 | 1387738 | 1428827 | + | seg_23 | 1392750 | 1394000 | CSF2RA | OA1 = GPR143 |
| ENST00000355805.2 | 4130 | 1387738 | 1428827 | + | seg_23 | 1392750 | 1394000 | CSF2RA | OA1 = GPR143 |
| ENST00000419094.1 | 4131 | 1387723 | 1409320 | + | seg_23 | 1392750 | 1394000 | CSF2RA | OA1 = GPR143 |
| ENST00000493312.1 | 4132 | 1387707 | 1419436 | + | seg_23 | 1392750 | 1394000 | CSF2RA | OA1 = GPR143 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000381507.4 | 4133 | 1387693 | 1428828 | + | seg_23 | 1392750 | 1394000 | CSF2RA | OA1 = GPR143 |
| ENST00000381509.3 | 4134 | 1387725 | 1424834 | + | seg_23 | 1392750 | 1394000 | CSF2RA | OA1 = GPR143 |
| ENST00000494969.1 | 4135 | 1387725 | 1428815 | + | seg_23 | 1392750 | 1394000 | CSF2RA | OA1 = GPR143 |
| ENST00000432318.2 | 4136 | 1387693 | 1428828 | + | seg_23 | 1392750 | 1394000 | CSF2RA | OA1 = GPR143 |
| ENST00000481245.1 | 4137 | 1387728 | 1401113 | + | seg_23 | 1392750 | 1394000 | CSF2RA | OA1 = GPR143 |
| ENST00000486791.1 | 4138 | 1387738 | 1428827 | + | seg_24 | 1397900 | 1399150 | CSF2RA | OA1 = GPR143 |
| ENST00000381524.3 | 4139 | 1387701 | 1429274 | + | seg_24 | 1397900 | 1399150 | CSF2RA | OA1 = GPR143 |
| ENST00000412290.1 | 4140 | 1387711 | 1413288 | + | seg_24 | 1397900 | 1399150 | CSF2RA | OA1 = GPR143 |
| ENST00000501036.2 | 4141 | 1387693 | 1428828 | + | seg_24 | 1397900 | 1399150 | CSF2RA | OA1 = GPR143 |
| ENST00000381529.3 | 4142 | 1387693 | 1428815 | + | seg_24 | 1397900 | 1399150 | CSF2RA | OA1 = GPR143 |
| ENST00000361536.3 | 4143 | 1387693 | 1428828 | + | seg_24 | 1397900 | 1399150 | CSF2RA | OA1 = GPR143 |
| ENST00000355432.3 | 4144 | 1387738 | 1428827 | + | seg_24 | 1397900 | 1399150 | CSF2RA | OA1 = GPR143 |
| ENST00000355805.2 | 4145 | 1387738 | 1428827 | + | seg_24 | 1397900 | 1399150 | CSF2RA | OA1 = GPR143 |
| ENST00000419094.1 | 4146 | 1387723 | 1409320 | + | seg_24 | 1397900 | 1399150 | CSF2RA | OA1 = GPR143 |
| ENST00000493312.1 | 4147 | 1387707 | 1419436 | + | seg_24 | 1397900 | 1399150 | CSF2RA | OA1 = GPR143 |
| ENST00000381507.4 | 4148 | 1387693 | 1428828 | + | seg_24 | 1397900 | 1399150 | CSF2RA | OA1 = GPR143 |
| ENST00000381509.3 | 4149 | 1387725 | 1424834 | + | seg_24 | 1397900 | 1399150 | CSF2RA | OA1 = GPR143 |
| ENST00000494969.1 | 4150 | 1387725 | 1428815 | + | seg_24 | 1397900 | 1399150 | CSF2RA | OA1 = GPR143 |
| ENST00000432318.2 | 4151 | 1387693 | 1428828 | + | seg_24 | 1397900 | 1399150 | CSF2RA | OA1 = GPR143 |
| ENST00000481245.1 | 4152 | 1387728 | 1401113 | + | seg_24 | 1397900 | 1399150 | CSF2RA | OA1 = GPR143 |
| ENST00000381469.2 | 4153 | 1460659 | 1501358 | + | seg_26 | 1464250 | 1469050 | IL3RA | OA1 = GPR143 |
| ENST00000331035.4 | 4154 | 1455509 | 1501578 | + | seg_26 | 1464250 | 1469050 | IL3RA | OA1 = GPR143 |
| ENST00000432757.1 | 4155 | 1455689 | 1475224 | + | seg_26 | 1464250 | 1469050 | IL3RA | OA1 = GPR143 |
| ENST00000474865.1 | 4156 | 1560485 | 1571765 | − | seg_27 | 1571500 | 1573550 | ASMTL | OA1 = GPR143 |
| ENST00000534940.1 | 4157 | 1522032 | 1572655 | − | seg_27 | 1571500 | 1573550 | ASMTL | OA1 = GPR143 |
| ENST00000416733.2 | 4158 | 1522032 | 1571768 | − | seg_27 | 1571500 | 1573550 | ASMTL | OA1 = GPR143 |
| ENST00000381333.4 | 4159 | 1522034 | 1571822 | − | seg_27 | 1571500 | 1573550 | ASMTL | OA1 = GPR143 |
| ENST00000381317.3 | 4160 | 1522034 | 1571766 | − | seg_27 | 1571500 | 1573550 | ASMTL | OA1 = GPR143 |
| ENST00000381297.4 | 4161 | 1581465 | 1656000 | − | seg_28 | 1589950 | 1591400 | P2RY8 | OA1 = GPR143 |
| ENST00000460672.1 | 4162 | 1585330 | 1613246 | − | seg_28 | 1589950 | 1591400 | P2RY8 | OA1 = GPR143 |
| ENST00000381229.4 | 4163 | 1734057 | 1761920 | + | seg_30 | 1736000 | 1737000 | ASMT | OA1 = GPR143 |
| ENST00000381233.3 | 4164 | 1734068 | 1761974 | + | seg_30 | 1736000 | 1737000 | ASMT | OA1 = GPR143 |
| ENST00000381241.3 | 4165 | 1733894 | 1761974 | + | seg_30 | 1736000 | 1737000 | ASMT | OA1 = GPR143 |
| ENST00000381229.4 | 4166 | 1734057 | 1761920 | + | seg_31 | 1750100 | 1751300 | ASMT | OA1 = GPR143 |
| ENST00000381233.3 | 4167 | 1734068 | 1761974 | + | seg_31 | 1750100 | 1751300 | ASMT | OA1 = GPR143 |
| ENST00000381241.3 | 4168 | 1733894 | 1761974 | + | seg_31 | 1750100 | 1751300 | ASMT | OA1 = GPR143 |
| ENST00000509780.1 | 4169 | 1746639 | 1755356 | + | seg_31 | 1750100 | 1751300 | ASMT | OA1 = GPR143 |
| ENST00000334651.5 | 4170 | 2137557 | 2419019 | − | seg_33 | 2143700 | 2144900 | DHRSX | OA1 = GPR143 |
| ENST00000381180.3 | 4171 | 2609402 | 2610291 | + | seg_38 | 2608500 | 2610050 | CD99 | OA1 = GPR143 |
| ENST00000381187.3 | 4172 | 2609317 | 2659142 | + | seg_38 | 2608500 | 2610050 | CD99 | OA1 = GPR143 |
| ENST00000381184.1 | 4173 | 2609321 | 2651708 | + | seg_38 | 2608500 | 2610050 | CD99 | OA1 = GPR143 |
| ENST00000381192.3 | 4174 | 2609220 | 2659350 | + | seg_38 | 2608500 | 2610050 | CD99 | OA1 = GPR143 |
| ENST00000449611.1 | 4175 | 2609541 | 2644414 | + | seg_38 | 2608500 | 2610050 | CD99 | OA1 = GPR143 |
| ENST00000426774.1 | 4176 | 2670093 | 2734539 | + | seg_40 | 2685100 | 2686250 | XG | OA1 = GPR143 |
| ENST00000533923.2 | 4177 | 2670231 | 2732581 | + | seg_40 | 2685100 | 2686250 | XG | OA1 = GPR143 |
| ENST00000381174.5 | 4178 | 2670091 | 2733968 | + | seg_40 | 2685100 | 2686250 | XG | OA1 = GPR143 |
| ENST00000503018.1 | 4179 | 2670337 | 2693037 | + | seg_40 | 2685100 | 2686250 | XG | OA1 = GPR143 |
| ENST00000419513.2 | 4180 | 2670093 | 2732589 | + | seg_40 | 2685100 | 2686250 | XG | OA1 = GPR143 |
| ENST00000509484.2 | 4181 | 2670186 | 2729477 | + | seg_40 | 2685100 | 2686250 | XG | OA1 = GPR143 |
| ENST00000519244.1 | 4182 | 2712576 | 2726418 | + | seg_41 | 2710300 | 2713050 | GYG2 | OA1 = GPR143 |
| ENST00000426774.1 | 4183 | 2670093 | 2734539 | + | seg_41 | 2710300 | 2713050 | GYG2 | OA1 = GPR143 |
| ENST00000533923.2 | 4184 | 2670231 | 2732581 | + | seg_41 | 2710300 | 2713050 | GYG2 | OA1 = GPR143 |
| ENST00000381174.5 | 4185 | 2670091 | 2733968 | + | seg_41 | 2710300 | 2713050 | GYG2 | OA1 = GPR143 |
| ENST00000419513.2 | 4186 | 2670093 | 2732589 | + | seg_41 | 2710300 | 2713050 | GYG2 | OA1 = GPR143 |
| ENST00000509484.2 | 4187 | 2670186 | 2729477 | + | seg_41 | 2710300 | 2713050 | GYG2 | OA1 = GPR143 |
| ENST00000519244.1 | 4188 | 2712576 | 2726418 | + | seg_42 | 2718100 | 2719250 | GYG2 | OA1 = GPR143 |
| ENST00000426774.1 | 4189 | 2670093 | 2734539 | + | seg_42 | 2718100 | 2719250 | GYG2 | OA1 = GPR143 |
| ENST00000533923.2 | 4190 | 2670231 | 2732581 | + | seg_42 | 2718100 | 2719250 | GYG2 | OA1 = GPR143 |
| ENST00000381174.5 | 4191 | 2670091 | 2733968 | + | seg_42 | 2718100 | 2719250 | GYG2 | OA1 = GPR143 |
| ENST00000419513.2 | 4192 | 2670093 | 2732589 | + | seg_42 | 2718100 | 2719250 | GYG2 | OA1 = GPR143 |
| ENST00000509484.2 | 4193 | 2670186 | 2729477 | + | seg_42 | 2718100 | 2719250 | GYG2 | OA1 = GPR143 |
| ENST00000519244.1 | 4194 | 2712576 | 2726418 | + | seg_43 | 2722300 | 2723400 | GYG2 | OA1 = GPR143 |
| ENST00000426774.1 | 4195 | 2670093 | 2734539 | + | seg_43 | 2722300 | 2723400 | GYG2 | OA1 = GPR143 |
| ENST00000533923.2 | 4196 | 2670231 | 2732581 | + | seg_43 | 2722300 | 2723400 | GYG2 | OA1 = GPR143 |
| ENST00000381174.5 | 4197 | 2670091 | 2733968 | + | seg_43 | 2722300 | 2723400 | GYG2 | OA1 = GPR143 |
| ENST00000419513.2 | 4198 | 2670093 | 2732589 | + | seg_43 | 2722300 | 2723400 | GYG2 | OA1 = GPR143 |
| ENST00000509484.2 | 4199 | 2670186 | 2729477 | + | seg_43 | 2722300 | 2723400 | GYG2 | OA1 = GPR143 |
| ENST00000537104.1 | 4200 | 2976652 | 3030747 | + | seg_44 | 2985150 | 2986300 | ARSF | OA1 = GPR143 |
| ENST00000359361.2 | 4201 | 2984874 | 3030747 | + | seg_44 | 2985150 | 2986300 | ARSF | OA1 = GPR143 |
| ENST00000381127.1 | 4202 | 2959512 | 3030767 | + | seg_44 | 2985150 | 2986300 | ARSF | OA1 = GPR143 |
| ENST00000217939.5 | 4203 | 3226611 | 3264684 | − | seg_45 | 3262450 | 3264450 | MXRA5 | OA1 = GPR143 |
| ENST00000381114.1 | 4204 | 3226606 | 3264682 | − | seg_45 | 3262450 | 3264450 | MXRA5 | OA1 = GPR143 |
| ENST00000381106.3 | 4205 | 3820866 | 3838787 | − | seg_48 | 3836600 | 3837850 | RP11-706O15.1 | OA1 = GPR143 |
| ENST00000453306.1 | 4206 | 8432871 | 8434550 | + | seg_50 | 8433250 | 8434450 | VCX3B | OA1 = GPR143 |
| ENST00000381029.4 | 4207 | 8433467 | 8434510 | + | seg_50 | 8433250 | 8434450 | VCX3B | OA1 = GPR143 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000440654.2 | 4208 | 8433376 | 8434522 | + | seg_50 | 8433250 | 8434450 | VCX3B | OA1 = GPR143 |
| ENST00000381032.1 | 4209 | 8432871 | 8434547 | + | seg_50 | 8433250 | 8434450 | VCX3B | OA1 = GPR143 |
| ENST00000444481.1 | 4210 | 8432871 | 8434424 | + | seg_50 | 8433250 | 8434450 | VCX3B | OA1 = GPR143 |
| ENST00000432442.1 | 4211 | 9217960 | 9243246 | + | seg_51 | 9230300 | 9231800 | FAM9B | OA1 = GPR143 |
| ENST00000416620.1 | 4212 | 9370791 | 9382606 | + | seg_56 | 9372050 | 9382550 | TBL1X | OA1 = GPR143 |
| ENST00000441088.1 | 4213 | 9431360 | 9622328 | + | seg_57 | 9433800 | 9434800 | TBL1X | OA1 = GPR143 |
| ENST00000217964.7 | 4214 | 9433048 | 9687778 | + | seg_57 | 9433800 | 9434800 | TBL1X | OA1 = GPR143 |
| ENST00000380961.1 | 4215 | 9431369 | 9686902 | + | seg_57 | 9433800 | 9434800 | TBL1X | OA1 = GPR143 |
| ENST00000407597.2 | 4216 | 9431335 | 9687780 | + | seg_57 | 9433800 | 9434800 | TBL1X | OA1 = GPR143 |
| ENST00000424279.1 | 4217 | 9431335 | 9687780 | + | seg_57 | 9433800 | 9434800 | TBL1X | OA1 = GPR143 |
| ENST00000415293.1 | 4218 | 9431371 | 9656077 | + | seg_57 | 9433800 | 9434800 | TBL1X | OA1 = GPR143 |
| ENST00000536365.1 | 4219 | 9431352 | 9684302 | + | seg_57 | 9433800 | 9434800 | TBL1X | OA1 = GPR143 |
| ENST00000422314.1 | 4220 | 9433334 | 9652158 | + | seg_57 | 9433800 | 9434800 | TBL1X | OA1 = GPR143 |
| ENST00000441088.1 | 4221 | 9431360 | 9622328 | + | seg_58 | 9465900 | 9467000 | TBL1X | OA1 = GPR143 |
| ENST00000217964.7 | 4222 | 9433048 | 9687778 | + | seg_58 | 9465900 | 9467000 | TBL1X | OA1 = GPR143 |
| ENST00000380961.1 | 4223 | 9431369 | 9686902 | + | seg_58 | 9465900 | 9467000 | TBL1X | OA1 = GPR143 |
| ENST00000407597.2 | 4224 | 9431335 | 9687780 | + | seg_58 | 9465900 | 9467000 | TBL1X | OA1 = GPR143 |
| ENST00000424279.1 | 4225 | 9431335 | 9687780 | + | seg_58 | 9465900 | 9467000 | TBL1X | OA1 = GPR143 |
| ENST00000415293.1 | 4226 | 9431371 | 9656077 | + | seg_58 | 9465900 | 9467000 | TBL1X | OA1 = GPR143 |
| ENST00000536365.1 | 4227 | 9431352 | 9684302 | + | seg_58 | 9465900 | 9467000 | TBL1X | OA1 = GPR143 |
| ENST00000422314.1 | 4228 | 9433334 | 9652158 | + | seg_58 | 9465900 | 9467000 | TBL1X | OA1 = GPR143 |
| ENST00000447366.1 | 4229 | 9707592 | 9754337 | − | seg_59 | 9732550 | 9734250 | GPR143 | OA1 = GPR143 |
| ENST00000431126.1 | 4230 | 9711605 | 9734229 | − | seg_59 | 9732550 | 9734250 | GPR143 | OA1 = GPR143 |
| ENST00000467482.1 | 4231 | 9693386 | 9734004 | − | seg_59 | 9732550 | 9734250 | GPR143 | OA1 = GPR143 |
| ENST00000380929.2 | 4232 | 9693454 | 9734005 | − | seg_59 | 9732550 | 9734250 | GPR143 | OA1 = GPR143 |
| ENST00000447366.1 | 4233 | 9707592 | 9754337 | − | seg_60 | 9754100 | 9755600 | SHROOM2 | OA1 = GPR143 |
| ENST00000380913.3 | 4234 | 9754496 | 9917483 | + | seg_60 | 9754100 | 9755600 | SHROOM2 | OA1 = GPR143 |
| ENST00000380913.3 | 4235 | 9754496 | 9917483 | + | seg_61 | 9815800 | 9817450 | SHROOM2 | OA1 = GPR143 |
| ENST00000380913.3 | 4236 | 9754496 | 9917483 | + | seg_62 | 9861700 | 9864800 | SHROOM2 | OA1 = GPR143 |
| ENST00000445307.2 | 4237 | 9935392 | 9936134 | + | seg_63 | 9935000 | 9936000 | AC002365.1 | OA1 = GPR143 |
| ENST00000543293.1 | 4238 | 10031499 | 10086141 | + | seg_66 | 10066550 | 10068450 | WWC3 | OA1 = GPR143 |
| ENST00000398613.4 | 4239 | 10035291 | 10109658 | + | seg_66 | 10066550 | 10068450 | WWC3 | OA1 = GPR143 |
| ENST00000380861.4 | 4240 | 9983602 | 10112518 | + | seg_66 | 10066550 | 10068450 | WWC3 | OA1 = GPR143 |
| ENST00000454666.1 | 4241 | 10031499 | 10109658 | + | seg_66 | 10066550 | 10068450 | WWC3 | OA1 = GPR143 |
| ENST00000423614.1 | 4242 | 10534995 | 10588625 | − | seg_67 | 10587800 | 10589000 | MID1 | OA1 = GPR143 |
| ENST00000453318.2 | 4243 | 10413350 | 10645779 | − | seg_67 | 10587800 | 10589000 | MID1 | OA1 = GPR143 |
| ENST00000380782.1 | 4244 | 10413596 | 10588459 | − | seg_67 | 10587800 | 10589000 | MID1 | OA1 = GPR143 |
| ENST00000380787.1 | 4245 | 10413596 | 10851773 | − | seg_67 | 10587800 | 10589000 | MID1 | OA1 = GPR143 |
| ENST00000380785.1 | 4246 | 10413596 | 10851762 | − | seg_67 | 10587800 | 10589000 | MID1 | OA1 = GPR143 |
| ENST00000317552.4 | 4247 | 10413350 | 10588674 | − | seg_67 | 10587800 | 10589000 | MID1 | OA1 = GPR143 |
| ENST00000413894.1 | 4248 | 10423115 | 10645727 | − | seg_67 | 10587800 | 10589000 | MID1 | OA1 = GPR143 |
| ENST00000433747.1 | 4249 | 10981960 | 11129258 | − | seg_68 | 10995600 | 10996600 | HCCS | OA1 = GPR143 |
| ENST00000433747.1 | 4250 | 10981960 | 11129258 | − | seg_69 | 11002150 | 11003400 | HCCS | OA1 = GPR143 |
| ENST00000380712.3 | 4251 | 11311533 | 11318881 | + | seg_70 | 11317250 | 11318400 | AMELX | OA1 = GPR143 |
| ENST00000380714.3 | 4252 | 11311533 | 11318881 | + | seg_70 | 11317250 | 11318400 | AMELX | OA1 = GPR143 |
| ENST00000348912.4 | 4253 | 11311533 | 11318873 | + | seg_70 | 11317250 | 11318400 | AMELX | OA1 = GPR143 |
| ENST00000380736.1 | 4254 | 11155663 | 11445893 | − | seg_70 | 11317250 | 11318400 | AMELX | OA1 = GPR143 |
| ENST00000413512.3 | 4255 | 11162134 | 11369656 | − | seg_70 | 11317250 | 11318400 | AMELX | OA1 = GPR143 |
| ENST00000380732.3 | 4256 | 11166770 | 11682948 | − | seg_70 | 11317250 | 11318400 | AMELX | OA1 = GPR143 |
| ENST00000489330.1 | 4257 | 11155667 | 11683203 | − | seg_70 | 11317250 | 11318400 | AMELX | OA1 = GPR143 |
| ENST00000337414.4 | 4258 | 11155664 | 11683821 | − | seg_70 | 11317250 | 11318400 | AMELX | OA1 = GPR143 |
| ENST00000495242.1 | 4259 | 11155664 | 11683821 | − | seg_70 | 11317250 | 11318400 | AMELX | OA1 = GPR143 |
| ENST00000380718.1 | 4260 | 11161517 | 11683821 | − | seg_70 | 11317250 | 11318400 | AMELX | OA1 = GPR143 |
| ENST00000380732.3 | 4261 | 11166770 | 11682948 | − | seg_71 | 11671200 | 11672400 | ARHGAP6 | OA1 = GPR143 |
| ENST00000489330.1 | 4262 | 11155667 | 11683203 | − | seg_71 | 11671200 | 11672400 | ARHGAP6 | OA1 = GPR143 |
| ENST00000337414.4 | 4263 | 11155664 | 11683821 | − | seg_71 | 11671200 | 11672400 | ARHGAP6 | OA1 = GPR143 |
| ENST00000495242.1 | 4264 | 11155664 | 11683821 | − | seg_71 | 11671200 | 11672400 | ARHGAP6 | OA1 = GPR143 |
| ENST00000380718.1 | 4265 | 11161517 | 11683821 | − | seg_71 | 11671200 | 11672400 | ARHGAP6 | OA1 = GPR143 |
| ENST00000380732.3 | 4266 | 11166770 | 11682948 | − | seg_72 | 11681150 | 11684100 | ARHGAP6 | OA1 = GPR143 |
| ENST00000489330.1 | 4267 | 11155667 | 11683203 | − | seg_72 | 11681150 | 11684100 | ARHGAP6 | OA1 = GPR143 |
| ENST00000337414.4 | 4268 | 11155664 | 11683821 | − | seg_72 | 11681150 | 11684100 | ARHGAP6 | OA1 = GPR143 |
| ENST00000495242.1 | 4269 | 11155664 | 11683821 | − | seg_72 | 11681150 | 11684100 | ARHGAP6 | OA1 = GPR143 |
| ENST00000380718.1 | 4270 | 11161517 | 11683821 | − | seg_72 | 11681150 | 11684100 | ARHGAP6 | OA1 = GPR143 |
| ENST00000473806.1 | 4271 | 11778257 | 11779701 | + | seg_74 | 11778800 | 11779850 | MSL3 | SEDL = TRAPPC2 |
| ENST00000478462.1 | 4272 | 11777760 | 11779173 | + | seg_74 | 11778800 | 11779850 | MSL3 | SEDL = TRAPPC2 |
| ENST00000380693.3 | 4273 | 11777671 | 11793870 | + | seg_74 | 11778800 | 11779850 | MSL3 | SEDL = TRAPPC2 |
| ENST00000337339.2 | 4274 | 11776356 | 11786096 | + | seg_74 | 11778800 | 11779850 | MSL3 | SEDL = TRAPPC2 |
| ENST00000312196.4 | 4275 | 11776278 | 11793870 | + | seg_74 | 11778800 | 11779850 | MSL3 | SEDL = TRAPPC2 |
| ENST00000398527.2 | 4276 | 11776728 | 11793574 | + | seg_74 | 11778800 | 11779850 | MSL3 | SEDL = TRAPPC2 |
| ENST00000468149.1 | 4277 | 11776372 | 11793350 | + | seg_74 | 11778800 | 11779850 | MSL3 | SEDL = TRAPPC2 |
| ENST00000494268.1 | 4278 | 11778341 | 11782370 | + | seg_74 | 11778800 | 11779850 | MSL3 | SEDL = TRAPPC2 |
| ENST00000421368.2 | 4279 | 11776705 | 11781076 | + | seg_74 | 11778800 | 11779850 | MSL3 | SEDL = TRAPPC2 |
| ENST00000487782.1 | 4280 | 11778594 | 11786803 | + | seg_74 | 11778800 | 11779850 | MSL3 | SEDL = TRAPPC2 |
| ENST00000476743.1 | 4281 | 11776701 | 11780338 | + | seg_74 | 11778800 | 11779850 | MSL3 | SEDL = TRAPPC2 |
| ENST00000483645.1 | 4282 | 11778305 | 11781043 | + | seg_74 | 11778800 | 11779850 | MSL3 | SEDL = TRAPPC2 |
| ENST00000361672.2 | 4283 | 11776410 | 11793350 | + | seg_74 | 11778800 | 11779850 | MSL3 | SEDL = TRAPPC2 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000380692.2 | 4284 | 11777747 | 11783765 | + | seg_74 | 11778800 | 11779850 | MSL3 | SEDL = TRAPPC2 |
| ENST00000482871.1 | 4285 | 11778162 | 11781026 | + | seg_74 | 11778800 | 11779850 | MSL3 | SEDL = TRAPPC2 |
| ENST00000304087.6 | 4286 | 12516791 | 12742633 | + | seg_75 | 12601150 | 12602900 | PRPS2 | SEDL = TRAPPC2 |
| ENST00000380682.1 | 4287 | 12156585 | 12742642 | + | seg_75 | 12601150 | 12602900 | PRPS2 | SEDL = TRAPPC2 |
| ENST00000429478.2 | 4288 | 12516714 | 12736911 | + | seg_75 | 12601150 | 12602900 | PRPS2 | SEDL = TRAPPC2 |
| ENST00000489404.1 | 4289 | 12809607 | 12828488 | + | seg_78 | 12812950 | 12814100 | PRPS2 | SEDL = TRAPPC2 |
| ENST00000398491.2 | 4290 | 12809525 | 12841205 | + | seg_78 | 12812950 | 12814100 | PRPS2 | SEDL = TRAPPC2 |
| ENST00000380668.5 | 4291 | 12809489 | 12842341 | + | seg_78 | 12812950 | 12814100 | PRPS2 | SEDL = TRAPPC2 |
| ENST00000380663.3 | 4292 | 12809474 | 12828238 | + | seg_78 | 12812950 | 12814100 | PRPS2 | SEDL = TRAPPC2 |
| ENST00000380659.3 | 4293 | 12885202 | 12908499 | + | seg_80 | 12897150 | 12898350 | TLR7 | SEDL = TRAPPC2 |
| ENST00000451311.2 | 4294 | 12993227 | 12995346 | + | seg_81 | 12993000 | 12994200 | TMSB4X | SEDL = TRAPPC2 |
| ENST00000380633.1 | 4295 | 12993777 | 12995200 | + | seg_81 | 12993000 | 12994200 | TMSB4X | SEDL = TRAPPC2 |
| ENST00000380635.1 | 4296 | 12993363 | 12995346 | + | seg_81 | 12993000 | 12994200 | TMSB4X | SEDL = TRAPPC2 |
| ENST00000380636.1 | 4297 | 12993229 | 12995345 | + | seg_81 | 12993000 | 12994200 | TMSB4X | SEDL = TRAPPC2 |
| ENST00000380602.3 | 4298 | 13587741 | 13651694 | + | seg_85 | 13587150 | 13589000 | EGFL6 | SEDL = TRAPPC2 |
| ENST00000361306.1 | 4299 | 13587724 | 13651693 | + | seg_85 | 13587150 | 13589000 | EGFL6 | SEDL = TRAPPC2 |
| ENST00000493677.1 | 4300 | 13790818 | 13835188 | − | seg_86 | 13804100 | 13806050 | GPM6B | OFD1 |
| ENST00000355135.2 | 4301 | 13792073 | 13835188 | − | seg_86 | 13804100 | 13806050 | GPM6B | OFD1 |
| ENST00000316715.4 | 4302 | 13789150 | 13835461 | − | seg_86 | 13804100 | 13806050 | GPM6B | OFD1 |
| ENST00000356942.5 | 4303 | 13792073 | 13835465 | − | seg_86 | 13804100 | 13806050 | GPM6B | OFD1 |
| ENST00000475307.1 | 4304 | 13801568 | 13835442 | − | seg_86 | 13804100 | 13806050 | GPM6B | OFD1 |
| ENST00000493085.1 | 4305 | 13797972 | 13907176 | − | seg_86 | 13804100 | 13806050 | GPM6B | OFD1 |
| ENST00000398361.3 | 4306 | 13792456 | 13956534 | − | seg_86 | 13804100 | 13806050 | GPM6B | OFD1 |
| ENST00000468080.1 | 4307 | 13798027 | 13907731 | − | seg_86 | 13804100 | 13806050 | GPM6B | OFD1 |
| ENST00000454189.2 | 4308 | 13789575 | 13956757 | − | seg_86 | 13804100 | 13806050 | GPM6B | OFD1 |
| ENST00000493677.1 | 4309 | 13790818 | 13835188 | − | seg_87 | 13834050 | 13835850 | GPM6B | OFD1 |
| ENST00000355135.2 | 4310 | 13792073 | 13835188 | − | seg_87 | 13834050 | 13835850 | GPM6B | OFD1 |
| ENST00000316715.4 | 4311 | 13789150 | 13835461 | − | seg_87 | 13834050 | 13835850 | GPM6B | OFD1 |
| ENST00000356942.5 | 4312 | 13792073 | 13835465 | − | seg_87 | 13834050 | 13835850 | GPM6B | OFD1 |
| ENST00000475307.1 | 4313 | 13801568 | 13835442 | − | seg_87 | 13834050 | 13835850 | GPM6B | OFD1 |
| ENST00000493085.1 | 4314 | 13797972 | 13907176 | − | seg_87 | 13834050 | 13835850 | GPM6B | OFD1 |
| ENST00000398361.3 | 4315 | 13792456 | 13956534 | − | seg_87 | 13834050 | 13835850 | GPM6B | OFD1 |
| ENST00000468080.1 | 4316 | 13798027 | 13907731 | − | seg_87 | 13834050 | 13835850 | GPM6B | OFD1 |
| ENST00000454189.2 | 4317 | 13789575 | 13956757 | − | seg_87 | 13834050 | 13835850 | GPM6B | OFD1 |
| ENST00000493085.1 | 4318 | 13797972 | 13907176 | − | seg_88 | 13898100 | 13899500 | GPM6B | OFD1 |
| ENST00000398361.3 | 4319 | 13792456 | 13956534 | − | seg_88 | 13898100 | 13899500 | GPM6B | OFD1 |
| ENST00000468080.1 | 4320 | 13798027 | 13907731 | − | seg_88 | 13898100 | 13899500 | GPM6B | OFD1 |
| ENST00000454189.2 | 4321 | 13789575 | 13956757 | − | seg_88 | 13898100 | 13899500 | GPM6B | OFD1 |
| ENST00000398361.3 | 4322 | 13792456 | 13956534 | − | seg_89 | 13955300 | 13956550 | GPM6B | OFD1 |
| ENST00000454189.2 | 4323 | 13789575 | 13956757 | − | seg_89 | 13955300 | 13956550 | GPM6B | OFD1 |
| ENST00000415367.1 | 4324 | 14549268 | 14625369 | + | seg_91 | 14596250 | 14597350 | GLRA2 | PIGA |
| ENST00000443437.2 | 4325 | 14547420 | 14749931 | + | seg_91 | 14596250 | 14597350 | GLRA2 | PIGA |
| ENST00000355020.4 | 4326 | 14547894 | 14748692 | + | seg_91 | 14596250 | 14597350 | GLRA2 | PIGA |
| ENST00000218075.4 | 4327 | 14547650 | 14749934 | + | seg_91 | 14596250 | 14597350 | GLRA2 | PIGA |
| ENST00000444401.1 | 4328 | 15135563 | 15135890 | − | seg_93 | 15134850 | 15135950 | ASB9 | PIGA |
| ENST00000380470.3 | 4329 | 15299819 | 15333746 | − | seg_94 | 15330250 | 15331650 | ASB11 | PIGA |
| ENST00000537676.1 | 4330 | 15298053 | 15332681 | − | seg_94 | 15330250 | 15331650 | ASB11 | PIGA |
| ENST00000344384.4 | 4331 | 15300441 | 15332681 | − | seg_94 | 15330250 | 15331650 | ASB11 | PIGA |
| ENST00000485437.1 | 4332 | 15301628 | 15333727 | − | seg_94 | 15330250 | 15331650 | ASB11 | PIGA |
| ENST00000480796.1 | 4333 | 15301166 | 15333778 | − | seg_94 | 15330250 | 15331650 | ASB11 | PIGA |
| ENST00000357277.3 | 4334 | 16964814 | 17171395 | + | seg_97 | 16967100 | 16968150 | REPS2 | CC = NHS |
| ENST00000380063.2 | 4335 | 16964814 | 17167136 | + | seg_97 | 16967100 | 16968150 | REPS2 | CC = NHS |
| ENST00000481792.1 | 4336 | 16965193 | 17040494 | + | seg_97 | 16967100 | 16968150 | REPS2 | CC = NHS |
| ENST00000303843.7 | 4337 | 16964985 | 17171395 | + | seg_97 | 16967100 | 16968150 | REPS2 | CC = NHS |
| ENST00000357277.3 | 4338 | 16964814 | 17171395 | + | seg_98 | 17047350 | 17048350 | REPS2 | CC = NHS |
| ENST00000380063.2 | 4339 | 16964814 | 17167136 | + | seg_98 | 17047350 | 17048350 | REPS2 | CC = NHS |
| ENST00000380064.4 | 4340 | 16996667 | 17165745 | + | seg_98 | 17047350 | 17048350 | REPS2 | CC = NHS |
| ENST00000303843.7 | 4341 | 16964985 | 17171395 | + | seg_98 | 17047350 | 17048350 | REPS2 | CC = NHS |
| ENST00000360011.1 | 4342 | 17818171 | 17878827 | − | seg_100 | 17877100 | 17879400 | RAI2 | CC = NHS |
| ENST00000331511.1 | 4343 | 17818171 | 17879356 | − | seg_100 | 17877100 | 17879400 | RAI2 | CC = NHS |
| ENST00000545871.1 | 4344 | 17818171 | 17879457 | − | seg_100 | 17877100 | 17879400 | RAI2 | CC = NHS |
| ENST00000451717.1 | 4345 | 17818171 | 17879457 | − | seg_100 | 17877100 | 17879400 | RAI2 | CC = NHS |
| ENST00000415486.2 | 4346 | 17818171 | 17879457 | − | seg_100 | 17877100 | 17879400 | RAI2 | CC = NHS |
| ENST00000453902.1 | 4347 | 17988317 | 18122764 | − | seg_101 | 18001050 | 18002050 | RAI2 | CDKL5 |
| ENST00000380033.4 | 4348 | 18181051 | 18239003 | − | seg_104 | 18232100 | 18233200 | BEND2 | CDKL5 |
| ENST00000380030.3 | 4349 | 18189095 | 18239024 | − | seg_104 | 18232100 | 18233200 | BEND2 | CDKL5 |
| ENST00000380033.4 | 4350 | 18181051 | 18239003 | − | seg_105 | 18236850 | 18239450 | BEND2 | CDKL5 |
| ENST00000380030.3 | 4351 | 18189095 | 18239024 | − | seg_105 | 18236850 | 18239450 | BEND2 | CDKL5 |
| ENST00000379996.3 | 4352 | 18443703 | 18671749 | + | seg_107 | 18442500 | 18445000 | CDKL5 | CDKL5 |
| ENST00000476595.1 | 4353 | 18660044 | 18668657 | − | seg_108 | 18661950 | 18663150 | RS1 | RS1 |
| ENST00000379984.3 | 4354 | 18658030 | 18690229 | − | seg_108 | 18661950 | 18663150 | RS1 | RS1 |
| ENST00000379996.3 | 4355 | 18443703 | 18671749 | + | seg_108 | 18661950 | 18663150 | RS1 | RS1 |
| ENST00000379989.3 | 4356 | 18460308 | 18671745 | + | seg_108 | 18661950 | 18663150 | RS1 | RS1 |
| ENST00000476595.1 | 4357 | 18660044 | 18668657 | − | seg_109 | 18667450 | 18668950 | RS1 | RS1 |
| ENST00000379984.3 | 4358 | 18658030 | 18690229 | − | seg_109 | 18667450 | 18668950 | RS1 | RS1 |
| ENST00000379996.3 | 4359 | 18443703 | 18671749 | + | seg_109 | 18667450 | 18668950 | RS1 | RS1 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000379989.3 | 4360 | 18460308 | 18671745 | + | seg_109 | 18667450 | 18668950 | RS1 | RS1 |
| ENST00000379942.4 | 4361 | 18910418 | 19002716 | − | seg_113 | 18931800 | 18932800 | PHKA2 | PHKA2 |
| ENST00000470101.1 | 4362 | 19378178 | 19391296 | − | seg_118 | 19390850 | 19391950 | PDHA1 | PHKA2 |
| ENST00000338883.4 | 4363 | 19378174 | 19533379 | − | seg_118 | 19390850 | 19391950 | PDHA1 | PHKA2 |
| ENST00000359173.3 | 4364 | 19378176 | 19478245 | − | seg_118 | 19390850 | 19391950 | PDHA1 | PHKA2 |
| ENST00000469203.2 | 4365 | 19378797 | 19504642 | − | seg_118 | 19390850 | 19391950 | PDHA1 | PHKA2 |
| ENST00000518578.1 | 4366 | 19378174 | 19500394 | − | seg_118 | 19390850 | 19391950 | PDHA1 | PHKA2 |
| ENST00000338883.4 | 4367 | 19378174 | 19533379 | − | seg_119 | 19395050 | 19396500 | PDHA1 | PHKA2 |
| ENST00000359173.3 | 4368 | 19378176 | 19478245 | − | seg_119 | 19395050 | 19396500 | PDHA1 | PHKA2 |
| ENST00000469203.2 | 4369 | 19378797 | 19504642 | − | seg_119 | 19395050 | 19396500 | PDHA1 | PHKA2 |
| ENST00000518578.1 | 4370 | 19378174 | 19500394 | − | seg_119 | 19395050 | 19396500 | PDHA1 | PHKA2 |
| ENST00000338883.4 | 4371 | 19378174 | 19533379 | − | seg_120 | 19398600 | 19399850 | PDHA1 | PHKA2 |
| ENST00000359173.3 | 4372 | 19378176 | 19478245 | − | seg_120 | 19398600 | 19399850 | PDHA1 | PHKA2 |
| ENST00000469203.2 | 4373 | 19378797 | 19504642 | − | seg_120 | 19398600 | 19399850 | PDHA1 | PHKA2 |
| ENST00000518578.1 | 4374 | 19378174 | 19500394 | − | seg_120 | 19398600 | 19399850 | PDHA1 | PHKA2 |
| ENST00000338883.4 | 4375 | 19378174 | 19533379 | − | seg_121 | 19504100 | 19505200 | MAP3K15 | PHKA2 |
| ENST00000469203.2 | 4376 | 19378797 | 19504642 | − | seg_121 | 19504100 | 19505200 | MAP3K15 | PHKA2 |
| ENST00000397804.1 | 4377 | 19553520 | 19725207 | − | seg_122 | 19602850 | 19605500 | SH3KBP1 | PHKA2 |
| ENST00000379698.4 | 4378 | 19553811 | 19817869 | − | seg_122 | 19602850 | 19605500 | SH3KBP1 | PHKA2 |
| ENST00000397821.3 | 4379 | 19552093 | 19905719 | − | seg_122 | 19602850 | 19605500 | SH3KBP1 | PHKA2 |
| ENST00000379702.2 | 4380 | 19552083 | 19905719 | − | seg_122 | 19602850 | 19605500 | SH3KBP1 | PHKA2 |
| ENST00000379726.3 | 4381 | 19554532 | 19764529 | − | seg_122 | 19602850 | 19605500 | SH3KBP1 | PHKA2 |
| ENST00000541422.1 | 4382 | 19554308 | 19688480 | − | seg_122 | 19602850 | 19605500 | SH3KBP1 | PHKA2 |
| ENST00000379716.1 | 4383 | 19552125 | 19689116 | − | seg_122 | 19602850 | 19605500 | SH3KBP1 | PHKA2 |
| ENST00000397804.1 | 4384 | 19553520 | 19725207 | − | seg_123 | 19627300 | 19628350 | SH3KBP1 | PHKA2 |
| ENST00000379698.4 | 4385 | 19553811 | 19817869 | − | seg_123 | 19627300 | 19628350 | SH3KBP1 | PHKA2 |
| ENST00000397821.3 | 4386 | 19552093 | 19905719 | − | seg_123 | 19627300 | 19628350 | SH3KBP1 | PHKA2 |
| ENST00000477102.1 | 4387 | 19610186 | 19682833 | − | seg_123 | 19627300 | 19628350 | SH3KBP1 | PHKA2 |
| ENST00000379697.3 | 4388 | 19606396 | 19905577 | − | seg_123 | 19627300 | 19628350 | SH3KBP1 | PHKA2 |
| ENST00000494961.1 | 4389 | 19606802 | 19713819 | − | seg_123 | 19627300 | 19628350 | SH3KBP1 | PHKA2 |
| ENST00000379702.2 | 4390 | 19552083 | 19905719 | − | seg_123 | 19627300 | 19628350 | SH3KBP1 | PHKA2 |
| ENST00000379726.3 | 4391 | 19554532 | 19764529 | − | seg_123 | 19627300 | 19628350 | SH3KBP1 | PHKA2 |
| ENST00000541422.1 | 4392 | 19554308 | 19688480 | − | seg_123 | 19627300 | 19628350 | SH3KBP1 | PHKA2 |
| ENST00000379716.1 | 4393 | 19552125 | 19689116 | − | seg_123 | 19627300 | 19628350 | SH3KBP1 | PHKA2 |
| ENST00000397821.3 | 4394 | 19552093 | 19905719 | − | seg_124 | 19874700 | 19875850 | SH3KBP1 | PHKA2 |
| ENST00000379697.3 | 4395 | 19606396 | 19905577 | − | seg_124 | 19874700 | 19875850 | SH3KBP1 | PHKA2 |
| ENST00000379702.2 | 4396 | 19552083 | 19905719 | − | seg_124 | 19874700 | 19875850 | SH3KBP1 | PHKA2 |
| ENST00000397821.3 | 4397 | 19552093 | 19905719 | − | seg_125 | 19904300 | 19906050 | SH3KBP1 | PHKA2 |
| ENST00000379697.3 | 4398 | 19606396 | 19905577 | − | seg_125 | 19904300 | 19906050 | SH3KBP1 | PHKA2 |
| ENST00000379702.2 | 4399 | 19552083 | 19905719 | − | seg_125 | 19904300 | 19906050 | SH3KBP1 | PHKA2 |
| ENST00000330274.7 | 4400 | 20070519 | 20135114 | − | seg_127 | 20099150 | 20100450 | MAP7D2 | PHKA2 |
| ENST00000379643.4 | 4401 | 20024833 | 20135114 | − | seg_127 | 20099150 | 20100450 | MAP7D2 | PHKA2 |
| ENST00000544957.1 | 4402 | 20026440 | 20135022 | − | seg_127 | 20099150 | 20100450 | MAP7D2 | PHKA2 |
| ENST00000443379.2 | 4403 | 20024833 | 20135114 | − | seg_127 | 20099150 | 20100450 | MAP7D2 | PHKA2 |
| ENST00000379651.3 | 4404 | 20024831 | 20135016 | − | seg_127 | 20099150 | 20100450 | MAP7D2 | PHKA2 |
| ENST00000452324.2 | 4405 | 20024833 | 20134756 | − | seg_127 | 20099150 | 20100450 | MAP7D2 | PHKA2 |
| ENST00000330274.7 | 4406 | 20070519 | 20135114 | − | seg_128 | 20129200 | 20134650 | MAP7D2 | PHKA2 |
| ENST00000379643.4 | 4407 | 20024833 | 20135114 | − | seg_128 | 20129200 | 20134650 | MAP7D2 | PHKA2 |
| ENST00000544957.1 | 4408 | 20026440 | 20135022 | − | seg_128 | 20129200 | 20134650 | MAP7D2 | PHKA2 |
| ENST00000443379.2 | 4409 | 20024833 | 20135114 | − | seg_128 | 20129200 | 20134650 | MAP7D2 | PHKA2 |
| ENST00000379651.3 | 4410 | 20024831 | 20135016 | − | seg_128 | 20129200 | 20134650 | MAP7D2 | PHKA2 |
| ENST00000452324.2 | 4411 | 20024833 | 20134756 | − | seg_128 | 20129200 | 20134650 | MAP7D2 | PHKA2 |
| ENST00000379607.5 | 4412 | 20142636 | 20159962 | − | seg_129 | 20159600 | 20160600 | EIF1AX | PHKA2 |
| ENST00000379593.1 | 4413 | 20146196 | 20159944 | − | seg_129 | 20159600 | 20160600 | EIF1AX | PHKA2 |
| ENST00000404933.2 | 4414 | 21958691 | 22012953 | + | seg_133 | 21991750 | 21992750 | SMS | PHEX |
| ENST00000379404.1 | 4415 | 21958833 | 22012591 | + | seg_133 | 21991750 | 21992750 | SMS | PHEX |
| ENST00000457085.1 | 4416 | 21959163 | 21996229 | + | seg_133 | 21991750 | 21992750 | SMS | PHEX |
| ENST00000478094.1 | 4417 | 21958896 | 21996107 | + | seg_133 | 21991750 | 21992750 | SMS | PHEX |
| ENST00000415881.2 | 4418 | 21958853 | 22025798 | + | seg_133 | 21991750 | 21992750 | SMS | PHEX |
| ENST00000424650.1 | 4419 | 22180850 | 22191100 | + | seg_134 | 22180550 | 22181700 | PHEX | PHEX |
| ENST00000379374.4 | 4420 | 22050559 | 22269427 | + | seg_134 | 22180550 | 22181700 | PHEX | PHEX |
| ENST00000537599.1 | 4421 | 22051016 | 22266300 | + | seg_134 | 22180550 | 22181700 | PHEX | PHEX |
| ENST00000535894.1 | 4422 | 22056171 | 22266413 | + | seg_134 | 22180550 | 22181700 | PHEX | PHEX |
| ENST00000418858.3 | 4423 | 22115822 | 22266209 | + | seg_134 | 22180550 | 22181700 | PHEX | PHEX |
| ENST00000455399.1 | 4424 | 22407432 | 23082236 | − | seg_135 | 22537550 | 22538650 | ZNF645 | PHEX |
| ENST00000455399.1 | 4425 | 22407432 | 23082236 | − | seg_136 | 22961950 | 22963000 | DDX53 | SAT = SAT1 |
| ENST00000312214.5 | 4426 | 23093875 | 23094884 | + | seg_137 | 23093050 | 23094400 | DDX53 | SAT = SAT1 |
| ENST00000508288.1 | 4427 | 23093708 | 23096495 | − | seg_137 | 23093050 | 23094400 | DDX53 | SAT = SAT1 |
| ENST00000379361.4 | 4428 | 23352133 | 23422489 | + | seg_139 | 23412800 | 23413800 | PTCHD1 | SAT = SAT1 |
| ENST00000439528.1 | 4429 | 23851480 | 23899018 | − | seg_141 | 23889950 | 23891000 | APOO | SAT = SAT1 |
| ENST00000379226.4 | 4430 | 23851470 | 23926051 | − | seg_141 | 23889950 | 23891000 | APOO | SAT = SAT1 |
| ENST00000379220.3 | 4431 | 23851481 | 23926057 | − | seg_141 | 23889950 | 23891000 | APOO | SAT = SAT1 |
| ENST00000490078.1 | 4432 | 23851484 | 23926020 | − | seg_141 | 23889950 | 23891000 | APOO | SAT = SAT1 |
| ENST00000379211.3 | 4433 | 23925918 | 23957624 | + | seg_142 | 23925150 | 23926350 | APOO | SAT = SAT1 |
| ENST00000379226.4 | 4434 | 23851470 | 23926051 | − | seg_142 | 23925150 | 23926350 | APOO | SAT = SAT1 |
| ENST00000379220.3 | 4435 | 23851481 | 23926057 | − | seg_142 | 23925150 | 23926350 | APOO | SAT = SAT1 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000490078.1 | 4436 | 23851484 | 23926020 | − | seg_142 | 23925150 | 23926350 | APOO | SAT = SAT1 |
| ENST00000486479.1 | 4437 | 24329024 | 24331432 | − | seg_146 | 24328700 | 24333250 | ZFX | SAT = SAT1 |
| ENST00000536351.1 | 4438 | 24328979 | 24331432 | − | seg_146 | 24328700 | 24333250 | ZFX | SAT = SAT1 |
| ENST00000413856.1 | 4439 | 24380878 | 24383541 | + | seg_147 | 24379450 | 24382100 | PDK3 | SAT = SAT1 |
| ENST00000436466.1 | 4440 | 24380878 | 24383495 | + | seg_147 | 24379450 | 24382100 | PDK3 | SAT = SAT1 |
| ENST00000441463.2 | 4441 | 24483573 | 24557954 | + | seg_149 | 24504450 | 24505550 | PDK3 | SAT = SAT1 |
| ENST00000379162.4 | 4442 | 24483338 | 24552542 | + | seg_149 | 24504450 | 24505550 | PDK3 | SAT = SAT1 |
| ENST00000379144.2 | 4443 | 24579959 | 24665353 | − | seg_151 | 24644850 | 24646050 | PCYT1B | SAT = SAT1 |
| ENST00000356768.4 | 4444 | 24579959 | 24665275 | − | seg_151 | 24644850 | 24646050 | PCYT1B | SAT = SAT1 |
| ENST00000379145.1 | 4445 | 24576204 | 24690794 | − | seg_151 | 24644850 | 24646050 | PCYT1B | SAT = SAT1 |
| ENST00000496020.1 | 4446 | 24580518 | 24665155 | − | seg_151 | 24644850 | 24646050 | PCYT1B | SAT = SAT1 |
| ENST00000379044.4 | 4447 | 25021811 | 25034065 | − | seg_152 | 25025650 | 25045000 | ARX | SAT = SAT1 |
| ENST00000438281.1 | 4448 | 25047662 | 25048352 | + | seg_153 | 25046850 | 25048300 | ARX | SAT = SAT1 |
| ENST00000378963.1 | 4449 | 30323791 | 30326605 | − | seg_158 | 30325950 | 30328550 | NR0B1 | DAX1 = NR0B1 |
| ENST00000453287.1 | 4450 | 30323938 | 30327495 | − | seg_158 | 30325950 | 30328550 | NR0B1 | DAX1 = NR0B1 |
| ENST00000378970.4 | 4451 | 30322323 | 30327715 | − | seg_158 | 30325950 | 30328550 | NR0B1 | DAX1 = NR0B1 |
| ENST00000378932.2 | 4452 | 30848454 | 30993201 | − | seg_160 | 30955050 | 30956300 | TAB3 | DAX1 = NR0B1 |
| ENST00000288422.2 | 4453 | 30848454 | 30993201 | − | seg_160 | 30955050 | 30956300 | TAB3 | DAX1 = NR0B1 |
| ENST00000378932.2 | 4454 | 30848454 | 30993201 | − | seg_161 | 30992350 | 30993350 | FTHL17 | DAX1 = NR0B1 |
| ENST00000288422.2 | 4455 | 30848454 | 30993201 | − | seg_161 | 30992350 | 30993350 | FTHL17 | DAX1 = NR0B1 |
| ENST00000474231.1 | 4456 | 31139514 | 32173586 | − | seg_163 | 31691100 | 31692100 | DMD | DAX1 = NR0B1 |
| ENST00000378684.4 | 4457 | 31132808 | 32430174 | − | seg_163 | 31691100 | 31692100 | DMD | DAX1 = NR0B1 |
| ENST00000343523.2 | 4458 | 31137345 | 32173586 | − | seg_163 | 31691100 | 31692100 | DMD | DAX1 = NR0B1 |
| ENST00000541735.1 | 4459 | 31137345 | 32173586 | − | seg_163 | 31691100 | 31692100 | DMD | DAX1 = NR0B1 |
| ENST00000378682.4 | 4460 | 31132808 | 32430326 | − | seg_163 | 31691100 | 31692100 | DMD | DAX1 = NR0B1 |
| ENST00000357033.4 | 4461 | 31137345 | 33229636 | − | seg_163 | 31691100 | 31692100 | DMD | DAX1 = NR0B1 |
| ENST00000542849.1 | 4462 | 31137345 | 33229673 | − | seg_163 | 31691100 | 31692100 | DMD | DAX1 = NR0B1 |
| ENST00000359836.1 | 4463 | 31137345 | 32173586 | − | seg_163 | 31691100 | 31692100 | DMD | DAX1 = NR0B1 |
| ENST00000535280.1 | 4464 | 31137345 | 33146544 | − | seg_163 | 31691100 | 31692100 | DMD | DAX1 = NR0B1 |
| ENST00000378707.3 | 4465 | 31137345 | 32173586 | − | seg_163 | 31691100 | 31692100 | DMD | DAX1 = NR0B1 |
| ENST00000378677.2 | 4466 | 31137345 | 33146477 | − | seg_163 | 31691100 | 31692100 | DMD | DAX1 = NR0B1 |
| ENST00000358062.2 | 4467 | 31137338 | 31893490 | − | seg_163 | 31691100 | 31692100 | DMD | DAX1 = NR0B1 |
| ENST00000534884.1 | 4468 | 31132808 | 33038324 | − | seg_163 | 31691100 | 31692100 | DMD | DAX1 = NR0B1 |
| ENST00000465285.1 | 4469 | 31139514 | 31947809 | − | seg_163 | 31691100 | 31692100 | DMD | DAX1 = NR0B1 |
| ENST00000439992.1 | 4470 | 33744625 | 33960397 | + | seg_164 | 33817650 | 33818700 | FAM47A | DAX1 = NR0B1 |
| ENST00000445233.1 | 4471 | 33760235 | 33960352 | + | seg_164 | 33817650 | 33818700 | FAM47A | DAX1 = NR0B1 |
| ENST00000402402.2 | 4472 | 37351274 | 37351801 | + | seg_168 | 37351000 | 37352100 | LANCL3 | XK |
| ENST00000465127.1 | 4473 | 37208583 | 38546928 | + | seg_168 | 37351000 | 37352100 | LANCL3 | XK |
| ENST00000465127.1 | 4474 | 37208583 | 38546928 | + | seg_169 | 37733800 | 37734850 | DYNLT3 | CYBB |
| ENST00000423919.1 | 4475 | 38080644 | 38082920 | + | seg_170 | 38078900 | 38081100 | SRPX | RPGR |
| ENST00000432886.2 | 4476 | 38008589 | 38080177 | − | seg_170 | 38078900 | 38081100 | SRPX | RPGR |
| ENST00000378533.3 | 4477 | 38008592 | 38080152 | − | seg_170 | 38078900 | 38081100 | SRPX | RPGR |
| ENST00000538295.1 | 4478 | 38008589 | 38080177 | − | seg_170 | 38078900 | 38081100 | SRPX | RPGR |
| ENST00000343800.6 | 4479 | 38008595 | 38080696 | − | seg_170 | 38078900 | 38081100 | SRPX | RPGR |
| ENST00000544439.1 | 4480 | 38008589 | 38080177 | − | seg_170 | 38078900 | 38081100 | SRPX | RPGR |
| ENST00000465127.1 | 4481 | 37208583 | 38546928 | + | seg_170 | 38078900 | 38081100 | SRPX | RPGR |
| ENST00000457894.1 | 4482 | 38660685 | 38665781 | + | seg_171 | 38663050 | 38664250 | MID1IP1 | OTC |
| ENST00000336949.6 | 4483 | 38662986 | 38665790 | + | seg_171 | 38663050 | 38664250 | MID1IP1 | OTC |
| ENST00000436893.1 | 4484 | 38660821 | 38663136 | − | seg_171 | 38663050 | 38664250 | MID1IP1 | OTC |
| ENST00000378474.3 | 4485 | 38660707 | 38665686 | + | seg_171 | 38663050 | 38664250 | MID1IP1 | OTC |
| ENST00000342274.4 | 4486 | 39910501 | 40036582 | − | seg_183 | 40027900 | 40029300 | BCOR | CSNB1 = NYX |
| ENST00000378455.4 | 4487 | 39910499 | 40036582 | − | seg_183 | 40027900 | 40029300 | BCOR | CSNB1 = NYX |
| ENST00000406200.2 | 4488 | 39922208 | 40036573 | − | seg_183 | 40027900 | 40029300 | BCOR | CSNB1 = NYX |
| ENST00000342595.2 | 4489 | 41306687 | 41334963 | + | seg_193 | 41306350 | 41307400 | NYX | CSNB1 = NYX |
| ENST00000378220.1 | 4490 | 41306713 | 41334905 | + | seg_193 | 41306350 | 41307400 | NYX | CSNB1 = NYX |
| ENST00000442175.1 | 4491 | 41958007 | 41958426 | − | seg_194 | 41958050 | 41959450 | CASK | CSNB1 = NYX |
| ENST00000440002.1 | 4492 | 42315830 | 42558636 | + | seg_196 | 42505050 | 42506050 | CASK | CSNB1 = NYX |
| ENST00000411879.1 | 4493 | 42111712 | 42558542 | + | seg_196 | 42505050 | 42506050 | CASK | CSNB1 = NYX |
| ENST00000378062.5 | 4494 | 43808022 | 43832750 | − | seg_198 | 43830050 | 43831700 | NDP | NDP |
| ENST00000470584.1 | 4495 | 43808928 | 43832632 | − | seg_198 | 43830050 | 43831700 | NDP | NDP |
| ENST00000328306.4 | 4496 | 46464753 | 46618490 | − | seg_202 | 46464100 | 46465450 | CHST7 | UBA1 |
| ENST00000446295.1 | 4497 | 47372001 | 47372882 | − | seg_207 | 47371600 | 47373400 | CXorf24 | UBA1 |
| ENST00000340666.4 | 4498 | 47431303 | 47479252 | − | seg_208 | 47476800 | 47478350 | SYN1 | UBA1 |
| ENST00000295987.7 | 4499 | 47431303 | 47479252 | − | seg_208 | 47476800 | 47478350 | SYN1 | UBA1 |
| ENST00000483225.1 | 4500 | 47566590 | 47596027 | + | seg_209 | 47595750 | 47596900 | UXT | UBA1 |
| ENST00000444248.1 | 4501 | 47662695 | 47664188 | + | seg_210 | 47661850 | 47663050 | ZNF81 | UBA1 |
| ENST00000338709.3 | 4502 | 47657325 | 47664188 | + | seg_210 | 47661850 | 47663050 | ZNF81 | UBA1 |
| ENST00000453735.1 | 4503 | 48166204 | 48168490 | + | seg_212 | 48165350 | 48166500 | SSX9 | WAS |
| ENST00000407081.2 | 4504 | 48156255 | 48165614 | − | seg_212 | 48165350 | 48166500 | SSX9 | WAS |
| ENST00000376909.1 | 4505 | 48154885 | 48165675 | − | seg_212 | 48165350 | 48166500 | SSX9 | WAS |
| ENST00000424410.1 | 4506 | 48193110 | 48193874 | − | seg_214 | 48193350 | 48194400 | SSX3 | WAS |
| ENST00000413071.1 | 4507 | 48239582 | 48242564 | − | seg_216 | 48240000 | 48241200 | SSX4 | WAS |
| ENST00000376327.5 | 4508 | 49028273 | 49031588 | + | seg_219 | 49029700 | 49030700 | PLP2 | PQBP1 |
| ENST00000376322.3 | 4509 | 49028273 | 49030030 | + | seg_219 | 49029700 | 49030700 | PLP2 | PQBP1 |
| ENST00000323022.5 | 4510 | 49061523 | 49089833 | − | seg_220 | 49068450 | 49069750 | CACNA1F | PQBP1 |
| ENST00000376265.2 | 4511 | 49061523 | 49089833 | − | seg_220 | 49068450 | 49069750 | CACNA1F | PQBP1 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000376251.1 | 4512 | 49061523 | 49089771 | − | seg_220 | 49068450 | 49069750 | CACNA1F | PQBP1 |
| ENST00000323022.5 | 4513 | 49061523 | 49089833 | − | seg_221 | 49074200 | 49075450 | CACNA1F | PQBP1 |
| ENST00000376265.2 | 4514 | 49061523 | 49089833 | − | seg_221 | 49074200 | 49075450 | CACNA1F | PQBP1 |
| ENST00000376251.1 | 4515 | 49061523 | 49089771 | − | seg_221 | 49074200 | 49075450 | CACNA1F | PQBP1 |
| ENST00000492334.1 | 4516 | 49104172 | 49106976 | + | seg_222 | 49104450 | 49105650 | FOXP3 | PQBP1 |
| ENST00000538876.1 | 4517 | 49091932 | 49106980 | + | seg_222 | 49104450 | 49105650 | FOXP3 | PQBP1 |
| ENST00000376227.3 | 4518 | 49091927 | 49106987 | + | seg_222 | 49104450 | 49105650 | FOXP3 | PQBP1 |
| ENST00000289292.7 | 4519 | 50334647 | 50557302 | − | seg_229 | 50450650 | 50451850 | SHROOM4 | CLCN5 |
| ENST00000376020.2 | 4520 | 50334647 | 50557044 | − | seg_229 | 50450650 | 50451850 | SHROOM4 | CLCN5 |
| ENST00000289292.7 | 4521 | 50334647 | 50557302 | − | seg_230 | 50555600 | 50557750 | SHROOM4 | CLCN5 |
| ENST00000376020.2 | 4522 | 50334647 | 50557044 | − | seg_230 | 50555600 | 50557750 | SHROOM4 | CLCN5 |
| ENST00000425150.1 | 4523 | 51099796 | 51139314 | − | seg_233 | 51126600 | 51128150 | CXorf67 | CLCN5 |
| ENST00000491883.1 | 4524 | 51425000 | 51425485 | − | seg_236 | 51424500 | 51426000 | GSPT2 | CLCN5 |
| ENST00000480752.1 | 4525 | 51453887 | 51454372 | + | seg_237 | 51452900 | 51456150 | GSPT2 | CLCN5 |
| ENST00000375772.3 | 4526 | 51546103 | 51645450 | + | seg_239 | 51545600 | 51546650 | GSPT2 | MRX1 = IQSEC2 |
| ENST00000408778.1 | 4527 | 51806443 | 51806570 | − | seg_241 | 51805500 | 51812400 | MAGED4B | MRX1 = IQSEC2 |
| ENST00000514560.1 | 4528 | 51809141 | 51809753 | − | seg_241 | 51805500 | 51812400 | MAGED4B | MRX1 = IQSEC2 |
| ENST00000486010.1 | 4529 | 51810106 | 51812268 | − | seg_241 | 51805500 | 51812400 | MAGED4B | MRX1 = IQSEC2 |
| ENST00000486469.1 | 4530 | 51810098 | 51810701 | − | seg_241 | 51805500 | 51812400 | MAGED4B | MRX1 = IQSEC2 |
| ENST00000480114.1 | 4531 | 51804925 | 51812303 | − | seg_241 | 51805500 | 51812400 | MAGED4B | MRX1 = IQSEC2 |
| ENST00000470594.1 | 4532 | 51804923 | 51812278 | − | seg_241 | 51805500 | 51812400 | MAGED4B | MRX1 = IQSEC2 |
| ENST00000471617.1 | 4533 | 51804935 | 51807173 | − | seg_241 | 51805500 | 51812400 | MAGED4B | MRX1 = IQSEC2 |
| ENST00000497164.1 | 4534 | 51804923 | 51812278 | − | seg_241 | 51805500 | 51812400 | MAGED4B | MRX1 = IQSEC2 |
| ENST00000481193.2 | 4535 | 51805652 | 51808388 | − | seg_241 | 51805500 | 51812400 | MAGED4B | MRX1 = IQSEC2 |
| ENST00000490581.2 | 4536 | 51804923 | 51807639 | − | seg_241 | 51805500 | 51812400 | MAGED4B | MRX1 = IQSEC2 |
| ENST00000335504.5 | 4537 | 51804923 | 51812344 | − | seg_241 | 51805500 | 51812400 | MAGED4B | MRX1 = IQSEC2 |
| ENST00000360134.6 | 4538 | 51804923 | 51812294 | − | seg_241 | 51805500 | 51812400 | MAGED4B | MRX1 = IQSEC2 |
| ENST00000431659.1 | 4539 | 51804923 | 51812368 | − | seg_241 | 51805500 | 51812400 | MAGED4B | MRX1 = IQSEC2 |
| ENST00000481096.2 | 4540 | 51804923 | 51809773 | − | seg_241 | 51805500 | 51812400 | MAGED4B | MRX1 = IQSEC2 |
| ENST00000485287.1 | 4541 | 51804923 | 51812315 | − | seg_241 | 51805500 | 51812400 | MAGED4B | MRX1 = IQSEC2 |
| ENST00000477634.1 | 4542 | 51928008 | 51935364 | + | seg_242 | 51929300 | 51932300 | MAGED4 | MRX1 = IQSEC2 |
| ENST00000416960.1 | 4543 | 51927919 | 51935364 | + | seg_242 | 51929300 | 51932300 | MAGED4 | MRX1 = IQSEC2 |
| ENST00000474812.1 | 4544 | 51929586 | 51930176 | + | seg_242 | 51929300 | 51932300 | MAGED4 | MRX1 = IQSEC2 |
| ENST00000488430.1 | 4545 | 51927983 | 51935364 | + | seg_242 | 51929300 | 51932300 | MAGED4 | MRX1 = IQSEC2 |
| ENST00000459685.1 | 4546 | 51927972 | 51935364 | + | seg_242 | 51929300 | 51932300 | MAGED4 | MRX1 = IQSEC2 |
| ENST00000471932.1 | 4547 | 51927943 | 51935364 | + | seg_242 | 51929300 | 51932300 | MAGED4 | MRX1 = IQSEC2 |
| ENST00000467526.1 | 4548 | 51928019 | 51930190 | + | seg_242 | 51929300 | 51932300 | MAGED4 | MRX1 = IQSEC2 |
| ENST00000479281.1 | 4549 | 51930729 | 51935364 | + | seg_242 | 51929300 | 51932300 | MAGED4 | MRX1 = IQSEC2 |
| ENST00000375626.3 | 4550 | 51928008 | 51935364 | + | seg_242 | 51929300 | 51932300 | MAGED4 | MRX1 = IQSEC2 |
| ENST00000498483.1 | 4551 | 51928008 | 51935364 | + | seg_242 | 51929300 | 51932300 | MAGED4 | MRX1 = IQSEC2 |
| ENST00000477634.1 | 4552 | 51928008 | 51935364 | + | seg_243 | 51935000 | 51936100 | MAGED4 | MRX1 = IQSEC2 |
| ENST00000494716.1 | 4553 | 51933114 | 51935352 | + | seg_243 | 51935000 | 51936100 | MAGED4 | MRX1 = IQSEC2 |
| ENST00000416960.1 | 4554 | 51927919 | 51935364 | + | seg_243 | 51935000 | 51936100 | MAGED4 | MRX1 = IQSEC2 |
| ENST00000497348.1 | 4555 | 51934138 | 51935280 | + | seg_243 | 51935000 | 51936100 | MAGED4 | MRX1 = IQSEC2 |
| ENST00000488430.1 | 4556 | 51927983 | 51935364 | + | seg_243 | 51935000 | 51936100 | MAGED4 | MRX1 = IQSEC2 |
| ENST00000459685.1 | 4557 | 51927972 | 51935364 | + | seg_243 | 51935000 | 51936100 | MAGED4 | MRX1 = IQSEC2 |
| ENST00000471932.1 | 4558 | 51927943 | 51935364 | + | seg_243 | 51935000 | 51936100 | MAGED4 | MRX1 = IQSEC2 |
| ENST00000479281.1 | 4559 | 51930729 | 51935364 | + | seg_243 | 51935000 | 51936100 | MAGED4 | MRX1 = IQSEC2 |
| ENST00000375626.3 | 4560 | 51928008 | 51935364 | + | seg_243 | 51935000 | 51936100 | MAGED4 | MRX1 = IQSEC2 |
| ENST00000498483.1 | 4561 | 51928008 | 51935364 | + | seg_243 | 51935000 | 51936100 | MAGED4 | MRX1 = IQSEC2 |
| ENST00000518075.1 | 4562 | 52235228 | 52243951 | + | seg_245 | 52239900 | 52241050 | XAGE1B | MRX1 = IQSEC2 |
| ENST00000375612.4 | 4563 | 52239019 | 52243954 | + | seg_245 | 52239900 | 52241050 | XAGE1B | MRX1 = IQSEC2 |
| ENST00000375616.1 | 4564 | 52238818 | 52243954 | + | seg_245 | 52239900 | 52241050 | XAGE1B | MRX1 = IQSEC2 |
| ENST00000399805.2 | 4565 | 52240504 | 52243954 | + | seg_245 | 52239900 | 52241050 | XAGE1B | MRX1 = IQSEC2 |
| ENST00000437949.2 | 4566 | 52238810 | 52243954 | + | seg_245 | 52239900 | 52241050 | XAGE1B | MRX1 = IQSEC2 |
| ENST00000494039.1 | 4567 | 52241006 | 52243954 | + | seg_245 | 52239900 | 52241050 | XAGE1B | MRX1 = IQSEC2 |
| ENST00000519579.1 | 4568 | 52238925 | 52240863 | + | seg_245 | 52239900 | 52241050 | XAGE1B | MRX1 = IQSEC2 |
| ENST00000375613.3 | 4569 | 52238974 | 52243954 | + | seg_245 | 52239900 | 52241050 | XAGE1B | MRX1 = IQSEC2 |
| ENST00000478767.1 | 4570 | 52528159 | 52531107 | − | seg_249 | 52530600 | 52532500 | XAGE1D | MRX1 = IQSEC2 |
| ENST00000374959.3 | 4571 | 52528162 | 52533139 | − | seg_249 | 52530600 | 52532500 | XAGE1D | MRX1 = IQSEC2 |
| ENST00000375578.1 | 4572 | 52528159 | 52533295 | − | seg_249 | 52530600 | 52532500 | XAGE1D | MRX1 = IQSEC2 |
| ENST00000396497.3 | 4573 | 52528159 | 52533303 | − | seg_249 | 52530600 | 52532500 | XAGE1D | MRX1 = IQSEC2 |
| ENST00000438079.1 | 4574 | 52528159 | 52531609 | − | seg_249 | 52530600 | 52532500 | XAGE1D | MRX1 = IQSEC2 |
| ENST00000375572.4 | 4575 | 52528159 | 52533094 | − | seg_249 | 52530600 | 52532500 | XAGE1D | MRX1 = IQSEC2 |
| ENST00000375563.4 | 4576 | 52541053 | 52545988 | − | seg_250 | 52543750 | 52545000 | XAGE1E | MRX1 = IQSEC2 |
| ENST00000375567.3 | 4577 | 52541053 | 52546033 | − | seg_250 | 52543750 | 52545000 | XAGE1E | MRX1 = IQSEC2 |
| ENST00000375570.1 | 4578 | 52541053 | 52546189 | − | seg_250 | 52543750 | 52545000 | XAGE1E | MRX1 = IQSEC2 |
| ENST00000463689.1 | 4579 | 52541053 | 52544001 | − | seg_250 | 52543750 | 52545000 | XAGE1E | MRX1 = IQSEC2 |
| ENST00000429372.2 | 4580 | 52541053 | 52546197 | − | seg_250 | 52543750 | 52545000 | XAGE1E | MRX1 = IQSEC2 |
| ENST00000443473.1 | 4581 | 52701768 | 52706101 | + | seg_252 | 52705000 | 52706750 | SSX7 | MRX1 = IQSEC2 |
| ENST00000434905.1 | 4582 | 52810501 | 52814830 | − | seg_254 | 52809850 | 52811650 | SPANXN5 | MRX1 = IQSEC2 |
| ENST00000414788.1 | 4583 | 52920646 | 52929617 | + | seg_255 | 52919850 | 52921300 | FAM156B | MRX1 = IQSEC2 |
| ENST00000452154.2 | 4584 | 52920336 | 52937089 | + | seg_255 | 52919850 | 52921300 | FAM156B | MRX1 = IQSEC2 |
| ENST00000458697.1 | 4585 | 52925995 | 52929686 | + | seg_256 | 52925850 | 52927100 | FAM156B | MRX1 = IQSEC2 |
| ENST00000414788.1 | 4586 | 52920646 | 52929617 | + | seg_256 | 52925850 | 52927100 | FAM156B | MRX1 = IQSEC2 |
| ENST00000430150.2 | 4587 | 52926322 | 52937587 | + | seg_256 | 52925850 | 52927100 | FAM156B | MRX1 = IQSEC2 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000452154.2 | 4588 | 52920336 | 52937089 | + | seg_256 | 52925850 | 52927100 | FAM156B | MRX1 = IQSEC2 |
| ENST00000452021.2 | 4589 | 52926351 | 52937562 | + | seg_256 | 52925850 | 52927100 | FAM156B | MRX1 = IQSEC2 |
| ENST00000412319.1 | 4590 | 52926426 | 52937587 | + | seg_256 | 52925850 | 52927100 | FAM156B | MRX1 = IQSEC2 |
| ENST00000451084.2 | 4591 | 52977462 | 53024634 | − | seg_257 | 52989600 | 52990850 | FAM156A | MRX1 = IQSEC2 |
| ENST00000510893.1 | 4592 | 52985477 | 52993695 | − | seg_257 | 52989600 | 52990850 | FAM156A | MRX1 = IQSEC2 |
| ENST00000416923.1 | 4593 | 52977768 | 53024632 | − | seg_257 | 52989600 | 52990850 | FAM156A | MRX1 = IQSEC2 |
| ENST00000511863.1 | 4594 | 52984353 | 53024651 | − | seg_257 | 52989600 | 52990850 | FAM156A | MRX1 = IQSEC2 |
| ENST00000414076.2 | 4595 | 52976960 | 53024551 | − | seg_257 | 52989600 | 52990850 | FAM156A | MRX1 = IQSEC2 |
| ENST00000505988.1 | 4596 | 52977787 | 53024551 | − | seg_257 | 52989600 | 52990850 | FAM156A | MRX1 = IQSEC2 |
| ENST00000512364.1 | 4597 | 52976462 | 53024644 | − | seg_257 | 52989600 | 52990850 | FAM156A | MRX1 = IQSEC2 |
| ENST00000447562.1 | 4598 | 52977471 | 52993386 | − | seg_257 | 52989600 | 52990850 | FAM156A | MRX1 = IQSEC2 |
| ENST00000475552.1 | 4599 | 52977803 | 53024634 | − | seg_257 | 52989600 | 52990850 | FAM156A | MRX1 = IQSEC2 |
| ENST00000515858.1 | 4600 | 52994637 | 53024651 | − | seg_258 | 52994300 | 52995300 | FAM156A | MRX1 = IQSEC2 |
| ENST00000451084.2 | 4601 | 52977462 | 53024634 | − | seg_258 | 52994300 | 52995300 | FAM156A | MRX1 = IQSEC2 |
| ENST00000416923.1 | 4602 | 52977768 | 53024632 | − | seg_258 | 52994300 | 52995300 | FAM156A | MRX1 = IQSEC2 |
| ENST00000511863.1 | 4603 | 52984353 | 53024651 | − | seg_258 | 52994300 | 52995300 | FAM156A | MRX1 = IQSEC2 |
| ENST00000414076.2 | 4604 | 52976960 | 53024551 | − | seg_258 | 52994300 | 52995300 | FAM156A | MRX1 = IQSEC2 |
| ENST00000505988.1 | 4605 | 52977787 | 53024551 | − | seg_258 | 52994300 | 52995300 | FAM156A | MRX1 = IQSEC2 |
| ENST00000512364.1 | 4606 | 52976462 | 53024644 | − | seg_258 | 52994300 | 52995300 | FAM156A | MRX1 = IQSEC2 |
| ENST00000505062.1 | 4607 | 52994760 | 53024651 | − | seg_258 | 52994300 | 52995300 | FAM156A | MRX1 = IQSEC2 |
| ENST00000475552.1 | 4608 | 52977803 | 53024634 | − | seg_258 | 52994300 | 52995300 | FAM156A | MRX1 = IQSEC2 |
| ENST00000375365.2 | 4609 | 53263292 | 53310796 | − | seg_260 | 53284450 | 53286250 | IQSEC2 | MRX1 = IQSEC2 |
| ENST00000396435.3 | 4610 | 53262058 | 53350522 | − | seg_260 | 53284450 | 53286250 | IQSEC2 | MRX1 = IQSEC2 |
| ENST00000375368.5 | 4611 | 53262059 | 53350522 | − | seg_260 | 53284450 | 53286250 | IQSEC2 | MRX1 = IQSEC2 |
| ENST00000396435.3 | 4612 | 53262058 | 53350522 | − | seg_261 | 53329950 | 53331050 | IQSEC2 | MRX1 = IQSEC2 |
| ENST00000375368.5 | 4613 | 53262059 | 53350522 | − | seg_261 | 53329950 | 53331050 | IQSEC2 | MRX1 = IQSEC2 |
| ENST00000396435.3 | 4614 | 53262058 | 53350522 | − | seg_262 | 53348300 | 53351800 | IQSEC2 | MRX1 = IQSEC2 |
| ENST00000375368.5 | 4615 | 53262059 | 53350522 | − | seg_262 | 53348300 | 53351800 | IQSEC2 | MRX1 = IQSEC2 |
| ENST00000453905.1 | 4616 | 54044212 | 54075368 | − | seg_267 | 54070050 | 54071100 | PHF8 | PHF8 |
| ENST00000415025.1 | 4617 | 54044204 | 54070495 | − | seg_267 | 54070050 | 54071100 | PHF8 | PHF8 |
| ENST00000437224.1 | 4618 | 54044203 | 54075391 | − | seg_267 | 54070050 | 54071100 | PHF8 | PHF8 |
| ENST00000338154.6 | 4619 | 53963109 | 54070607 | − | seg_267 | 54070050 | 54071100 | PHF8 | PHF8 |
| ENST00000357988.5 | 4620 | 53963109 | 54071682 | − | seg_267 | 54070050 | 54071100 | PHF8 | PHF8 |
| ENST00000396277.3 | 4621 | 53963115 | 54070607 | − | seg_267 | 54070050 | 54071100 | PHF8 | PHF8 |
| ENST00000338946.6 | 4622 | 53963115 | 54070607 | − | seg_267 | 54070050 | 54071100 | PHF8 | PHF8 |
| ENST00000354646.2 | 4623 | 54219258 | 54384438 | − | seg_268 | 54221650 | 54222700 | FAM120C | PHF8 |
| ENST00000375169.3 | 4624 | 54219256 | 54384438 | − | seg_268 | 54221650 | 54222700 | FAM120C | PHF8 |
| ENST00000375159.2 | 4625 | 54224757 | 54360106 | − | seg_269 | 54315000 | 54316050 | WNK3 | FGD1 |
| ENST00000354646.2 | 4626 | 54219258 | 54384438 | − | seg_269 | 54315000 | 54316050 | WNK3 | FGD1 |
| ENST00000375169.3 | 4627 | 54219256 | 54384438 | − | seg_269 | 54315000 | 54316050 | WNK3 | FGD1 |
| ENST00000375135.3 | 4628 | 54471887 | 54522599 | − | seg_271 | 54521250 | 54522900 | FGD1 | FGD1 |
| ENST00000537277.1 | 4629 | 54475243 | 54522322 | − | seg_271 | 54521250 | 54522900 | FGD1 | FGD1 |
| ENST00000218436.6 | 4630 | 54775332 | 54824673 | − | seg_272 | 54776750 | 54777850 | ITIH6 | FGD1 |
| ENST00000471758.1 | 4631 | 55026826 | 55033190 | + | seg_273 | 55026400 | 55027550 | APEX2 | ALAS2 |
| ENST00000374987.3 | 4632 | 55026790 | 55035490 | + | seg_273 | 55026400 | 55027550 | APEX2 | ALAS2 |
| ENST00000452532.1 | 4633 | 55934556 | 56041606 | + | seg_276 | 56029500 | 56030800 | AL353698.1 | ALAS2 |
| ENST00000423617.1 | 4634 | 56755789 | 56844059 | + | seg_278 | 56787300 | 56788350 | UBQLN2 | ALAS2 |
| ENST00000451583.1 | 4635 | 56755806 | 56843809 | + | seg_278 | 56787300 | 56788350 | UBQLN2 | ALAS2 |
| ENST00000374922.4 | 4636 | 56755692 | 56844813 | + | seg_278 | 56787300 | 56788350 | UBQLN2 | ALAS2 |
| ENST00000437625.1 | 4637 | 56755677 | 56843883 | + | seg_278 | 56787300 | 56788350 | UBQLN2 | ALAS2 |
| ENST00000374870.4 | 4638 | 62854856 | 62975031 | − | seg_306 | 62967650 | 62969200 | ARHGEF9 | AR |
| ENST00000437457.2 | 4639 | 62854856 | 63005426 | − | seg_306 | 62967650 | 62969200 | ARHGEF9 | AR |
| ENST00000374878.1 | 4640 | 62854847 | 63005413 | − | seg_306 | 62967650 | 62969200 | ARHGEF9 | AR |
| ENST00000495564.1 | 4641 | 62857860 | 62974991 | − | seg_306 | 62967650 | 62969200 | ARHGEF9 | AR |
| ENST00000253401.6 | 4642 | 62854847 | 62974993 | − | seg_306 | 62967650 | 62969200 | ARHGEF9 | AR |
| ENST00000374872.1 | 4643 | 62857862 | 62974988 | − | seg_306 | 62967650 | 62969200 | ARHGEF9 | AR |
| ENST00000374869.3 | 4644 | 63404997 | 63425624 | − | seg_308 | 63412200 | 63413300 | AMER1 | AR |
| ENST00000403336.1 | 4645 | 63405997 | 63413166 | − | seg_308 | 63412200 | 63413300 | AMER1 | AR |
| ENST00000330258.3 | 4646 | 63404997 | 63425624 | − | seg_308 | 63412200 | 63413300 | AMER1 | AR |
| ENST00000488406.1 | 4647 | 64137280 | 64140007 | − | seg_309 | 64138750 | 64139800 | ZC4H2 | AR |
| ENST00000447788.2 | 4648 | 64136250 | 64196413 | − | seg_309 | 64138750 | 64139800 | ZC4H2 | AR |
| ENST00000374839.3 | 4649 | 64136261 | 64196364 | − | seg_309 | 64138750 | 64139800 | ZC4H2 | AR |
| ENST00000476032.1 | 4650 | 64137738 | 64196243 | − | seg_309 | 64138750 | 64139800 | ZC4H2 | AR |
| ENST00000488608.1 | 4651 | 64136368 | 64196413 | − | seg_309 | 64138750 | 64139800 | ZC4H2 | AR |
| ENST00000545618.1 | 4652 | 64136250 | 64196328 | − | seg_309 | 64138750 | 64139800 | ZC4H2 | AR |
| ENST0000492653.1 | 4653 | 64137660 | 64196353 | − | seg_309 | 64138750 | 64139800 | ZC4H2 | AR |
| ENST00000337990.2 | 4654 | 64136262 | 64254593 | − | seg_309 | 64138750 | 64139800 | ZC4H2 | AR |
| ENST00000488831.1 | 4655 | 64137720 | 64254549 | − | seg_309 | 64138750 | 64139800 | ZC4H2 | AR |
| ENST00000440433.1 | 4656 | 64770778 | 64772301 | − | seg_310 | 64770000 | 64772700 | LAS1L | AR |
| ENST00000538891.1 | 4657 | 66764989 | 66766608 | + | seg_312 | 66763900 | 66766950 | AR | AR |
| ENST00000396044.3 | 4658 | 66764986 | 66943778 | + | seg_312 | 66763900 | 66766950 | AR | AR |
| ENST00000513847.1 | 4659 | 66764662 | 66909605 | + | seg_312 | 66763900 | 66766950 | AR | AR |
| ENST00000544984.1 | 4660 | 66763874 | 66944119 | + | seg_312 | 66763900 | 66766950 | AR | AR |
| ENST00000514029.1 | 4661 | 66764662 | 66915917 | + | seg_312 | 66763900 | 66766950 | AR | AR |
| ENST00000374690.3 | 4662 | 66764465 | 66950461 | + | seg_312 | 66763900 | 66766950 | AR | AR |
| ENST00000504326.1 | 4663 | 66764662 | 66915917 | + | seg_312 | 66763900 | 66766950 | AR | AR |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000488088.1 | 4664 | 67867508 | 67876393 | + | seg_313 | 67871900 | 67872900 | STARD8 | ED1 = EDA |
| ENST00000374599.3 | 4665 | 67867610 | 67945678 | + | seg_313 | 67871900 | 67872900 | STARD8 | ED1 = EDA |
| ENST00000523864.1 | 4666 | 67867511 | 67945684 | + | seg_313 | 67871900 | 67872900 | STARD8 | ED1 = EDA |
| ENST00000252336.6 | 4667 | 67867511 | 67945682 | + | seg_313 | 67871900 | 67872900 | STARD8 | ED1 = EDA |
| ENST00000204961.4 | 4668 | 68048840 | 68061990 | + | seg_314 | 68048550 | 68051950 | EFNB1 | ED1 = EDA |
| ENST00000399711.1 | 4669 | 68399400 | 68429767 | + | seg_318 | 68406000 | 68407300 | PJA1 | ED1 = EDA |
| ENST00000399711.1 | 4670 | 68399400 | 68429767 | + | seg_319 | 68423100 | 68425000 | PJA1 | ED1 = EDA |
| ENST00000338901.3 | 4671 | 68835911 | 68890104 | + | seg_322 | 68836650 | 68837650 | EDA | ED1 = EDA |
| ENST00000374548.1 | 4672 | 68835911 | 69177354 | + | seg_322 | 68836650 | 68837650 | EDA | ED1 = EDA |
| ENST00000525810.1 | 4673 | 68835911 | 69080892 | + | seg_322 | 68836650 | 68837650 | EDA | ED1 = EDA |
| ENST00000513754.2 | 4674 | 68835911 | 69177327 | + | seg_322 | 68836650 | 68837650 | EDA | ED1 = EDA |
| ENST00000533317.1 | 4675 | 68835911 | 69177327 | + | seg_322 | 68836650 | 68837650 | EDA | ED1 = EDA |
| ENST00000527388.1 | 4676 | 68835911 | 69080892 | + | seg_322 | 68836650 | 68837650 | EDA | ED1 = EDA |
| ENST00000502251.1 | 4677 | 68835911 | 69177354 | + | seg_322 | 68836650 | 68837650 | EDA | ED1 = EDA |
| ENST00000374552.4 | 4678 | 68835911 | 69259319 | + | seg_322 | 68836650 | 68837650 | EDA | ED1 = EDA |
| ENST00000374553.2 | 4679 | 68835911 | 69259319 | + | seg_322 | 68836650 | 68837650 | EDA | ED1 = EDA |
| ENST00000524573.1 | 4680 | 68835961 | 69255487 | + | seg_322 | 68836650 | 68837650 | EDA | ED1 = EDA |
| ENST00000342206.6 | 4681 | 69353299 | 69386174 | + | seg_323 | 69354600 | 69355600 | IGBP1 | ED1 = EDA |
| ENST00000356413.4 | 4682 | 69353313 | 69386174 | + | seg_323 | 69354600 | 69355600 | IGBP1 | ED1 = EDA |
| ENST00000194900.4 | 4683 | 69664711 | 69725337 | + | seg_325 | 69663950 | 69665850 | DLG3 | GJB1 |
| ENST00000463252.1 | 4684 | 69664986 | 69723796 | + | seg_325 | 69663950 | 69665850 | DLG3 | GJB1 |
| ENST00000374360.3 | 4685 | 69664819 | 69725337 | + | seg_325 | 69663950 | 69665850 | DLG3 | GJB1 |
| ENST00000344304.3 | 4686 | 69748791 | 70117396 | − | seg_326 | 70013100 | 70014100 | TEX11 | GJB1 |
| ENST00000395889.2 | 4687 | 69748791 | 70128561 | − | seg_326 | 70013100 | 70014100 | TEX11 | GJB1 |
| ENST00000374333.2 | 4688 | 69748790 | 70128581 | − | seg_326 | 70013100 | 70014100 | TEX11 | GJB1 |
| ENST00000374051.3 | 4689 | 70364693 | 70391051 | + | seg_327 | 70368600 | 70369750 | NLGN3 | GJB1 |
| ENST00000395855.2 | 4690 | 70364693 | 70387607 | + | seg_327 | 70368600 | 70369750 | NLGN3 | GJB1 |
| ENST00000536169.1 | 4691 | 70364681 | 70391049 | + | seg_327 | 70368600 | 70369750 | NLGN3 | GJB1 |
| ENST00000358741.3 | 4692 | 70364712 | 70390143 | + | seg_327 | 70368600 | 70369750 | NLGN3 | GJB1 |
| ENST00000542063.1 | 4693 | 70364686 | 70390964 | + | seg_327 | 70368600 | 70369750 | NLGN3 | GJB1 |
| ENST00000447581.1 | 4694 | 70435109 | 70443810 | + | seg_328 | 70435950 | 70436950 | GJB1 | GJB1 |
| ENST00000374029.1 | 4695 | 70435044 | 70445050 | + | seg_328 | 70435950 | 70436950 | GJB1 | GJB1 |
| ENST00000374022.3 | 4696 | 70435062 | 70445366 | + | seg_328 | 70435950 | 70436950 | GJB1 | GJB1 |
| ENST00000447581.1 | 4697 | 70435109 | 70443810 | + | seg_329 | 70443150 | 70444550 | GJB1 | GJB1 |
| ENST00000374029.1 | 4698 | 70435044 | 70445050 | + | seg_329 | 70443150 | 70444550 | GJB1 | GJB1 |
| ENST00000361726.6 | 4699 | 70443056 | 70445048 | + | seg_329 | 70443150 | 70444550 | GJB1 | GJB1 |
| ENST00000374022.3 | 4700 | 70435062 | 70445366 | + | seg_329 | 70443150 | 70444550 | GJB1 | GJB1 |
| ENST00000422194.1 | 4701 | 70882845 | 70885603 | − | seg_331 | 70877750 | 70883200 | CXCR3 | GJB1 |
| ENST00000433410.1 | 4702 | 70882848 | 70884121 | − | seg_331 | 70877750 | 70883200 | CXCR3 | GJB1 |
| ENST00000508574.1 | 4703 | 70917046 | 70926305 | + | seg_332 | 70920450 | 70921550 | CXCR3 | GJB1 |
| ENST00000417668.1 | 4704 | 70938992 | 70939460 | + | seg_333 | 70931300 | 70944400 | CXCR3 | GJB1 |
| ENST00000457716.1 | 4705 | 70939766 | 70940650 | + | seg_333 | 70931300 | 70944400 | CXCR3 | GJB1 |
| ENST00000535490.1 | 4706 | 70934224 | 70938135 | − | seg_333 | 70931300 | 70944400 | CXCR3 | GJB1 |
| ENST00000452468.1 | 4707 | 70934221 | 70936237 | − | seg_333 | 70931300 | 70944400 | CXCR3 | GJB1 |
| ENST00000456199.1 | 4708 | 70981815 | 70982283 | − | seg_336 | 70973450 | 70990950 | CXCR3 | GJB1 |
| ENST00000439926.1 | 4709 | 70980625 | 70981509 | − | seg_336 | 70973450 | 70990950 | CXCR3 | GJB1 |
| ENST00000440412.1 | 4710 | 70985038 | 70987054 | + | seg_336 | 70973450 | 70990950 | CXCR3 | GJB1 |
| ENST00000542739.1 | 4711 | 70983140 | 70987051 | + | seg_336 | 70973450 | 70990950 | CXCR3 | GJB1 |
| ENST00000408757.1 | 4712 | 70979235 | 70979305 | − | seg_336 | 70973450 | 70990950 | CXCR3 | GJB1 |
| ENST00000540800.1 | 4713 | 71130938 | 71363424 | + | seg_339 | 71130200 | 71132050 | NHSL2 | GJB1 |
| ENST00000540800.1 | 4714 | 71130938 | 71363424 | + | seg_340 | 71237900 | 71239300 | NHSL2 | GJB1 |
| ENST00000540800.1 | 4715 | 71130938 | 71363424 | + | seg_341 | 71241400 | 71242500 | RGAG4 | GJB1 |
| ENST00000540800.1 | 4716 | 71130938 | 71363424 | + | seg_342 | 71279100 | 71280300 | RGAG4 | GJB1 |
| ENST00000479991.1 | 4717 | 71346960 | 71351751 | − | seg_343 | 71350200 | 71352700 | RGAG4 | GJB1 |
| ENST00000545866.1 | 4718 | 71346958 | 71351758 | − | seg_343 | 71350200 | 71352700 | RGAG4 | GJB1 |
| ENST00000513469.1 | 4719 | 71352000 | 71354556 | + | seg_343 | 71350200 | 71352700 | RGAG4 | GJB1 |
| ENST00000540800.1 | 4720 | 71130938 | 71363424 | + | seg_343 | 71350200 | 71352700 | RGAG4 | GJB1 |
| ENST00000456343.2 | 4721 | 71364034 | 71381600 | + | seg_344 | 71364150 | 71365850 | NHSL2 | GJB1 |
| ENST00000246139.5 | 4722 | 71521500 | 71526837 | − | seg_345 | 71525750 | 71529400 | CITED1 | GJB1 |
| ENST00000445983.1 | 4723 | 71521490 | 71525764 | − | seg_345 | 71525750 | 71529400 | CITED1 | GJB1 |
| ENST00000431381.1 | 4724 | 71521490 | 71525764 | − | seg_345 | 71525750 | 71529400 | CITED1 | GJB1 |
| ENST00000453707.2 | 4725 | 71521488 | 71527000 | − | seg_345 | 71525750 | 71529400 | CITED1 | GJB1 |
| ENST00000454225.1 | 4726 | 71522056 | 71526757 | − | seg_345 | 71525750 | 71529400 | CITED1 | GJB1 |
| ENST00000373619.3 | 4727 | 71521497 | 71527037 | − | seg_345 | 71525750 | 71529400 | CITED1 | GJB1 |
| ENST00000339490.3 | 4728 | 71798665 | 71934029 | − | seg_346 | 71800550 | 71801550 | HDAC8 | GJB1 |
| ENST00000373542.4 | 4729 | 71798664 | 71933888 | − | seg_346 | 71800550 | 71801550 | HDAC8 | GJB1 |
| ENST00000541944.1 | 4730 | 71798665 | 71934029 | − | seg_346 | 71800550 | 71801550 | HDAC8 | GJB1 |
| ENST00000373545.3 | 4731 | 71798664 | 71934167 | − | seg_346 | 71800550 | 71801550 | HDAC8 | GJB1 |
| ENST00000373539.3 | 4732 | 71800477 | 71934106 | − | seg_346 | 71800550 | 71801550 | HDAC8 | GJB1 |
| ENST00000472595.1 | 4733 | 71996833 | 72068636 | + | seg_348 | 72011750 | 72013700 | DMRTC1B | GJB1 |
| ENST00000334036.5 | 4734 | 71996972 | 72068632 | + | seg_348 | 72011750 | 72013700 | DMRTC1B | GJB1 |
| ENST00000483816.1 | 4735 | 72091859 | 72163653 | + | seg_349 | 72136450 | 72138350 | LINC00684 | GJB1 |
| ENST00000483816.1 | 4736 | 72091859 | 72163653 | − | seg_350 | 72146600 | 72148500 | LINC00684 | GJB1 |
| ENST00000373527.1 | 4737 | 72158003 | 72158798 | + | seg_351 | 72157050 | 72158200 | LINC00684 | GJB1 |
| ENST00000373524.1 | 4738 | 72158069 | 72158780 | + | seg_351 | 72157050 | 72158200 | LINC00684 | GJB1 |
| ENST00000483816.1 | 4739 | 72091859 | 72163653 | − | seg_351 | 72157050 | 72158200 | LINC00684 | GJB1 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000373514.1 | 4740 | 72667088 | 72675081 | + | seg_352 | 72666800 | 72668350 | CDX4 | ABCB7 |
| ENST00000430772.1 | 4741 | 73467699 | 73513362 | − | seg_355 | 73498350 | 73499350 | ZCCHC13 | ABCB7 |
| ENST00000429124.1 | 4742 | 73498209 | 73512435 | − | seg_355 | 73498350 | 73499350 | ZCCHC13 | ABCB7 |
| ENST00000276033.4 | 4743 | 73640638 | 73753752 | + | seg_356 | 73642400 | 73643800 | SLC16A2 | ABCB7 |
| ENST00000055682.5 | 4744 | 73952692 | 74145287 | + | seg_357 | 74055400 | 74056550 | KIAA2022 | ABCB7 |
| ENST00000373468.1 | 4745 | 73952684 | 74145320 | − | seg_357 | 74055400 | 74056550 | KIAA2022 | ABCB7 |
| ENST00000350425.4 | 4746 | 77166194 | 77305892 | + | seg_358 | 77165200 | 77166850 | COX7B | ATP7A |
| ENST00000341514.6 | 4747 | 77166199 | 77305892 | + | seg_358 | 77165200 | 77166850 | COX7B | ATP7A |
| ENST00000343533.5 | 4748 | 77166194 | 77305892 | + | seg_358 | 77165200 | 77166850 | COX7B | ATP7A |
| ENST00000400860.5 | 4749 | 77166224 | 77302211 | + | seg_358 | 77165200 | 77166850 | COX7B | ATP7A |
| ENST00000343912.6 | 4750 | 77166194 | 77301057 | + | seg_358 | 77165200 | 77166850 | COX7B | ATP7A |
| ENST00000458128.1 | 4751 | 77223458 | 77225135 | − | seg_359 | 77223450 | 77224850 | PGAM4 | ATP7A |
| ENST00000355691.5 | 4752 | 77220936 | 77268087 | + | seg_359 | 77223450 | 77224850 | PGAM4 | ATP7A |
| ENST00000350425.4 | 4753 | 77166194 | 77305892 | + | seg_359 | 77223450 | 77224850 | PGAM4 | ATP7A |
| ENST00000341514.6 | 4754 | 77166199 | 77305892 | + | seg_359 | 77223450 | 77224850 | PGAM4 | ATP7A |
| ENST00000343533.5 | 4755 | 77166194 | 77305892 | + | seg_359 | 77223450 | 77224850 | PGAM4 | ATP7A |
| ENST00000400860.5 | 4756 | 77166224 | 77302211 | + | seg_359 | 77223450 | 77224850 | PGAM4 | ATP7A |
| ENST00000343912.6 | 4757 | 77166194 | 77301057 | + | seg_359 | 77223450 | 77224850 | PGAM4 | ATP7A |
| ENST00000350425.4 | 4758 | 77166194 | 77305892 | + | seg_360 | 77296400 | 77297850 | PGK1 | PGK1 |
| ENST00000341514.6 | 4759 | 77166199 | 77305892 | + | seg_360 | 77296400 | 77297850 | PGK1 | PGK1 |
| ENST00000343533.5 | 4760 | 77166194 | 77305892 | + | seg_360 | 77296400 | 77297850 | PGK1 | PGK1 |
| ENST00000400860.5 | 4761 | 77166224 | 77302211 | + | seg_360 | 77296400 | 77297850 | PGK1 | PGK1 |
| ENST00000343912.6 | 4762 | 77166194 | 77301057 | + | seg_360 | 77296400 | 77297850 | PGK1 | PGK1 |
| ENST00000476373.1 | 4763 | 79270268 | 79278153 | + | seg_363 | 79277400 | 79278700 | TBX22 | PGK1 |
| ENST00000373296.3 | 4764 | 79270255 | 79286872 | + | seg_363 | 79277400 | 79278700 | TBX22 | PGK1 |
| ENST00000373291.1 | 4765 | 79278568 | 79287268 | + | seg_363 | 79277400 | 79278700 | TBX22 | PGK1 |
| ENST00000373294.5 | 4766 | 79277741 | 79287268 | + | seg_363 | 79277400 | 79278700 | TBX22 | PGK1 |
| ENST00000442340.1 | 4767 | 79270255 | 79287268 | + | seg_363 | 79277400 | 79278700 | TBX22 | PGK1 |
| ENST00000544771.1 | 4768 | 83116170 | 83254350 | + | seg_367 | 83187500 | 83188750 | CYLC1 | CHM |
| ENST00000437961.1 | 4769 | 85106580 | 85106687 | − | seg_368 | 85105500 | 85106600 | CHM | CHM |
| ENST00000395337.2 | 4770 | 91034260 | 91139006 | + | seg_373 | 91035500 | 91036850 | PCDH11X | CHM |
| ENST00000373034.4 | 4771 | 99546642 | 99665271 | − | seg_375 | 99556100 | 99557150 | PCDH19 | BTK |
| ENST00000255531.7 | 4772 | 99546644 | 99665271 | − | seg_375 | 99556100 | 99557150 | PCDH19 | BTK |
| ENST00000420881.2 | 4773 | 99546642 | 99663595 | − | seg_375 | 99556100 | 99557150 | PCDH19 | BTK |
| ENST00000373020.4 | 4774 | 99883667 | 99891803 | − | seg_377 | 99891050 | 99892300 | TSPAN6 | BTK |
| ENST00000431386.2 | 4775 | 99884765 | 99891848 | − | seg_377 | 99891050 | 99892300 | TSPAN6 | BTK |
| ENST00000496771.1 | 4776 | 99887538 | 99891686 | − | seg_377 | 99891050 | 99892300 | TSPAN6 | BTK |
| ENST00000494424.1 | 4777 | 99888439 | 99894988 | − | seg_377 | 99891050 | 99892300 | TSPAN6 | BTK |
| ENST00000455616.1 | 4778 | 99929491 | 99986522 | − | seg_378 | 99934950 | 99936050 | SYTL4 | BTK |
| ENST00000372989.1 | 4779 | 99929488 | 99986498 | − | seg_378 | 99934950 | 99936050 | SYTL4 | BTK |
| ENST00000276141.6 | 4780 | 99929491 | 99986522 | − | seg_378 | 99934950 | 99936050 | SYTL4 | BTK |
| ENST00000454200.2 | 4781 | 99929491 | 99986522 | − | seg_378 | 99934950 | 99936050 | SYTL4 | BTK |
| ENST00000263033.5 | 4782 | 99930894 | 99987108 | − | seg_378 | 99934950 | 99936050 | SYTL4 | BTK |
| ENST00000444892.2 | 4783 | 100333871 | 100350296 | + | seg_380 | 100334000 | 100335900 | TMEM35 | BTK |
| ENST00000372930.4 | 4784 | 100333709 | 100351353 | + | seg_380 | 100334000 | 100335900 | TMEM35 | BTK |
| ENST00000538510.1 | 4785 | 100486534 | 100519485 | + | seg_381 | 100509100 | 100510450 | DRP2 | BTK |
| ENST00000541709.1 | 4786 | 100474933 | 100519485 | + | seg_381 | 100509100 | 100510450 | DRP2 | BTK |
| ENST00000402866.1 | 4787 | 100474758 | 100519486 | + | seg_381 | 100509100 | 100510450 | DRP2 | BTK |
| ENST00000395209.3 | 4788 | 100474775 | 100519486 | + | seg_381 | 100509100 | 100510450 | DRP2 | BTK |
| ENST00000453574.1 | 4789 | 100673287 | 100674171 | + | seg_382 | 100672350 | 100673500 | HNRNPH2 | GLA |
| ENST00000430461.1 | 4790 | 100673286 | 100701120 | + | seg_382 | 100672350 | 100673500 | HNRNPH2 | GLA |
| ENST00000433011.1 | 4791 | 100673275 | 100788446 | + | seg_382 | 100672350 | 100673500 | HNRNPH2 | GLA |
| ENST00000452188.1 | 4792 | 100740420 | 100788446 | + | seg_383 | 100744750 | 100745800 | ARMCX4 | GLA |
| ENST00000455331.1 | 4793 | 100740440 | 100754031 | + | seg_383 | 100744750 | 100745800 | ARMCX4 | GLA |
| ENST00000442270.1 | 4794 | 100740443 | 100788446 | + | seg_383 | 100744750 | 100745800 | ARMCX4 | GLA |
| ENST00000354842.4 | 4795 | 100740462 | 100788446 | + | seg_383 | 100744750 | 100745800 | ARMCX4 | GLA |
| ENST00000433011.1 | 4796 | 100673275 | 100788446 | + | seg_383 | 100744750 | 100745800 | ARMCX4 | GLA |
| ENST00000423738.2 | 4797 | 100740440 | 100750794 | + | seg_383 | 100744750 | 100745800 | ARMCX4 | GLA |
| ENST00000445416.1 | 4798 | 100740241 | 100771941 | + | seg_383 | 100744750 | 100745800 | ARMCX4 | GLA |
| ENST00000392722.2 | 4799 | 100792472 | 100794237 | − | seg_384 | 100793500 | 100794650 | ARMCX1 | GLA |
| ENST00000372828.2 | 4800 | 100852488 | 100853049 | + | seg_385 | 100852500 | 100853550 | ARMCX6 | GLA |
| ENST00000448512.1 | 4801 | 101470280 | 101567445 | + | seg_387 | 101564000 | 101565000 | NXF2 | GLA |
| ENST00000372758.1 | 4802 | 101478939 | 101581631 | + | seg_387 | 101564000 | 101565000 | NXF2 | GLA |
| ENST00000372763.1 | 4803 | 101478829 | 101581634 | + | seg_387 | 101564000 | 101565000 | NXF2 | GLA |
| ENST00000330252.5 | 4804 | 101470280 | 101581631 | + | seg_387 | 101564000 | 101565000 | NXF2 | GLA |
| ENST00000372757.1 | 4805 | 101502170 | 101581631 | + | seg_387 | 101564000 | 101565000 | NXF2 | GLA |
| ENST00000395088.2 | 4806 | 101470280 | 101581634 | + | seg_387 | 101564000 | 101565000 | NXF2 | GLA |
| ENST00000289373.4 | 4807 | 101768604 | 101771712 | − | seg_389 | 101770350 | 101771700 | TMSB15A | GLA |
| ENST00000372680.1 | 4808 | 102528619 | 102531800 | − | seg_390 | 102529150 | 102533650 | TCEAL5 | GLA |
| ENST00000449185.1 | 4809 | 102564600 | 102565863 | − | seg_391 | 102564750 | 102566250 | BEX2 | GLA |
| ENST00000372674.1 | 4810 | 102564430 | 102565935 | − | seg_391 | 102564750 | 102566250 | BEX2 | GLA |
| ENST00000372677.3 | 4811 | 102564274 | 102565974 | − | seg_391 | 102564750 | 102566250 | BEX2 | GLA |
| ENST00000536889.1 | 4812 | 102564282 | 102565883 | − | seg_391 | 102564750 | 102566250 | BEX2 | GLA |
| ENST00000332431.4 | 4813 | 102585124 | 102587254 | + | seg_392 | 102585450 | 102586700 | TCEAL7 | GLA |
| ENST00000372666.1 | 4814 | 102585157 | 102587016 | + | seg_392 | 102585450 | 102586700 | TCEAL7 | GLA |
| ENST00000425011.1 | 4815 | 102840543 | 102841777 | + | seg_393 | 102840700 | 102841750 | TCEAL4 | GLA |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000481555.1 | 4816 | 102840433 | 102841427 | + | seg_393 | 102840700 | 102841750 | TCEAL4 | GLA |
| ENST00000490644.1 | 4817 | 102840451 | 102841833 | + | seg_393 | 102840700 | 102841750 | TCEAL4 | GLA |
| ENST00000469586.1 | 4818 | 102841064 | 102841991 | + | seg_393 | 102840700 | 102841750 | TCEAL4 | GLA |
| ENST00000434216.2 | 4819 | 102840506 | 102841753 | + | seg_393 | 102840700 | 102841750 | TCEAL4 | GLA |
| ENST00000459722.1 | 4820 | 102840456 | 102841877 | + | seg_393 | 102840700 | 102841750 | TCEAL4 | GLA |
| ENST00000472484.1 | 4821 | 102840441 | 102842657 | + | seg_393 | 102840700 | 102841750 | TCEAL4 | GLA |
| ENST00000468024.1 | 4822 | 102840420 | 102842446 | + | seg_393 | 102840700 | 102841750 | TCEAL4 | GLA |
| ENST00000472745.1 | 4823 | 102840461 | 102842622 | + | seg_393 | 102840700 | 102841750 | TCEAL4 | GLA |
| ENST00000494801.1 | 4824 | 102840491 | 102842454 | + | seg_393 | 102840700 | 102841750 | TCEAL4 | GLA |
| ENST00000415568.2 | 4825 | 102840443 | 102842430 | + | seg_393 | 102840700 | 102841750 | TCEAL4 | GLA |
| ENST00000372629.4 | 4826 | 102831159 | 102842446 | + | seg_393 | 102840700 | 102841750 | TCEAL4 | GLA |
| ENST00000414064.2 | 4827 | 102840445 | 102842653 | + | seg_393 | 102840700 | 102841750 | TCEAL4 | GLA |
| ENST00000480725.1 | 4828 | 102973502 | 102983552 | − | seg_395 | 102982800 | 102984450 | GLRA4 | TBG = SERPINA7 |
| ENST00000372617.4 | 4829 | 102962152 | 102983552 | − | seg_395 | 102982800 | 102984450 | GLRA4 | TBG = SERPINA7 |
| ENST00000436213.1 | 4830 | 102962228 | 102983583 | − | seg_395 | 102982800 | 102984450 | GLRA4 | TBG = SERPINA7 |
| ENST00000243298.2 | 4831 | 103077252 | 103087158 | − | seg_396 | 103086000 | 103088000 | RAB9B | TBG = SERPINA7 |
| ENST00000447281.1 | 4832 | 103172005 | 103174131 | − | seg_397 | 103172500 | 103174100 | TMSB15B | TBG = SERPINA7 |
| ENST00000455723.1 | 4833 | 103173770 | 103187485 | + | seg_397 | 103172500 | 103174100 | TMSB15B | TBG = SERPINA7 |
| ENST00000419165.1 | 4834 | 103173479 | 103220554 | + | seg_397 | 103172500 | 103174100 | TMSB15B | TBG = SERPINA7 |
| ENST00000540220.1 | 4835 | 103217224 | 103220868 | + | seg_398 | 103216950 | 103218150 | TMSB15B | TBG = SERPINA7 |
| ENST00000436583.1 | 4836 | 103217242 | 103220554 | + | seg_398 | 103216950 | 103218150 | TMSB15B | TBG = SERPINA7 |
| ENST00000419165.1 | 4837 | 103173479 | 103220554 | + | seg_398 | 103216950 | 103218150 | TMSB15B | TBG = SERPINA7 |
| ENST00000423478.1 | 4838 | 103356822 | 103357563 | + | seg_402 | 103355950 | 103358450 | SLC25A53 | TBG = SERPINA7 |
| ENST00000422784.1 | 4839 | 103357235 | 103360533 | + | seg_402 | 103355950 | 103358450 | SLC25A53 | TBG = SERPINA7 |
| ENST00000537356.1 | 4840 | 103357107 | 103360531 | + | seg_402 | 103355950 | 103358450 | SLC25A53 | TBG = SERPINA7 |
| ENST00000357421.4 | 4841 | 103343898 | 103401708 | − | seg_402 | 103355950 | 103358450 | SLC25A53 | TBG = SERPINA7 |
| ENST00000243300.9 | 4842 | 105066536 | 105202602 | + | seg_405 | 105065050 | 105067850 | NRK | TBG = SERPINA7 |
| ENST00000536164.1 | 4843 | 105066574 | 105139308 | + | seg_405 | 105065050 | 105067850 | NRK | TBG = SERPINA7 |
| ENST00000428173.2 | 4844 | 105066536 | 105202601 | + | seg_405 | 105065050 | 105067850 | NRK | TBG = SERPINA7 |
| ENST00000418562.1 | 4845 | 105937024 | 106033435 | + | seg_406 | 105960300 | 105961850 | RNF128 | TBG = SERPINA7 |
| ENST00000324342.3 | 4846 | 105937068 | 106040223 | + | seg_406 | 105960300 | 105961850 | RNF128 | TBG = SERPINA7 |
| ENST00000357242.5 | 4847 | 106045910 | 106119375 | + | seg_407 | 106047050 | 106048050 | TBC1D8B | TBG = SERPINA7 |
| ENST00000481617.2 | 4848 | 106045935 | 106073313 | + | seg_407 | 106047050 | 106048050 | TBC1D8B | TBG = SERPINA7 |
| ENST00000276175.3 | 4849 | 106046043 | 106117347 | + | seg_407 | 106047050 | 106048050 | TBC1D8B | TBG = SERPINA7 |
| ENST00000310452.2 | 4850 | 106045919 | 106093061 | + | seg_407 | 106047050 | 106048050 | TBC1D8B | TBG = SERPINA7 |
| ENST00000540876.1 | 4851 | 106161590 | 106174089 | + | seg_408 | 106172400 | 106173500 | CLDN2 | PRPS1 |
| ENST00000541806.1 | 4852 | 106143394 | 106174089 | + | seg_408 | 106172400 | 106173500 | CLDN2 | PRPS1 |
| ENST00000358740.3 | 4853 | 106057103 | 106236570 | − | seg_408 | 106172400 | 106173500 | CLDN2 | PRPS1 |
| ENST00000336803.1 | 4854 | 106163634 | 106174091 | + | seg_408 | 106172400 | 106173500 | CLDN2 | PRPS1 |
| ENST00000415252.1 | 4855 | 106756213 | 106789051 | − | seg_411 | 106766900 | 106768200 | FRMPD3 | PRPS1 |
| ENST00000276185.4 | 4856 | 106765680 | 106846603 | + | seg_411 | 106766900 | 106768200 | FRMPD3 | PRPS1 |
| ENST00000477796.1 | 4857 | 106787813 | 106798427 | + | seg_412 | 106794250 | 106794250 | FRMPD3 | PRPS1 |
| ENST00000276185.4 | 4858 | 106765680 | 106846603 | + | seg_412 | 106793100 | 106794250 | FRMPD3 | PRPS1 |
| ENST00000439554.1 | 4859 | 106769876 | 106848481 | + | seg_412 | 106793100 | 106794250 | FRMPD3 | PRPS1 |
| ENST00000276185.4 | 4860 | 106765680 | 106846603 | + | seg_413 | 106843800 | 106846550 | PRPS1 | PRPS1 |
| ENST00000439554.1 | 4861 | 106769876 | 106848481 | + | seg_413 | 106843800 | 106846550 | PRPS1 | PRPS1 |
| ENST00000372384.2 | 4862 | 106956454 | 107019218 | − | seg_414 | 106991800 | 106993500 | TSC22D3 | PRPS1 |
| ENST00000372383.4 | 4863 | 106956454 | 107019017 | − | seg_414 | 106991800 | 106993500 | TSC22D3 | PRPS1 |
| ENST00000394928.2 | 4864 | 106957214 | 107018890 | − | seg_414 | 106991800 | 106993500 | TSC22D3 | PRPS1 |
| ENST00000315660.4 | 4865 | 106956451 | 107019215 | − | seg_414 | 106991800 | 106993500 | TSC22D3 | PRPS1 |
| ENST00000506081.1 | 4866 | 106957600 | 107020297 | − | seg_414 | 106991800 | 106993500 | TSC22D3 | PRPS1 |
| ENST00000514426.1 | 4867 | 106957717 | 107020308 | − | seg_414 | 106991800 | 106993500 | TSC22D3 | PRPS1 |
| ENST00000510887.1 | 4868 | 106959142 | 107019944 | − | seg_414 | 106991800 | 106993500 | TSC22D3 | PRPS1 |
| ENST00000502650.1 | 4869 | 106959153 | 107019345 | − | seg_414 | 106991800 | 106993500 | TSC22D3 | PRPS1 |
| ENST00000514897.1 | 4870 | 106959128 | 107020572 | − | seg_414 | 106991800 | 106993500 | TSC22D3 | PRPS1 |
| ENST00000480691.2 | 4871 | 106959133 | 107020285 | − | seg_414 | 106991800 | 106993500 | TSC22D3 | PRPS1 |
| ENST00000506724.1 | 4872 | 107018348 | 107019488 | − | seg_415 | 107018250 | 107019350 | TSC22D3 | PRPS1 |
| ENST00000372384.2 | 4873 | 106956454 | 107019218 | − | seg_415 | 107018250 | 107019350 | TSC22D3 | PRPS1 |
| ENST00000505965.1 | 4874 | 107018397 | 107020567 | − | seg_415 | 107018250 | 107019350 | TSC22D3 | PRPS1 |
| ENST00000372383.4 | 4875 | 106956454 | 107019017 | − | seg_415 | 107018250 | 107019350 | TSC22D3 | PRPS1 |
| ENST00000394928.2 | 4876 | 106957214 | 107018890 | − | seg_415 | 107018250 | 107019350 | TSC22D3 | PRPS1 |
| ENST00000315660.4 | 4877 | 106956451 | 107019215 | − | seg_415 | 107018250 | 107019350 | TSC22D3 | PRPS1 |
| ENST00000506081.1 | 4878 | 106957600 | 107020297 | − | seg_415 | 107018250 | 107019350 | TSC22D3 | PRPS1 |
| ENST00000514426.1 | 4879 | 106957717 | 107020308 | − | seg_415 | 107018250 | 107019350 | TSC22D3 | PRPS1 |
| ENST00000502961.1 | 4880 | 107018476 | 107020559 | − | seg_415 | 107018250 | 107019350 | TSC22D3 | PRPS1 |
| ENST00000510887.1 | 4881 | 106959142 | 107019944 | − | seg_415 | 107018250 | 107019350 | TSC22D3 | PRPS1 |
| ENST00000502650.1 | 4882 | 106959153 | 107019345 | − | seg_415 | 107018250 | 107019350 | TSC22D3 | PRPS1 |
| ENST00000514897.1 | 4883 | 106959128 | 107020572 | − | seg_415 | 107018250 | 107019350 | TSC22D3 | PRPS1 |
| ENST00000480691.2 | 4884 | 106959133 | 107020285 | − | seg_415 | 107018250 | 107019350 | TSC22D3 | PRPS1 |
| ENST00000451923.1 | 4885 | 107068985 | 107084611 | + | seg_416 | 107067850 | 107070850 | MID2 | PRPS1 |
| ENST00000443968.2 | 4886 | 107069644 | 107170423 | + | seg_416 | 107067850 | 107070850 | MID2 | PRPS1 |
| ENST00000262843.6 | 4887 | 107069109 | 107170423 | + | seg_416 | 107067850 | 107070850 | MID2 | PRPS1 |
| ENST00000302917.1 | 4888 | 107224094 | 107225600 | − | seg_417 | 107223950 | 107225250 | TEX13B | PRPS1 |
| ENST00000545689.1 | 4889 | 107399275 | 107681556 | − | seg_418 | 107509250 | 107510600 | COL4A6 | COL4A5 |
| ENST00000538570.1 | 4890 | 107399275 | 107681556 | − | seg_418 | 107509250 | 107510600 | COL4A6 | COL4A5 |
| ENST00000394872.2 | 4891 | 107398838 | 107681658 | − | seg_418 | 107509250 | 107510600 | COL4A6 | COL4A5 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000468338.1 | 4892 | 107457022 | 107682702 | − | seg_418 | 107509250 | 107510600 | COL4A6 | COL4A5 |
| ENST00000541389.1 | 4893 | 107399121 | 107681660 | − | seg_418 | 107509250 | 107510600 | COL4A6 | COL4A5 |
| ENST00000334504.7 | 4894 | 107398837 | 107681660 | − | seg_418 | 107509250 | 107510600 | COL4A6 | COL4A5 |
| ENST00000372216.4 | 4895 | 107398837 | 107682702 | − | seg_418 | 107509250 | 107510600 | COL4A6 | COL4A5 |
| ENST00000545689.1 | 4896 | 107399275 | 107681556 | − | seg_419 | 107621250 | 107622550 | COL4A6 | COL4A5 |
| ENST00000538570.1 | 4897 | 107399275 | 107681556 | − | seg_419 | 107621250 | 107622550 | COL4A6 | COL4A5 |
| ENST00000394872.2 | 4898 | 107398838 | 107681658 | − | seg_419 | 107621250 | 107622550 | COL4A6 | COL4A5 |
| ENST00000461897.1 | 4899 | 107510872 | 107681660 | − | seg_419 | 107621250 | 107622550 | COL4A6 | COL4A5 |
| ENST00000468338.1 | 4900 | 107457022 | 107682702 | − | seg_419 | 107621250 | 107622550 | COL4A6 | COL4A5 |
| ENST00000541389.1 | 4901 | 107399121 | 107681660 | − | seg_419 | 107621250 | 107622550 | COL4A6 | COL4A5 |
| ENST00000334504.7 | 4902 | 107398837 | 107681660 | − | seg_419 | 107621250 | 107622550 | COL4A6 | COL4A5 |
| ENST00000372216.4 | 4903 | 107398837 | 107682702 | − | seg_419 | 107621250 | 107622550 | COL4A6 | COL4A5 |
| ENST00000477085.1 | 4904 | 107510872 | 107682727 | − | seg_419 | 107621250 | 107622550 | COL4A6 | COL4A5 |
| ENST00000372129.2 | 4905 | 107975712 | 107979651 | − | seg_421 | 107975000 | 107976700 | RP6-24A23.6 | COL4A5 |
| ENST00000419932.1 | 4906 | 108297361 | 108297792 | − | seg_423 | 108296850 | 108298000 | IRS4 | COL4A5 |
| ENST00000516235.1 | 4907 | 108297553 | 108297626 | + | seg_423 | 108296850 | 108298000 | IRS4 | COL4A5 |
| ENST00000218006.2 | 4908 | 108616135 | 108725301 | − | seg_424 | 108674800 | 108676200 | GUCY2F | COL4A5 |
| ENST00000218006.2 | 4909 | 108616135 | 108725301 | − | seg_425 | 108703300 | 108705200 | GUCY2F | COL4A5 |
| ENST00000440201.1 | 4910 | 108811707 | 108813521 | + | seg_427 | 108811600 | 108812750 | NXT2 | COL4A5 |
| ENST00000471255.1 | 4911 | 109245915 | 109310624 | + | seg_430 | 109247900 | 109249000 | TMEM164 | COL4A5 |
| ENST00000288381.4 | 4912 | 109246343 | 109421016 | + | seg_430 | 109247900 | 109249000 | TMEM164 | COL4A5 |
| ENST00000372073.1 | 4913 | 109246323 | 109421016 | + | seg_430 | 109247900 | 109249000 | TMEM164 | COL4A5 |
| ENST00000372068.2 | 4914 | 109246342 | 109421012 | + | seg_430 | 109247900 | 109249000 | TMEM164 | COL4A5 |
| ENST00000501872.2 | 4915 | 109246343 | 109420900 | + | seg_430 | 109247900 | 109249000 | TMEM164 | COL4A5 |
| ENST00000372072.3 | 4916 | 109245863 | 109421012 | + | seg_430 | 109247900 | 109249000 | TMEM164 | COL4A5 |
| ENST00000520821.1 | 4917 | 109602044 | 109694109 | + | seg_431 | 109686900 | 109688500 | RGAG1 | COL4A5 |
| ENST00000465301.2 | 4918 | 109662285 | 109699562 | + | seg_431 | 109686900 | 109688500 | RGAG1 | COL4A5 |
| ENST00000218054.4 | 4919 | 109917092 | 110039076 | − | seg_432 | 110038450 | 110040100 | CHRDL1 | COL4A5 |
| ENST00000394797.4 | 4920 | 109918473 | 110038993 | − | seg_432 | 110038450 | 110040100 | CHRDL1 | COL4A5 |
| ENST00000434224.1 | 4921 | 109917092 | 110039286 | − | seg_432 | 110038450 | 110040100 | CHRDL1 | COL4A5 |
| ENST00000372045.1 | 4922 | 109917084 | 110038993 | − | seg_432 | 110038450 | 110040100 | CHRDL1 | COL4A5 |
| ENST00000482160.1 | 4923 | 109919169 | 110039047 | − | seg_432 | 110038450 | 110040100 | CHRDL1 | COL4A5 |
| ENST00000372042.1 | 4924 | 109919004 | 110039039 | − | seg_432 | 110038450 | 110040100 | CHRDL1 | COL4A5 |
| ENST00000444321.2 | 4925 | 109919285 | 110039047 | − | seg_432 | 110038450 | 110040100 | CHRDL1 | COL4A5 |
| ENST00000262839.2 | 4926 | 111017543 | 111326004 | − | seg_433 | 111148500 | 111149550 | TRPC5 | COL4A5 |
| ENST00000262839.2 | 4927 | 111017543 | 111326004 | − | seg_434 | 111323950 | 111326100 | TRPC5 | COL4A5 |
| ENST00000371968.3 | 4928 | 111873876 | 111923282 | − | seg_436 | 111877350 | 111878350 | LHFPL1 | COL4A5 |
| ENST00000536453.1 | 4929 | 111873879 | 111923375 | − | seg_436 | 111877350 | 111878350 | LHFPL1 | COL4A5 |
| ENST00000478229.1 | 4930 | 111874502 | 111923282 | − | seg_436 | 111877350 | 111878350 | LHFPL1 | COL4A5 |
| ENST00000462114.1 | 4931 | 112066365 | 112083911 | − | seg_437 | 112067850 | 112068950 | AMOT | COL4A5 |
| ENST00000524145.1 | 4932 | 112021795 | 112068356 | − | seg_437 | 112067850 | 112068950 | AMOT | COL4A5 |
| ENST00000304758.1 | 4933 | 112017731 | 112084043 | − | seg_437 | 112067850 | 112068950 | AMOT | COL4A5 |
| ENST00000371951.1 | 4934 | 113818551 | 114143070 | + | seg_439 | 113815000 | 113819700 | HTR2C | COL4A5 |
| ENST00000371950.3 | 4935 | 113818555 | 114144624 | + | seg_439 | 113815000 | 113819700 | HTR2C | COL4A5 |
| ENST00000276198.1 | 4936 | 113818551 | 114144624 | + | seg_439 | 113815000 | 113819700 | HTR2C | COL4A5 |
| ENST00000543279.1 | 4937 | 114752497 | 114797058 | − | seg_440 | 114795000 | 114796050 | PLS3 | COL4A5 |
| ENST00000441988.2 | 4938 | 114795501 | 114883831 | + | seg_440 | 114795000 | 114796050 | PLS3 | COL4A5 |
| ENST00000289290.3 | 4939 | 114795582 | 114884078 | + | seg_440 | 114795000 | 114796050 | PLS3 | COL4A5 |
| ENST00000537301.1 | 4940 | 114795555 | 114884078 | + | seg_440 | 114795000 | 114796050 | PLS3 | COL4A5 |
| ENST00000489283.1 | 4941 | 114795501 | 114864228 | + | seg_440 | 114795000 | 114796050 | PLS3 | COL4A5 |
| ENST00000355899.3 | 4942 | 114795509 | 114885177 | + | seg_440 | 114795000 | 114796050 | PLS3 | COL4A5 |
| ENST00000451869.1 | 4943 | 114957297 | 114959381 | + | seg_442 | 114957400 | 114958700 | RP1-241P17.4 | COL4A5 |
| ENST00000415394.1 | 4944 | 114957343 | 114959383 | + | seg_442 | 114957400 | 114958700 | RP1-241P17.4 | COL4A5 |
| ENST00000436163.1 | 4945 | 117250225 | 117250763 | − | seg_444 | 117249550 | 117251250 | KLHL13 | COL4A5 |
| ENST00000371882.1 | 4946 | 117031776 | 117250761 | − | seg_444 | 117249550 | 117251250 | KLHL13 | COL4A5 |
| ENST00000540167.1 | 4947 | 117031777 | 117250828 | − | seg_444 | 117249550 | 117251250 | KLHL13 | COL4A5 |
| ENST00000541812.1 | 4948 | 117031777 | 117251303 | − | seg_444 | 117249550 | 117251250 | KLHL13 | COL4A5 |
| ENST00000545703.1 | 4949 | 117031777 | 117250828 | − | seg_444 | 117249550 | 117251250 | KLHL13 | COL4A5 |
| ENST00000310164.2 | 4950 | 117957753 | 117960931 | + | seg_446 | 117956850 | 117960550 | ZCCHC12 | COL4A5 |
| ENST00000481285.1 | 4951 | 118108581 | 118151946 | + | seg_447 | 118109900 | 118111100 | LONRF3 | COL4A5 |
| ENST00000304778.7 | 4952 | 118108581 | 118152318 | + | seg_447 | 118109900 | 118111100 | LONRF3 | COL4A5 |
| ENST00000439603.1 | 4953 | 118109325 | 118151950 | + | seg_447 | 118109900 | 118111100 | LONRF3 | COL4A5 |
| ENST00000371628.3 | 4954 | 118108713 | 118151892 | + | seg_447 | 118109900 | 118111100 | LONRF3 | COL4A5 |
| ENST00000422289.2 | 4955 | 118110295 | 118151947 | + | seg_447 | 118109900 | 118111100 | LONRF3 | COL4A5 |
| ENST00000472173.1 | 4956 | 118110295 | 118151946 | + | seg_447 | 118109900 | 118111100 | LONRF3 | COL4A5 |
| ENST00000365713.2 | 4957 | 118108581 | 118156888 | + | seg_447 | 118109900 | 118111100 | LONRF3 | COL4A5 |
| ENST00000440399.1 | 4958 | 118212598 | 118223411 | − | seg_449 | 118214300 | 118215550 | KIAA1210 | OCRL |
| ENST00000402510.2 | 4959 | 118212598 | 118284542 | − | seg_449 | 118214300 | 118215550 | KIAA1210 | OCRL |
| ENST00000420240.1 | 4960 | 118227676 | 118250616 | − | seg_450 | 118240400 | 118241500 | KIAA1210 | OCRL |
| ENST00000402510.2 | 4961 | 118212598 | 118284542 | − | seg_450 | 118240400 | 118241500 | KIAA1210 | OCRL |
| ENST00000402510.2 | 4962 | 118212598 | 118284542 | − | seg_451 | 118283750 | 118285900 | KIAA1210 | OCRL |
| ENST00000488158.1 | 4963 | 118533343 | 118588435 | + | seg_453 | 118532900 | 118534700 | SLC25A43 | OCRL |
| ENST00000217909.7 | 4964 | 118533023 | 118588441 | + | seg_453 | 118532900 | 118534700 | SLC25A43 | OCRL |
| ENST00000326714.7 | 4965 | 118533367 | 118588431 | + | seg_453 | 118532900 | 118534700 | SLC25A43 | OCRL |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000495750.1 | 4966 | 118533463 | 118586860 | + | seg_453 | 118532900 | 118534700 | SLC25A43 | OCRL |
| ENST00000336249.7 | 4967 | 118533343 | 118587183 | + | seg_453 | 118532900 | 118534700 | SLC25A43 | OCRL |
| ENST00000493093.1 | 4968 | 118533372 | 118587145 | + | seg_453 | 118532900 | 118534700 | SLC25A43 | OCRL |
| ENST00000488158.1 | 4969 | 118533343 | 118588435 | + | seg_454 | 118552150 | 118553350 | SLC25A43 | OCRL |
| ENST00000217909.7 | 4970 | 118533023 | 118588441 | + | seg_454 | 118552150 | 118553350 | SLC25A43 | OCRL |
| ENST00000326714.7 | 4971 | 118533367 | 118588431 | + | seg_454 | 118552150 | 118553350 | SLC25A43 | OCRL |
| ENST00000495750.1 | 4972 | 118533463 | 118586860 | + | seg_454 | 118552150 | 118553350 | SLC25A43 | OCRL |
| ENST00000484058.1 | 4973 | 118540519 | 118586904 | + | seg_454 | 118552150 | 118553350 | SLC25A43 | OCRL |
| ENST00000336249.7 | 4974 | 118533343 | 118587183 | + | seg_454 | 118552150 | 118553350 | SLC25A43 | OCRL |
| ENST00000493093.1 | 4975 | 118533372 | 118587145 | + | seg_454 | 118552150 | 118553350 | SLC25A43 | OCRL |
| ENST00000454625.1 | 4976 | 119144675 | 119149501 | − | seg_460 | 119147300 | 119149300 | RHOXF2B | OCRL |
| ENST00000480821.1 | 4977 | 119443748 | 119445257 | − | seg_462 | 119443650 | 119445500 | TMEM255A | OCRL |
| ENST00000309720.5 | 4978 | 119392505 | 119445288 | − | seg_462 | 119443650 | 119445500 | TMEM255A | OCRL |
| ENST00000440464.1 | 4979 | 119392506 | 119445391 | − | seg_462 | 119443650 | 119445500 | TMEM255A | OCRL |
| ENST00000371369.4 | 4980 | 119392505 | 119445391 | − | seg_462 | 119443650 | 119445500 | TMEM255A | OCRL |
| ENST00000519908.1 | 4981 | 119402218 | 119445411 | − | seg_462 | 119443650 | 119445500 | TMEM255A | OCRL |
| ENST00000218008.3 | 4982 | 119495967 | 119516226 | + | seg_463 | 119503950 | 119505200 | ATP1B4 | OCRL |
| ENST00000539306.1 | 4983 | 119495997 | 119513514 | + | seg_463 | 119503950 | 119505200 | ATP1B4 | OCRL |
| ENST00000361319.3 | 4984 | 119495967 | 119516226 | + | seg_463 | 119503950 | 119505200 | ATP1B4 | OCRL |
| ENST00000371311.3 | 4985 | 120006457 | 120009779 | − | seg_465 | 120007900 | 120009150 | CT47B1 | OCRL |
| ENST00000479118.1 | 4986 | 122318412 | 122387553 | + | seg_471 | 122317650 | 122321300 | GRIA3 | OCRL |
| ENST00000371264.3 | 4987 | 122318152 | 122338534 | + | seg_471 | 122317650 | 122321300 | GRIA3 | OCRL |
| ENST00000371266.1 | 4988 | 122318006 | 122338534 | + | seg_471 | 122317650 | 122321300 | GRIA3 | OCRL |
| ENST00000335161.8 | 4989 | 122318224 | 122338270 | + | seg_471 | 122317650 | 122321300 | GRIA3 | OCRL |
| ENST00000541091.1 | 4990 | 122318765 | 122551942 | + | seg_471 | 122317650 | 122321300 | GRIA3 | OCRL |
| ENST00000371251.1 | 4991 | 122318336 | 122616897 | + | seg_471 | 122317650 | 122321300 | GRIA3 | OCRL |
| ENST00000264357.5 | 4992 | 122318096 | 122624756 | + | seg_471 | 122317650 | 122321300 | GRIA3 | OCRL |
| ENST00000371256.5 | 4993 | 122318336 | 122624766 | + | seg_471 | 122317650 | 122321300 | GRIA3 | OCRL |
| ENST00000542149.1 | 4994 | 122318224 | 122622587 | + | seg_471 | 122317650 | 122321300 | GRIA3 | OCRL |
| ENST00000479118.1 | 4995 | 122318412 | 122387553 | + | seg_472 | 122323700 | 122324850 | GRIA3 | OCRL |
| ENST00000371264.3 | 4996 | 122318152 | 122338534 | + | seg_472 | 122323700 | 122324850 | GRIA3 | OCRL |
| ENST00000371266.1 | 4997 | 122318006 | 122338534 | + | seg_472 | 122323700 | 122324850 | GRIA3 | OCRL |
| ENST00000335161.8 | 4998 | 122318224 | 122338270 | + | seg_472 | 122323700 | 122324850 | GRIA3 | OCRL |
| ENST00000541091.1 | 4999 | 122318765 | 122551942 | + | seg_472 | 122323700 | 122324850 | GRIA3 | OCRL |
| ENST00000371251.1 | 5000 | 122318336 | 122616897 | + | seg_472 | 122323700 | 122324850 | GRIA3 | OCRL |
| ENST00000264357.5 | 5001 | 122318096 | 122624756 | + | seg_472 | 122323700 | 122324850 | GRIA3 | OCRL |
| ENST00000371256.5 | 5002 | 122318336 | 122624766 | + | seg_472 | 122323700 | 122324850 | GRIA3 | OCRL |
| ENST00000542149.1 | 5003 | 122318224 | 122622587 | + | seg_472 | 122323700 | 122324850 | GRIA3 | OCRL |
| ENST00000429967.1 | 5004 | 128779786 | 128788914 | − | seg_479 | 128781850 | 128783650 | APLN | OCRL |
| ENST00000427399.1 | 5005 | 128781653 | 128782742 | − | seg_479 | 128781850 | 128783650 | APLN | OCRL |
| ENST00000307484.6 | 5006 | 128779240 | 128788933 | − | seg_479 | 128781850 | 128783650 | APLN | OCRL |
| ENST00000429967.1 | 5007 | 128779786 | 128788914 | − | seg_480 | 128787750 | 128789650 | APLN | OCRL |
| ENST00000307484.6 | 5008 | 128779240 | 128788933 | − | seg_480 | 128787750 | 128789650 | APLN | OCRL |
| ENST00000371106.3 | 5009 | 128872998 | 128903514 | + | seg_484 | 128882700 | 128883950 | XPNPEP2 | OCRL |
| ENST00000276218.2 | 5010 | 129518319 | 129519511 | − | seg_487 | 129517950 | 129519000 | GPR119 | OCRL |
| ENST00000458525.1 | 5011 | 129611043 | 129619850 | − | seg_489 | 129617200 | 129618900 | RBMX2 | OCRL |
| ENST00000412420.1 | 5012 | 130150443 | 130192120 | − | seg_491 | 130182550 | 130183750 | ARHGAP36 | NYS1 = FRMD7 |
| ENST00000423277.1 | 5013 | 130206962 | 130218649 | + | seg_492 | 130211050 | 130212100 | ARHGAP36 | NYS1 = FRMD7 |
| ENST00000370922.1 | 5014 | 130192331 | 130223857 | + | seg_492 | 130211050 | 130212100 | ARHGAP36 | NYS1 = FRMD7 |
| ENST00000276211.5 | 5015 | 130192216 | 130223853 | + | seg_492 | 130211050 | 130212100 | ARHGAP36 | NYS1 = FRMD7 |
| ENST00000423277.1 | 5016 | 130206962 | 130218649 | + | seg_493 | 130215900 | 130218550 | ARHGAP36 | NYS1 = FRMD7 |
| ENST00000412432.2 | 5017 | 130212691 | 130223857 | + | seg_493 | 130215900 | 130218550 | ARHGAP36 | NYS1 = FRMD7 |
| ENST00000370921.1 | 5018 | 130217684 | 130223857 | + | seg_493 | 130215900 | 130218550 | ARHGAP36 | NYS1 = FRMD7 |
| ENST00000370922.1 | 5019 | 130192331 | 130223857 | + | seg_493 | 130215900 | 130218550 | ARHGAP36 | NYS1 = FRMD7 |
| ENST00000276211.5 | 5020 | 130192216 | 130223853 | + | seg_493 | 130215900 | 130218550 | ARHGAP36 | NYS1 = FRMD7 |
| ENST00000467244.1 | 5021 | 130409953 | 130411491 | − | seg_494 | 130409100 | 130410150 | IGSF1 | NYS1 = FRMD7 |
| ENST00000370910.1 | 5022 | 130407480 | 130423252 | − | seg_494 | 130409100 | 130410150 | IGSF1 | NYS1 = FRMD7 |
| ENST00000370903.3 | 5023 | 130407485 | 130423403 | − | seg_494 | 130409100 | 130410150 | IGSF1 | NYS1 = FRMD7 |
| ENST00000361420.3 | 5024 | 130407483 | 130423200 | − | seg_494 | 130409100 | 130410150 | IGSF1 | NYS1 = FRMD7 |
| ENST00000370904.1 | 5025 | 130407485 | 130533677 | − | seg_494 | 130409100 | 130410150 | IGSF1 | NYS1 = FRMD7 |
| ENST00000490400.1 | 5026 | 131351694 | 131353471 | − | seg_496 | 131351450 | 131352650 | RAP2C | NYS1 = FRMD7 |
| ENST00000370874.1 | 5027 | 131338678 | 131353461 | − | seg_496 | 131351450 | 131352650 | RAP2C | NYS1 = FRMD7 |
| ENST00000342983.2 | 5028 | 131337053 | 131352152 | − | seg_496 | 131351450 | 131352650 | RAP2C | NYS1 = FRMD7 |
| ENST00000460462.1 | 5029 | 131339477 | 131352360 | − | seg_496 | 131351450 | 131352650 | RAP2C | NYS1 = FRMD7 |
| ENST00000421483.1 | 5030 | 131351175 | 131564190 | + | seg_496 | 131351450 | 131352650 | RAP2C | NYS1 = FRMD7 |
| ENST00000441399.1 | 5031 | 131352535 | 131566890 | + | seg_496 | 131351450 | 131352650 | RAP2C | NYS1 = FRMD7 |
| ENST00000370853.3 | 5032 | 131512177 | 131573718 | − | seg_497 | 131556050 | 131558450 | MBNL3 | NYS1 = FRMD7 |
| ENST00000370857.3 | 5033 | 131506029 | 131573705 | − | seg_497 | 131556050 | 131558450 | MBNL3 | NYS1 = FRMD7 |
| ENST00000370839.3 | 5034 | 131513232 | 131573718 | − | seg_497 | 131556050 | 131558450 | MBNL3 | NYS1 = FRMD7 |
| ENST00000370844.1 | 5035 | 131513232 | 131623996 | − | seg_497 | 131556050 | 131558450 | MBNL3 | NYS1 = FRMD7 |
| ENST00000421707.1 | 5036 | 131518691 | 131623043 | − | seg_497 | 131556050 | 131558450 | MBNL3 | NYS1 = FRMD7 |
| ENST00000421483.1 | 5037 | 131351175 | 131564190 | + | seg_497 | 131556050 | 131558450 | MBNL3 | NYS1 = FRMD7 |
| ENST00000436215.1 | 5038 | 131516244 | 131623894 | − | seg_497 | 131556050 | 131558450 | MBNL3 | NYS1 = FRMD7 |
| ENST00000441399.1 | 5039 | 131352535 | 131566890 | + | seg_497 | 131556050 | 131558450 | MBNL3 | NYS1 = FRMD7 |
| ENST00000370836.2 | 5040 | 131760044 | 132095423 | − | seg_499 | 132008150 | 132009150 | HS6ST2 | NYS1 = FRMD7 |
| ENST00000370833.2 | 5041 | 131762251 | 132091344 | − | seg_499 | 132008150 | 132009150 | HS6ST2 | NYS1 = FRMD7 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000461959.1 | 5042 | 131760044 | 132091354 | − | seg_499 | 132008150 | 132009150 | HS6ST2 | NYS1 = FRMD7 |
| ENST00000319809.6 | 5043 | 131762877 | 132091305 | − | seg_499 | 132008150 | 132009150 | HS6ST2 | NYS1 = FRMD7 |
| ENST00000521489.1 | 5044 | 131761998 | 132095423 | − | seg_499 | 132008150 | 132009150 | HS6ST2 | NYS1 = FRMD7 |
| ENST00000370837.1 | 5045 | 131760038 | 132091358 | − | seg_499 | 132008150 | 132009150 | HS6ST2 | NYS1 = FRMD7 |
| ENST00000370836.2 | 5046 | 131760044 | 132095423 | − | seg_500 | 132086850 | 132088300 | HS6ST2 | NYS1 = FRMD7 |
| ENST00000370833.2 | 5047 | 131762251 | 132091344 | − | seg_500 | 132086850 | 132088300 | HS6ST2 | NYS1 = FRMD7 |
| ENST00000461959.1 | 5048 | 131760044 | 132091354 | − | seg_500 | 132086850 | 132088300 | HS6ST2 | NYS1 = FRMD7 |
| ENST00000319809.6 | 5049 | 131762877 | 132091305 | − | seg_500 | 132086850 | 132088300 | HS6ST2 | NYS1 = FRMD7 |
| ENST00000521489.1 | 5050 | 131761998 | 132095423 | − | seg_500 | 132086850 | 132088300 | HS6ST2 | NYS1 = FRMD7 |
| ENST00000370837.1 | 5051 | 131760038 | 132091358 | − | seg_500 | 132086850 | 132088300 | HS6ST2 | NYS1 = FRMD7 |
| ENST00000517294.1 | 5052 | 133371077 | 133380237 | + | seg_502 | 133370100 | 133372850 | CCDC160 | HPRT1 = HPRT |
| ENST00000370809.4 | 5053 | 133371077 | 133379808 | + | seg_502 | 133370100 | 133372850 | CCDC160 | HPRT1 = HPRT |
| ENST00000434384.1 | 5054 | 133684003 | 133693953 | + | seg_504 | 133682650 | 133684050 | PLAC1 | HPRT1 = HPRT |
| ENST00000441416.1 | 5055 | 134314179 | 134328610 | + | seg_510 | 134314000 | 134315000 | CXorf48 | HPRT1 = HPRT |
| ENST00000445718.1 | 5056 | 134335662 | 134349163 | + | seg_511 | 134346900 | 134347900 | CXorf48 | HPRT1 = HPRT |
| ENST00000445718.1 | 5057 | 134335662 | 134349163 | + | seg_512 | 134349000 | 134350350 | CXorf48 | HPRT1 = HPRT |
| ENST00000442950.1 | 5058 | 134370740 | 134371295 | + | seg_515 | 134370750 | 134373750 | ZNF75D | HPRT1 = HPRT |
| ENST00000339249.4 | 5059 | 134478721 | 134497077 | + | seg_516 | 134478200 | 134479400 | ZNF449 | HPRT1 = HPRT |
| ENST00000370761.3 | 5060 | 134478721 | 134482954 | + | seg_516 | 134478200 | 134479400 | ZNF449 | HPRT1 = HPRT |
| ENST00000370760.3 | 5061 | 134478721 | 134482708 | + | seg_516 | 134478200 | 134479400 | ZNF449 | HPRT1 = HPRT |
| ENST00000417443.1 | 5062 | 134555868 | 134559682 | + | seg_518 | 134555850 | 134556850 | ZNF449 | HPRT1 = HPRT |
| ENST00000426910.1 | 5063 | 134566885 | 134572559 | + | seg_519 | 134566100 | 134571950 | DDX26B | HPRT1 = HPRT |
| ENST00000471213.1 | 5064 | 134866214 | 134875839 | + | seg_523 | 134871500 | 134872550 | CT45A2 | HPRT1 = HPRT |
| ENST00000370736.3 | 5065 | 134866214 | 134874250 | + | seg_523 | 134871500 | 134872550 | CT45A2 | HPRT1 = HPRT |
| ENST00000495729.1 | 5066 | 134866399 | 134874235 | + | seg_523 | 134871500 | 134872550 | CT45A2 | HPRT1 = HPRT |
| ENST00000370734.3 | 5067 | 134883488 | 134891521 | + | seg_524 | 134888100 | 134889150 | CT45A3 | HPRT1 = HPRT |
| ENST00000461216.1 | 5068 | 134883673 | 134891482 | + | seg_524 | 134888100 | 134889150 | CT45A3 | HPRT1 = HPRT |
| ENST00000485366.1 | 5069 | 134883488 | 134893393 | + | seg_524 | 134888100 | 134889150 | CT45A3 | HPRT1 = HPRT |
| ENST00000443882.1 | 5070 | 134887233 | 134891519 | + | seg_524 | 134888100 | 134889150 | CT45A3 | HPRT1 = HPRT |
| ENST00000487941.1 | 5071 | 134926788 | 134936735 | − | seg_525 | 134931900 | 134933650 | CT45A4 | HPRT1 = HPRT |
| ENST00000494421.1 | 5072 | 134928706 | 134936550 | − | seg_525 | 134931900 | 134933650 | CT45A4 | HPRT1 = HPRT |
| ENST00000434966.2 | 5073 | 134928695 | 134936735 | − | seg_525 | 134931900 | 134933650 | CT45A4 | HPRT1 = HPRT |
| ENST00000420087.2 | 5074 | 134928697 | 134953994 | − | seg_525 | 134931900 | 134933650 | CT45A4 | HPRT1 = HPRT |
| ENST00000463085.1 | 5075 | 134944381 | 134953994 | − | seg_526 | 134947700 | 134950650 | CT45A4 | HPRT1 = HPRT |
| ENST00000370724.3 | 5076 | 134945962 | 134953994 | − | seg_526 | 134947700 | 134950650 | CT45A4 | HPRT1 = HPRT |
| ENST00000491480.1 | 5077 | 134945973 | 134953809 | − | seg_526 | 134947700 | 134950650 | CT45A4 | HPRT1 = HPRT |
| ENST00000420087.2 | 5078 | 134928697 | 134953994 | − | seg_526 | 134947700 | 134950650 | CT45A4 | HPRT1 = HPRT |
| ENST00000536581.1 | 5079 | 135229692 | 135292637 | + | seg_532 | 135228300 | 135230300 | FHL1 | HPRT1 = HPRT |
| ENST00000420362.1 | 5080 | 135229825 | 135290725 | + | seg_532 | 135228300 | 135230300 | FHL1 | HPRT1 = HPRT |
| ENST00000370690.3 | 5081 | 135229624 | 135293518 | + | seg_532 | 135228300 | 135230300 | FHL1 | HPRT1 = HPRT |
| ENST00000394155.2 | 5082 | 135229559 | 135293518 | + | seg_532 | 135228300 | 135230300 | FHL1 | HPRT1 = HPRT |
| ENST00000458357.1 | 5083 | 135230270 | 135290084 | + | seg_532 | 135228300 | 135230300 | FHL1 | HPRT1 = HPRT |
| ENST00000536581.1 | 5084 | 135229692 | 135292637 | + | seg_533 | 135233600 | 135234900 | FHL1 | HPRT1 = HPRT |
| ENST00000420362.1 | 5085 | 135229825 | 135290725 | + | seg_533 | 135233600 | 135234900 | FHL1 | HPRT1 = HPRT |
| ENST00000370690.3 | 5086 | 135229624 | 135293518 | + | seg_533 | 135233600 | 135234900 | FHL1 | HPRT1 = HPRT |
| ENST00000535737.1 | 5087 | 135230737 | 135293518 | + | seg_533 | 135233600 | 135234900 | FHL1 | HPRT1 = HPRT |
| ENST00000394155.2 | 5088 | 135229559 | 135293518 | + | seg_533 | 135233600 | 135234900 | FHL1 | HPRT1 = HPRT |
| ENST00000458357.1 | 5089 | 135230270 | 135290084 | + | seg_533 | 135233600 | 135234900 | FHL1 | HPRT1 = HPRT |
| ENST00000536581.1 | 5090 | 135229692 | 135292637 | + | seg_534 | 135250050 | 135251600 | FHL1 | HPRT1 = HPRT |
| ENST00000434885.1 | 5091 | 135250353 | 135290734 | + | seg_534 | 135250050 | 135251600 | FHL1 | HPRT1 = HPRT |
| ENST00000543669.1 | 5092 | 135251455 | 135293518 | + | seg_534 | 135250050 | 135251600 | FHL1 | HPRT1 = HPRT |
| ENST00000420362.1 | 5093 | 135229825 | 135290725 | + | seg_534 | 135250050 | 135251600 | FHL1 | HPRT1 = HPRT |
| ENST00000452016.1 | 5094 | 135249163 | 135290734 | + | seg_534 | 135250050 | 135251600 | FHL1 | HPRT1 = HPRT |
| ENST00000370690.3 | 5095 | 135229624 | 135293518 | + | seg_534 | 135250050 | 135251600 | FHL1 | HPRT1 = HPRT |
| ENST00000535737.1 | 5096 | 135230737 | 135293518 | + | seg_534 | 135250050 | 135251600 | FHL1 | HPRT1 = HPRT |
| ENST00000394155.2 | 5097 | 135229559 | 135293518 | + | seg_534 | 135250050 | 135251600 | FHL1 | HPRT1 = HPRT |
| ENST00000458357.1 | 5098 | 135230270 | 135290084 | + | seg_534 | 135250050 | 135251600 | FHL1 | HPRT1 = HPRT |
| ENST00000394141.1 | 5099 | 135388180 | 135498843 | + | seg_535 | 135436600 | 135438050 | GPR112 | HPRT1 = HPRT |
| ENST00000287534.4 | 5100 | 135387012 | 135519215 | + | seg_535 | 135436600 | 135438050 | GPR112 | HPRT1 = HPRT |
| ENST00000394143.1 | 5101 | 135383122 | 135499047 | + | seg_535 | 135436600 | 135438050 | GPR112 | HPRT1 = HPRT |
| ENST00000412101.1 | 5102 | 135387012 | 135499047 | + | seg_535 | 135436600 | 135438050 | GPR112 | HPRT1 = HPRT |
| ENST00000370652.1 | 5103 | 135387012 | 135499047 | + | seg_535 | 135436600 | 135438050 | GPR112 | HPRT1 = HPRT |
| ENST00000370648.3 | 5104 | 135570046 | 135575939 | + | seg_536 | 135572450 | 135573650 | BRS3 | HPRT1 = HPRT |
| ENST00000470358.1 | 5105 | 135632601 | 135638966 | + | seg_537 | 135634450 | 135636250 | VGLL1 | HPRT1 = HPRT |
| ENST00000440515.1 | 5106 | 135618287 | 135638655 | + | seg_537 | 135634450 | 135636250 | VGLL1 | HPRT1 = HPRT |
| ENST00000370634.3 | 5107 | 135614311 | 135638966 | + | seg_537 | 135634450 | 135636250 | VGLL1 | HPRT1 = HPRT |
| ENST00000456412.1 | 5108 | 135618354 | 135638966 | + | seg_537 | 135634450 | 135636250 | VGLL1 | HPRT1 = HPRT |
| ENST00000430688.2 | 5109 | 135614311 | 135638965 | + | seg_537 | 135634450 | 135636250 | VGLL1 | HPRT1 = HPRT |
| ENST00000370628.2 | 5110 | 135730386 | 135742549 | + | seg_538 | 135736550 | 135737900 | CD40LG | HPRT1 = HPRT |
| ENST00000370629.2 | 5111 | 135730352 | 135742549 | + | seg_538 | 135736550 | 135737900 | CD40LG | HPRT1 = HPRT |
| ENST00000370628.2 | 5112 | 135730386 | 135742549 | + | seg_539 | 135741150 | 135742750 | CD40LG | HPRT1 = HPRT |
| ENST00000370629.2 | 5113 | 135730352 | 135742549 | + | seg_539 | 135741150 | 135742750 | CD40LG | HPRT1 = HPRT |
| ENST00000287538.5 | 5114 | 136648301 | 136653744 | + | seg_546 | 136650850 | 136652450 | ZIC3 | F9 |
| ENST00000478471.1 | 5115 | 136650964 | 136652154 | + | seg_546 | 136650850 | 136652450 | ZIC3 | F9 |
| ENST00000370606.3 | 5116 | 136648677 | 136659850 | + | seg_546 | 136650850 | 136652450 | ZIC3 | F9 |
| ENST00000483690.1 | 5117 | 138689343 | 138697109 | − | seg_550 | 138689350 | 138690400 | MCF2 | F9 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000519895.1 | 5118 | 138664456 | 138790386 | − | seg_550 | 138689350 | 138690400 | MCF2 | F9 |
| ENST00000446225.1 | 5119 | 138664301 | 138697211 | − | seg_550 | 138689350 | 138690400 | MCF2 | F9 |
| ENST00000520602.1 | 5120 | 138663929 | 138774315 | − | seg_550 | 138689350 | 138690400 | MCF2 | F9 |
| ENST00000536274.1 | 5121 | 138663930 | 138725000 | − | seg_550 | 138689350 | 138690400 | MCF2 | F9 |
| ENST00000370573.4 | 5122 | 138664602 | 138724677 | − | seg_550 | 138689350 | 138690400 | MCF2 | F9 |
| ENST00000370576.4 | 5123 | 138663930 | 138724887 | − | seg_550 | 138689350 | 138690400 | MCF2 | F9 |
| ENST00000370578.4 | 5124 | 138663930 | 138774284 | − | seg_550 | 138689350 | 138690400 | MCF2 | F9 |
| ENST00000338585.6 | 5125 | 138664630 | 138724677 | − | seg_550 | 138689350 | 138690400 | MCF2 | F9 |
| ENST00000414978.1 | 5126 | 138663930 | 138790375 | − | seg_550 | 138689350 | 138690400 | MCF2 | F9 |
| ENST00000519895.1 | 5127 | 138664456 | 138790386 | − | seg_551 | 138772800 | 138775400 | MCF2 | F9 |
| ENST00000520602.1 | 5128 | 138663929 | 138774315 | − | seg_551 | 138772800 | 138775400 | MCF2 | F9 |
| ENST00000370578.4 | 5129 | 138663930 | 138774284 | − | seg_551 | 138772800 | 138775400 | MCF2 | F9 |
| ENST00000414978.1 | 5130 | 138663930 | 138790375 | − | seg_551 | 138772800 | 138775400 | MCF2 | F9 |
| ENST00000485626.1 | 5131 | 138884461 | 139027435 | − | seg_552 | 139015500 | 139016750 | ATP11C | F9 |
| ENST00000453380.1 | 5132 | 139173902 | 139174720 | + | seg_553 | 139172400 | 139174100 | CXorf66 | F9 |
| ENST00000370536.2 | 5133 | 139585152 | 139587225 | − | seg_555 | 139584250 | 139586100 | SOX3 | F9 |
| ENST00000370530.1 | 5134 | 140096761 | 140097876 | + | seg_557 | 140096200 | 140097500 | SPANXB1 | F9 |
| ENST00000370467.3 | 5135 | 147062849 | 147108187 | + | seg_560 | 147095200 | 147096350 | FMR1NB | FMR1 |
| ENST00000489034.1 | 5136 | 147088336 | 147108185 | + | seg_560 | 147095200 | 147096350 | FMR1NB | FMR1 |
| ENST00000435346.1 | 5137 | 147628399 | 147628918 | + | seg_561 | 147627750 | 147628750 | AFF2 | FMR1 |
| ENST00000370457.5 | 5138 | 147582139 | 148082193 | + | seg_561 | 147627750 | 147628750 | AFF2 | FMR1 |
| ENST00000370460.2 | 5139 | 147582139 | 148082193 | + | seg_561 | 147627750 | 147628750 | AFF2 | FMR1 |
| ENST00000370458.1 | 5140 | 147582529 | 147985907 | + | seg_561 | 147627750 | 147628750 | AFF2 | FMR1 |
| ENST00000342251.3 | 5141 | 147582228 | 148075954 | + | seg_561 | 147627750 | 147628750 | AFF2 | FMR1 |
| ENST00000370457.5 | 5142 | 147582139 | 148082193 | + | seg_562 | 147670600 | 147671600 | AFF2 | FMR1 |
| ENST00000370460.2 | 5143 | 147582139 | 148082193 | + | seg_562 | 147670600 | 147671600 | AFF2 | FMR1 |
| ENST00000370458.1 | 5144 | 147582529 | 147985907 | + | seg_562 | 147670600 | 147671600 | AFF2 | FMR1 |
| ENST00000342251.3 | 5145 | 147582228 | 148075954 | + | seg_562 | 147670600 | 147671600 | AFF2 | FMR1 |
| ENST00000543618.1 | 5146 | 148678217 | 148683886 | − | seg_567 | 148673650 | 148678650 | HSFX2 | MTM1 |
| ENST00000522155.1 | 5147 | 148674868 | 148676436 | − | seg_567 | 148673650 | 148678650 | HSFX2 | MTM1 |
| ENST00000524178.1 | 5148 | 148674172 | 148676974 | − | seg_567 | 148673650 | 148678650 | HSFX2 | MTM1 |
| ENST00000519015.1 | 5149 | 148678217 | 148683886 | − | seg_567 | 148673650 | 148678650 | HSFX2 | MTM1 |
| ENST00000316916.8 | 5150 | 148678216 | 148713568 | − | seg_567 | 148673650 | 148678650 | HSFX2 | MTM1 |
| ENST00000536359.1 | 5151 | 148678216 | 148713487 | − | seg_567 | 148673650 | 148678650 | HSFX2 | MTM1 |
| ENST00000513505.2 | 5152 | 148678216 | 148713402 | − | seg_567 | 148673650 | 148678650 | HSFX2 | MTM1 |
| ENST00000543618.1 | 5153 | 148678217 | 148683886 | − | seg_568 | 148679900 | 148684000 | HSFX2 | MTM1 |
| ENST00000519015.1 | 5154 | 148678217 | 148683886 | − | seg_568 | 148679900 | 148684000 | HSFX2 | MTM1 |
| ENST00000316916.8 | 5155 | 148678216 | 148713568 | − | seg_568 | 148679900 | 148684000 | HSFX2 | MTM1 |
| ENST00000502858.2 | 5156 | 148679625 | 148690438 | − | seg_568 | 148679900 | 148684000 | HSFX2 | MTM1 |
| ENST00000536359.1 | 5157 | 148678216 | 148713487 | − | seg_568 | 148679900 | 148684000 | HSFX2 | MTM1 |
| ENST00000513505.2 | 5158 | 148678216 | 148713402 | − | seg_568 | 148679900 | 148684000 | HSFX2 | MTM1 |
| ENST00000502618.1 | 5159 | 148681969 | 148693146 | − | seg_568 | 148679900 | 148684000 | HSFX2 | MTM1 |
| ENST00000316916.8 | 5160 | 148678216 | 148713568 | − | seg_569 | 148712800 | 148714250 | TMEM185A | MTM1 |
| ENST00000502900.1 | 5161 | 148686838 | 148713403 | − | seg_569 | 148712800 | 148714250 | TMEM185A | MTM1 |
| ENST00000536359.1 | 5162 | 148678216 | 148713487 | − | seg_569 | 148712800 | 148714250 | TMEM185A | MTM1 |
| ENST00000511776.1 | 5163 | 148690379 | 148713365 | − | seg_569 | 148712800 | 148714250 | TMEM185A | MTM1 |
| ENST00000513505.2 | 5164 | 148678216 | 148713402 | − | seg_569 | 148712800 | 148714250 | TMEM185A | MTM1 |
| ENST00000507237.1 | 5165 | 148685375 | 148713381 | − | seg_569 | 148712800 | 148714250 | TMEM185A | MTM1 |
| ENST00000428022.1 | 5166 | 148848815 | 148854483 | + | seg_573 | 148848550 | 148851050 | HSFX1 | MTM1 |
| ENST00000524311.1 | 5167 | 148850558 | 148853029 | + | seg_573 | 148848550 | 148851050 | HSFX1 | MTM1 |
| ENST00000428022.1 | 5168 | 148848815 | 148854483 | + | seg_574 | 148853750 | 148858950 | HSFX1 | MTM1 |
| ENST00000370416.4 | 5169 | 148855726 | 148858525 | + | seg_574 | 148853750 | 148858950 | HSFX1 | MTM1 |
| ENST00000449111.1 | 5170 | 149106846 | 149392815 | + | seg_577 | 149221300 | 149222500 | CXorf40B | MTM1 |
| ENST00000449111.1 | 5171 | 149106846 | 149392815 | + | seg_578 | 149326200 | 149327250 | CXorf40B | MTM1 |
| ENST00000468306.1 | 5172 | 149529689 | 149638367 | + | seg_579 | 149527800 | 149533900 | MAMLD1 | MTM1 |
| ENST00000432680.2 | 5173 | 149531686 | 149681395 | + | seg_579 | 149527800 | 149533900 | MAMLD1 | MTM1 |
| ENST00000445612.2 | 5174 | 149529836 | 149680503 | + | seg_579 | 149527800 | 149533900 | MAMLD1 | MTM1 |
| ENST00000370401.2 | 5175 | 149531551 | 149682448 | + | seg_579 | 149527800 | 149533900 | MAMLD1 | MTM1 |
| ENST00000426613.2 | 5176 | 149613720 | 149682448 | + | seg_580 | 149646250 | 149648200 | MAMLD1 | MTM1 |
| ENST00000455522.2 | 5177 | 149639280 | 149680512 | + | seg_580 | 149646250 | 149648200 | MAMLD1 | MTM1 |
| ENST00000262858.5 | 5178 | 149613720 | 149682448 | + | seg_580 | 149646250 | 149648200 | MAMLD1 | MTM1 |
| ENST00000432680.2 | 5179 | 149531686 | 149681395 | + | seg_580 | 149646250 | 149648200 | MAMLD1 | MTM1 |
| ENST00000445612.2 | 5180 | 149529836 | 149680503 | + | seg_580 | 149646250 | 149648200 | MAMLD1 | MTM1 |
| ENST00000370401.2 | 5181 | 149531551 | 149682448 | + | seg_580 | 149646250 | 149648200 | MAMLD1 | MTM1 |
| ENST00000426613.2 | 5182 | 149613720 | 149682448 | + | seg_581 | 149670700 | 149671900 | MAMLD1 | MTM1 |
| ENST00000455522.2 | 5183 | 149639280 | 149680512 | + | seg_581 | 149670700 | 149671900 | MAMLD1 | MTM1 |
| ENST00000262858.5 | 5184 | 149613720 | 149682448 | + | seg_581 | 149670700 | 149671900 | MAMLD1 | MTM1 |
| ENST00000432680.2 | 5185 | 149531686 | 149681395 | + | seg_581 | 149670700 | 149671900 | MAMLD1 | MTM1 |
| ENST00000445612.2 | 5186 | 149529836 | 149680503 | + | seg_581 | 149670700 | 149671900 | MAMLD1 | MTM1 |
| ENST00000370401.2 | 5187 | 149531551 | 149682448 | + | seg_581 | 149670700 | 149671900 | MAMLD1 | MTM1 |
| ENST00000464149.1 | 5188 | 149677595 | 149682439 | + | seg_582 | 149681150 | 149683750 | MAMLD1 | MTM1 |
| ENST00000426613.2 | 5189 | 149613720 | 149682448 | + | seg_582 | 149681150 | 149683750 | MAMLD1 | MTM1 |
| ENST00000262858.5 | 5190 | 149613720 | 149682448 | + | seg_582 | 149681150 | 149683750 | MAMLD1 | MTM1 |
| ENST00000432680.2 | 5191 | 149531686 | 149681395 | + | seg_582 | 149681150 | 149683750 | MAMLD1 | MTM1 |
| ENST00000370401.2 | 5192 | 149531551 | 149682448 | + | seg_582 | 149681150 | 149683750 | MAMLD1 | MTM1 |
| ENST00000454196.1 | 5193 | 150343664 | 150346308 | − | seg_590 | 150342250 | 150347350 | GPR50 | MTM1 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000535473.1 | 5194 | 150345056 | 150348932 | + | seg_590 | 150342250 | 150347350 | GPR50 | MTM1 |
| ENST00000218316.3 | 5195 | 150345125 | 150349937 | + | seg_590 | 150342250 | 150347350 | GPR50 | MTM1 |
| ENST00000458074.1 | 5196 | 150394701 | 150396187 | − | seg_591 | 150395650 | 150397300 | GPR50 | MTM1 |
| ENST00000370361.1 | 5197 | 150565038 | 150573629 | + | seg_593 | 150565200 | 150566300 | VMA21 | MTM1 |
| ENST00000330374.6 | 5198 | 150565676 | 150577836 | + | seg_593 | 150565200 | 150566300 | VMA21 | MTM1 |
| ENST00000477649.1 | 5199 | 150564987 | 150573629 | + | seg_593 | 150565200 | 150566300 | VMA21 | MTM1 |
| ENST00000535156.1 | 5200 | 152082986 | 152142024 | + | seg_607 | 152096400 | 152098350 | ZNF185 | ABCD1 |
| ENST00000539731.1 | 5201 | 152082986 | 152142024 | + | seg_607 | 152096400 | 152098350 | ZNF185 | ABCD1 |
| ENST00000447088.1 | 5202 | 152088893 | 152106707 | + | seg_607 | 152096400 | 152098350 | ZNF185 | ABCD1 |
| ENST00000318504.7 | 5203 | 152082986 | 152142024 | + | seg_607 | 152096400 | 152098350 | ZNF185 | ABCD1 |
| ENST00000370270.1 | 5204 | 152086665 | 152142025 | + | seg_607 | 152096400 | 152098350 | ZNF185 | ABCD1 |
| ENST00000324823.6 | 5205 | 152082986 | 152142024 | + | seg_607 | 152096400 | 152098350 | ZNF185 | ABCD1 |
| ENST00000426821.1 | 5206 | 152087545 | 152142017 | + | seg_607 | 152096400 | 152098350 | ZNF185 | ABCD1 |
| ENST00000447792.1 | 5207 | 152089251 | 152106707 | + | seg_607 | 152096400 | 152098350 | ZNF185 | ABCD1 |
| ENST00000449285.2 | 5208 | 152082986 | 152142024 | + | seg_607 | 152096400 | 152098350 | ZNF185 | ABCD1 |
| ENST00000318529.8 | 5209 | 152086409 | 152142024 | + | seg_607 | 152096400 | 152098350 | ZNF185 | ABCD1 |
| ENST00000535861.1 | 5210 | 152082986 | 152142024 | + | seg_607 | 152096400 | 152098350 | ZNF185 | ABCD1 |
| ENST00000433245.2 | 5211 | 152082986 | 152128407 | + | seg_607 | 152096400 | 152098350 | ZNF185 | ABCD1 |
| ENST00000370268.4 | 5212 | 152082997 | 152142015 | + | seg_607 | 152096400 | 152098350 | ZNF185 | ABCD1 |
| ENST00000535156.1 | 5213 | 152082986 | 152142024 | + | seg_608 | 152101500 | 152102750 | ZNF185 | ABCD1 |
| ENST00000539731.1 | 5214 | 152082986 | 152142024 | + | seg_608 | 152101500 | 152102750 | ZNF185 | ABCD1 |
| ENST00000447088.1 | 5215 | 152088893 | 152106707 | + | seg_608 | 152101500 | 152102750 | ZNF185 | ABCD1 |
| ENST00000318504.7 | 5216 | 152082986 | 152142024 | + | seg_608 | 152101500 | 152102750 | ZNF185 | ABCD1 |
| ENST00000436731.1 | 5217 | 152100283 | 152128354 | + | seg_608 | 152101500 | 152102750 | ZNF185 | ABCD1 |
| ENST00000370270.1 | 5218 | 152086665 | 152142025 | + | seg_608 | 152101500 | 152102750 | ZNF185 | ABCD1 |
| ENST00000324823.6 | 5219 | 152082986 | 152142024 | + | seg_608 | 152101500 | 152102750 | ZNF185 | ABCD1 |
| ENST00000426821.1 | 5220 | 152087545 | 152142017 | + | seg_608 | 152101500 | 152102750 | ZNF185 | ABCD1 |
| ENST00000447792.1 | 5221 | 152089251 | 152106707 | + | seg_608 | 152101500 | 152102750 | ZNF185 | ABCD1 |
| ENST00000449285.2 | 5222 | 152082986 | 152142024 | + | seg_608 | 152101500 | 152102750 | ZNF185 | ABCD1 |
| ENST00000318529.8 | 5223 | 152086409 | 152142024 | + | seg_608 | 152101500 | 152102750 | ZNF185 | ABCD1 |
| ENST00000535861.1 | 5224 | 152082986 | 152142024 | + | seg_608 | 152101500 | 152102750 | ZNF185 | ABCD1 |
| ENST00000433245.2 | 5225 | 152082986 | 152128407 | + | seg_608 | 152101500 | 152102750 | ZNF185 | ABCD1 |
| ENST00000370268.4 | 5226 | 152082997 | 152142015 | + | seg_608 | 152101500 | 152102750 | ZNF185 | ABCD1 |
| ENST00000456193.1 | 5227 | 152387940 | 152393740 | − | seg_612 | 152392250 | 152393600 | PNMA6B | ABCD1 |
| ENST00000415779.1 | 5228 | 152537078 | 152543256 | − | seg_614 | 152530950 | 152538400 | MAGEA1 | ABCD1 |
| ENST00000427876.1 | 5229 | 152663209 | 152664240 | − | seg_616 | 152662500 | 152664500 | ZFP92 | ABCD1 |
| ENST00000445091.1 | 5230 | 152662421 | 152664307 | − | seg_616 | 152662500 | 152664500 | ZFP92 | ABCD1 |
| ENST00000431891.2 | 5231 | 152760451 | 152772084 | + | seg_618 | 152757650 | 152760600 | U82695.9 | ABCD1 |
| ENST00000331595.4 | 5232 | 152760397 | 152775012 | + | seg_618 | 152757650 | 152760600 | U82695.9 | ABCD1 |
| ENST00000480756.1 | 5233 | 152760441 | 152775004 | + | seg_618 | 152757650 | 152760600 | U82695.9 | ABCD1 |
| ENST00000421080.2 | 5234 | 152713128 | 152760978 | − | seg_618 | 152757650 | 152760600 | U82695.9 | ABCD1 |
| ENST00000431270.2 | 5235 | 152760411 | 152773996 | + | seg_618 | 152757650 | 152760600 | U82695.9 | ABCD1 |
| ENST00000453918.2 | 5236 | 152721747 | 152760940 | − | seg_618 | 152757650 | 152760600 | U82695.9 | ABCD1 |
| ENST00000472615.1 | 5237 | 152760439 | 152775004 | + | seg_618 | 152757650 | 152760600 | U82695.9 | ABCD1 |
| ENST00000370210.1 | 5238 | 152727018 | 152760974 | − | seg_618 | 152757650 | 152760600 | U82695.9 | ABCD1 |
| ENST00000418899.2 | 5239 | 152770145 | 152774295 | + | seg_619 | 152773950 | 152775950 | BGN | ABCD1 |
| ENST00000492658.1 | 5240 | 152771327 | 152774263 | + | seg_619 | 152773950 | 152775950 | BGN | ABCD1 |
| ENST00000370204.1 | 5241 | 152767902 | 152775004 | + | seg_619 | 152773950 | 152775950 | BGN | ABCD1 |
| ENST00000430380.2 | 5242 | 152767902 | 152774998 | + | seg_619 | 152773950 | 152775950 | BGN | ABCD1 |
| ENST00000331595.4 | 5243 | 152760397 | 152775012 | + | seg_619 | 152773950 | 152775950 | BGN | ABCD1 |
| ENST00000480756.1 | 5244 | 152760441 | 152775004 | + | seg_619 | 152773950 | 152775950 | BGN | ABCD1 |
| ENST00000431270.2 | 5245 | 152760411 | 152773996 | + | seg_619 | 152773950 | 152775950 | BGN | ABCD1 |
| ENST00000472615.1 | 5246 | 152760439 | 152775004 | + | seg_619 | 152773950 | 152775950 | BGN | ABCD1 |
| ENST00000349466.2 | 5247 | 152783134 | 152846047 | + | seg_620 | 152789000 | 152790950 | ATP2B3 | ABCD1 |
| ENST00000370186.1 | 5248 | 152783134 | 152848397 | + | seg_620 | 152789000 | 152790950 | ATP2B3 | ABCD1 |
| ENST00000349466.2 | 5249 | 152783134 | 152846047 | + | seg_621 | 152792050 | 152797450 | ATP2B3 | ABCD1 |
| ENST00000370186.1 | 5250 | 152783134 | 152848397 | + | seg_621 | 152792050 | 152797450 | ATP2B3 | ABCD1 |
| ENST00000263519.4 | 5251 | 152801580 | 152848387 | + | seg_622 | 152801800 | 152804350 | ATP2B3 | ABCD1 |
| ENST00000349466.2 | 5252 | 152783134 | 152846047 | + | seg_622 | 152801800 | 152804350 | ATP2B3 | ABCD1 |
| ENST00000359149.3 | 5253 | 152801580 | 152846047 | + | seg_622 | 152801800 | 152804350 | ATP2B3 | ABCD1 |
| ENST00000370181.2 | 5254 | 152801580 | 152848387 | + | seg_622 | 152801800 | 152804350 | ATP2B3 | ABCD1 |
| ENST00000393842.1 | 5255 | 152798392 | 152835420 | + | seg_622 | 152801800 | 152804350 | ATP2B3 | ABCD1 |
| ENST00000370186.1 | 5256 | 152783134 | 152848397 | + | seg_622 | 152801800 | 152804350 | ATP2B3 | ABCD1 |
| ENST00000263519.4 | 5257 | 152801580 | 152848387 | + | seg_623 | 152811300 | 152813150 | ATP2B3 | ABCD1 |
| ENST00000349466.2 | 5258 | 152783134 | 152846047 | + | seg_623 | 152811300 | 152813150 | ATP2B3 | ABCD1 |
| ENST00000359149.3 | 5259 | 152801580 | 152846047 | + | seg_623 | 152811300 | 152813150 | ATP2B3 | ABCD1 |
| ENST00000370181.2 | 5260 | 152801580 | 152848387 | + | seg_623 | 152811300 | 152813150 | ATP2B3 | ABCD1 |
| ENST00000393842.1 | 5261 | 152798392 | 152835420 | + | seg_623 | 152811300 | 152813150 | ATP2B3 | ABCD1 |
| ENST00000370186.1 | 5262 | 152783134 | 152848397 | + | seg_623 | 152811300 | 152813150 | ATP2B3 | ABCD1 |
| ENST00000263519.4 | 5263 | 152801580 | 152848387 | + | seg_624 | 152815500 | 152817200 | ATP2B3 | ABCD1 |
| ENST00000349466.2 | 5264 | 152783134 | 152846047 | + | seg_624 | 152815500 | 152817200 | ATP2B3 | ABCD1 |
| ENST00000359149.3 | 5265 | 152801580 | 152846047 | + | seg_624 | 152815500 | 152817200 | ATP2B3 | ABCD1 |
| ENST00000370181.2 | 5266 | 152801580 | 152848387 | + | seg_624 | 152815500 | 152817200 | ATP2B3 | ABCD1 |
| ENST00000393842.1 | 5267 | 152798392 | 152835420 | + | seg_624 | 152815500 | 152817200 | ATP2B3 | ABCD1 |
| ENST00000370186.1 | 5268 | 152783134 | 152848397 | + | seg_624 | 152815500 | 152817200 | ATP2B3 | ABCD1 |
| ENST00000460549.1 | 5269 | 152822404 | 152826282 | + | seg_625 | 152818800 | 152828200 | ATP2B3 | ABCD1 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000263519.4 | 5270 | 152801580 | 152848387 | + | seg_625 | 152818800 | 152828200 | ATP2B3 | ABCD1 |
| ENST00000349466.2 | 5271 | 152783134 | 152846047 | + | seg_625 | 152818800 | 152828200 | ATP2B3 | ABCD1 |
| ENST00000359149.3 | 5272 | 152801580 | 152846047 | + | seg_625 | 152818800 | 152828200 | ATP2B3 | ABCD1 |
| ENST00000370181.2 | 5273 | 152801580 | 152848387 | + | seg_625 | 152818800 | 152828200 | ATP2B3 | ABCD1 |
| ENST00000393842.1 | 5274 | 152798392 | 152835420 | + | seg_625 | 152818800 | 152828200 | ATP2B3 | ABCD1 |
| ENST00000370186.1 | 5275 | 152783134 | 152848397 | + | seg_625 | 152818800 | 152828200 | ATP2B3 | ABCD1 |
| ENST00000496610.1 | 5276 | 152835106 | 152846027 | + | seg_626 | 152831650 | 152837100 | FAM58A | ABCD1 |
| ENST00000263519.4 | 5277 | 152801580 | 152848387 | + | seg_626 | 152831650 | 152837100 | FAM58A | ABCD1 |
| ENST00000349466.2 | 5278 | 152783134 | 152846047 | + | seg_626 | 152831650 | 152837100 | FAM58A | ABCD1 |
| ENST00000359149.3 | 5279 | 152801580 | 152846047 | + | seg_626 | 152831650 | 152837100 | FAM58A | ABCD1 |
| ENST00000370181.2 | 5280 | 152801580 | 152848387 | + | seg_626 | 152831650 | 152837100 | FAM58A | ABCD1 |
| ENST00000393842.1 | 5281 | 152798392 | 152835420 | + | seg_626 | 152831650 | 152837100 | FAM58A | ABCD1 |
| ENST00000370186.1 | 5282 | 152783134 | 152848397 | + | seg_626 | 152831650 | 152837100 | FAM58A | ABCD1 |
| ENST00000496610.1 | 5283 | 152835106 | 152846027 | + | seg_627 | 152839000 | 152842300 | FAM58A | ABCD1 |
| ENST00000263519.4 | 5284 | 152801580 | 152848387 | + | seg_627 | 152839000 | 152842300 | FAM58A | ABCD1 |
| ENST00000349466.2 | 5285 | 152783134 | 152846047 | + | seg_627 | 152839000 | 152842300 | FAM58A | ABCD1 |
| ENST00000359149.3 | 5286 | 152801580 | 152846047 | + | seg_627 | 152839000 | 152842300 | FAM58A | ABCD1 |
| ENST00000370181.2 | 5287 | 152801580 | 152848387 | + | seg_627 | 152839000 | 152842300 | FAM58A | ABCD1 |
| ENST00000370186.1 | 5288 | 152783134 | 152848397 | + | seg_627 | 152839000 | 152842300 | FAM58A | ABCD1 |
| ENST00000406288.2 | 5289 | 152871972 | 152872343 | + | seg_628 | 152870900 | 152872850 | FAM58A | ABCD1 |
| ENST00000446370.1 | 5290 | 152876149 | 152878380 | + | seg_629 | 152875300 | 152879100 | FAM58A | ABCD1 |
| ENST00000477033.1 | 5291 | 152907946 | 152913467 | + | seg_634 | 152908450 | 152909650 | DUSP9 | ABCD1 |
| ENST00000370167.4 | 5292 | 152907988 | 152916781 | + | seg_634 | 152908450 | 152909650 | DUSP9 | ABCD1 |
| ENST00000433144.1 | 5293 | 152908932 | 152916777 | + | seg_634 | 152908450 | 152909650 | DUSP9 | ABCD1 |
| ENST00000537633.1 | 5294 | 153069624 | 153073873 | − | seg_635 | 153070100 | 153072100 | PDZD4 | L1CAM |
| ENST00000484792.1 | 5295 | 153070334 | 153073594 | − | seg_635 | 153070100 | 153072100 | PDZD4 | L1CAM |
| ENST00000480418.1 | 5296 | 153071037 | 153096020 | − | seg_635 | 153070100 | 153072100 | PDZD4 | L1CAM |
| ENST00000164640.4 | 5297 | 153067621 | 153095945 | − | seg_635 | 153070100 | 153072100 | PDZD4 | L1CAM |
| ENST00000544474.1 | 5298 | 153068742 | 153095813 | − | seg_635 | 153070100 | 153072100 | PDZD4 | L1CAM |
| ENST00000483693.1 | 5299 | 153071000 | 153095598 | − | seg_635 | 153070100 | 153072100 | PDZD4 | L1CAM |
| ENST00000393758.2 | 5300 | 153067623 | 153095351 | − | seg_635 | 153070100 | 153072100 | PDZD4 | L1CAM |
| ENST00000475140.1 | 5301 | 153070548 | 153095311 | − | seg_635 | 153070100 | 153072100 | PDZD4 | L1CAM |
| ENST00000468491.1 | 5302 | 153072782 | 153095125 | − | seg_636 | 153075150 | 153076450 | PDZD4 | L1CAM |
| ENST00000480418.1 | 5303 | 153071037 | 153096020 | − | seg_636 | 153075150 | 153076450 | PDZD4 | L1CAM |
| ENST00000480650.1 | 5304 | 153073438 | 153095792 | − | seg_636 | 153075150 | 153076450 | PDZD4 | L1CAM |
| ENST00000164640.4 | 5305 | 153067621 | 153095945 | − | seg_636 | 153075150 | 153076450 | PDZD4 | L1CAM |
| ENST00000544474.1 | 5306 | 153068742 | 153095813 | − | seg_636 | 153075150 | 153076450 | PDZD4 | L1CAM |
| ENST00000483693.1 | 5307 | 153071000 | 153095598 | − | seg_636 | 153075150 | 153076450 | PDZD4 | L1CAM |
| ENST00000393758.2 | 5308 | 153067623 | 153095351 | − | seg_636 | 153075150 | 153076450 | PDZD4 | L1CAM |
| ENST00000475140.1 | 5309 | 153070548 | 153095311 | − | seg_636 | 153075150 | 153076450 | PDZD4 | L1CAM |
| ENST00000468491.1 | 5310 | 153072782 | 153095125 | − | seg_637 | 153078150 | 153079950 | PDZD4 | L1CAM |
| ENST00000480418.1 | 5311 | 153071037 | 153096020 | − | seg_637 | 153078150 | 153079950 | PDZD4 | L1CAM |
| ENST00000480650.1 | 5312 | 153073438 | 153095792 | − | seg_637 | 153078150 | 153079950 | PDZD4 | L1CAM |
| ENST00000164640.4 | 5313 | 153067621 | 153095945 | − | seg_637 | 153078150 | 153079950 | PDZD4 | L1CAM |
| ENST00000544474.1 | 5314 | 153068742 | 153095813 | − | seg_637 | 153078150 | 153079950 | PDZD4 | L1CAM |
| ENST00000483693.1 | 5315 | 153071000 | 153095598 | − | seg_637 | 153078150 | 153079950 | PDZD4 | L1CAM |
| ENST00000393758.2 | 5316 | 153067623 | 153095351 | − | seg_637 | 153078150 | 153079950 | PDZD4 | L1CAM |
| ENST00000475140.1 | 5317 | 153070548 | 153095311 | − | seg_637 | 153078150 | 153079950 | PDZD4 | L1CAM |
| ENST00000468491.1 | 5318 | 153072782 | 153095125 | − | seg_638 | 153089000 | 153091450 | PDZD4 | L1CAM |
| ENST00000480418.1 | 5319 | 153071037 | 153096020 | − | seg_638 | 153089000 | 153091450 | PDZD4 | L1CAM |
| ENST00000480650.1 | 5320 | 153073438 | 153095792 | − | seg_638 | 153089000 | 153091450 | PDZD4 | L1CAM |
| ENST00000164640.4 | 5321 | 153067621 | 153095945 | − | seg_638 | 153089000 | 153091450 | PDZD4 | L1CAM |
| ENST00000544474.1 | 5322 | 153068742 | 153095813 | − | seg_638 | 153089000 | 153091450 | PDZD4 | L1CAM |
| ENST00000483693.1 | 5323 | 153071000 | 153095598 | − | seg_638 | 153089000 | 153091450 | PDZD4 | L1CAM |
| ENST00000393758.2 | 5324 | 153067623 | 153095351 | − | seg_638 | 153089000 | 153091450 | PDZD4 | L1CAM |
| ENST00000475140.1 | 5325 | 153070548 | 153095311 | − | seg_638 | 153089000 | 153091450 | PDZD4 | L1CAM |
| ENST00000468491.1 | 5326 | 153072782 | 153095125 | − | seg_639 | 153093650 | 153097850 | PDZD4 | L1CAM |
| ENST00000480418.1 | 5327 | 153071037 | 153096020 | − | seg_639 | 153093650 | 153097850 | PDZD4 | L1CAM |
| ENST00000480650.1 | 5328 | 153073438 | 153095792 | − | seg_639 | 153093650 | 153097850 | PDZD4 | L1CAM |
| ENST00000164640.4 | 5329 | 153067621 | 153095945 | − | seg_639 | 153093650 | 153097850 | PDZD4 | L1CAM |
| ENST00000544474.1 | 5330 | 153068742 | 153095813 | − | seg_639 | 153093650 | 153097850 | PDZD4 | L1CAM |
| ENST00000483693.1 | 5331 | 153071000 | 153095598 | − | seg_639 | 153093650 | 153097850 | PDZD4 | L1CAM |
| ENST00000393758.2 | 5332 | 153067623 | 153095351 | − | seg_639 | 153093650 | 153097850 | PDZD4 | L1CAM |
| ENST00000475140.1 | 5333 | 153070548 | 153095311 | − | seg_639 | 153093650 | 153097850 | PDZD4 | L1CAM |
| ENST00000370058.3 | 5334 | 153127888 | 153129933 | − | seg_640 | 153123550 | 153131800 | L1CAM | L1CAM |
| ENST00000491983.1 | 5335 | 153128247 | 153129424 | − | seg_640 | 153123550 | 153131800 | L1CAM | L1CAM |
| ENST00000474853.1 | 5336 | 153130419 | 153131370 | − | seg_640 | 153123550 | 153131800 | L1CAM | L1CAM |
| ENST00000370055.1 | 5337 | 153127408 | 153151608 | − | seg_640 | 153123550 | 153131800 | L1CAM | L1CAM |
| ENST00000370057.3 | 5338 | 153126973 | 153141399 | − | seg_640 | 153123550 | 153131800 | L1CAM | L1CAM |
| ENST00000361699.4 | 5339 | 153128003 | 153141302 | − | seg_640 | 153123550 | 153131800 | L1CAM | L1CAM |
| ENST00000540065.1 | 5340 | 153126995 | 153151569 | − | seg_640 | 153123550 | 153131800 | L1CAM | L1CAM |
| ENST00000361981.3 | 5341 | 153126973 | 153141399 | − | seg_640 | 153123550 | 153131800 | L1CAM | L1CAM |
| ENST00000538883.1 | 5342 | 153126973 | 153141399 | − | seg_640 | 153123550 | 153131800 | L1CAM | L1CAM |
| ENST00000370060.1 | 5343 | 153126969 | 153151600 | − | seg_640 | 153123550 | 153131800 | L1CAM | L1CAM |
| ENST00000543994.1 | 5344 | 153126973 | 153141399 | − | seg_640 | 153123550 | 153131800 | L1CAM | L1CAM |
| ENST00000455590.1 | 5345 | 153132227 | 153133832 | − | seg_641 | 153133350 | 153135150 | L1CAM | L1CAM |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000484652.1 | 5346 | 153133862 | 153134627 | − | seg_641 | 153133350 | 153135150 | L1CAM | L1CAM |
| ENST00000496122.1 | 5347 | 153133006 | 153134078 | − | seg_641 | 153133350 | 153135150 | L1CAM | L1CAM |
| ENST00000370055.1 | 5348 | 153127408 | 153151608 | − | seg_641 | 153133350 | 153135150 | L1CAM | L1CAM |
| ENST00000370057.3 | 5349 | 153126973 | 153141399 | − | seg_641 | 153133350 | 153135150 | L1CAM | L1CAM |
| ENST00000361699.4 | 5350 | 153128003 | 153141302 | − | seg_641 | 153133350 | 153135150 | L1CAM | L1CAM |
| ENST00000540065.1 | 5351 | 153126995 | 153151569 | − | seg_641 | 153133350 | 153135150 | L1CAM | L1CAM |
| ENST00000361981.3 | 5352 | 153126973 | 153141399 | − | seg_641 | 153133350 | 153135150 | L1CAM | L1CAM |
| ENST00000538883.1 | 5353 | 153126973 | 153141399 | − | seg_641 | 153133350 | 153135150 | L1CAM | L1CAM |
| ENST00000370060.1 | 5354 | 153126969 | 153151600 | − | seg_641 | 153133350 | 153135150 | L1CAM | L1CAM |
| ENST00000543994.1 | 5355 | 153126973 | 153141399 | − | seg_641 | 153133350 | 153135150 | L1CAM | L1CAM |
| ENST00000357566.1 | 5356 | 153146127 | 153154425 | + | seg_642 | 153150200 | 153151550 | LCA10 | L1CAM |
| ENST00000484587.1 | 5357 | 153149319 | 153151615 | − | seg_642 | 153150200 | 153151550 | LCA10 | L1CAM |
| ENST00000452593.1 | 5358 | 153146127 | 153154444 | + | seg_642 | 153150200 | 153151550 | LCA10 | L1CAM |
| ENST00000370055.1 | 5359 | 153127408 | 153151608 | − | seg_642 | 153150200 | 153151550 | LCA10 | L1CAM |
| ENST00000540065.1 | 5360 | 153126995 | 153151569 | − | seg_642 | 153150200 | 153151550 | LCA10 | L1CAM |
| ENST00000460553.1 | 5361 | 153138404 | 153151596 | − | seg_642 | 153150200 | 153151550 | LCA10 | L1CAM |
| ENST00000464967.1 | 5362 | 153137676 | 153174677 | − | seg_642 | 153150200 | 153151550 | LCA10 | L1CAM |
| ENST00000420165.1 | 5363 | 153137722 | 153151627 | − | seg_642 | 153150200 | 153151550 | LCA10 | L1CAM |
| ENST00000370060.1 | 5364 | 153126969 | 153151600 | − | seg_642 | 153150200 | 153151550 | LCA10 | L1CAM |
| ENST00000464967.1 | 5365 | 153137676 | 153174677 | − | seg_643 | 153157550 | 153159050 | LCA10 | AVPR2 |
| ENST00000370011.3 | 5366 | 153195658 | 153200468 | − | seg_644 | 153199600 | 153200600 | NAA10 | AVPR2 |
| ENST00000545734.1 | 5367 | 153195383 | 153200462 | − | seg_644 | 153199600 | 153200600 | NAA10 | AVPR2 |
| ENST00000432089.1 | 5368 | 153196232 | 153200519 | − | seg_644 | 153199600 | 153200600 | NAA10 | AVPR2 |
| ENST00000466877.1 | 5369 | 153195379 | 153200468 | − | seg_644 | 153199600 | 153200600 | NAA10 | AVPR2 |
| ENST00000393710.3 | 5370 | 153197407 | 153200468 | − | seg_644 | 153199600 | 153200600 | NAA10 | AVPR2 |
| ENST00000464845.1 | 5371 | 153194695 | 153200676 | − | seg_644 | 153199600 | 153200600 | NAA10 | AVPR2 |
| ENST00000460996.1 | 5372 | 153195529 | 153200238 | − | seg_644 | 153199600 | 153200600 | NAA10 | AVPR2 |
| ENST00000477750.1 | 5373 | 153197224 | 153200533 | − | seg_644 | 153199600 | 153200600 | NAA10 | AVPR2 |
| ENST00000393712.3 | 5374 | 153195374 | 153200411 | − | seg_644 | 153199600 | 153200600 | NAA10 | AVPR2 |
| ENST00000370015.4 | 5375 | 153195367 | 153200494 | − | seg_644 | 153199600 | 153200600 | NAA10 | AVPR2 |
| ENST00000478177.1 | 5376 | 153199113 | 153200468 | − | seg_644 | 153199600 | 153200600 | NAA10 | AVPR2 |
| ENST00000370009.1 | 5377 | 153195377 | 153200468 | − | seg_644 | 153199600 | 153200600 | NAA10 | AVPR2 |
| ENST00000488481.1 | 5378 | 153199483 | 153200459 | − | seg_644 | 153199600 | 153200600 | NAA10 | AVPR2 |
| ENST00000494813.1 | 5379 | 153178664 | 153200452 | − | seg_644 | 153199600 | 153200600 | NAA10 | AVPR2 |
| ENST00000369951.4 | 5380 | 153409698 | 153424507 | + | seg_646 | 153409000 | 153412050 | OPN1LW | OPN1MW |
| ENST00000463296.1 | 5381 | 153409748 | 153421872 | + | seg_646 | 153409000 | 153412050 | OPN1LW | OPN1MW |
| ENST00000369941.4 | 5382 | 153424682 | 153445634 | − | seg_647 | 153423450 | 153426400 | OPN1LW | OPN1MW |
| ENST00000369951.4 | 5383 | 153409698 | 153424507 | + | seg_647 | 153423450 | 153426400 | OPN1LW | OPN1MW |
| ENST00000442922.1 | 5384 | 153418415 | 153424498 | + | seg_647 | 153423450 | 153426400 | OPN1LW | OPN1MW |
| ENST00000369941.4 | 5385 | 153424682 | 153445634 | − | seg_648 | 153438400 | 153439900 | TEX28P2 | OPN1MW |
| ENST00000468495.1 | 5386 | 153448157 | 153459002 | + | seg_649 | 153447400 | 153449250 | OPN1MW | OPN1MW |
| ENST00000369935.5 | 5387 | 153448107 | 153461633 | + | seg_649 | 153447400 | 153449250 | OPN1MW | OPN1MW |
| ENST00000430054.1 | 5388 | 153455547 | 153461628 | + | seg_650 | 153454750 | 153456450 | OPN1MW | OPN1MW |
| ENST00000468495.1 | 5389 | 153448157 | 153459002 | + | seg_650 | 153454750 | 153456450 | OPN1MW | OPN1MW |
| ENST00000369935.5 | 5390 | 153448107 | 153461633 | + | seg_650 | 153454750 | 153456450 | OPN1MW | OPN1MW |
| ENST00000430054.1 | 5391 | 153455547 | 153461628 | + | seg_651 | 153460750 | 153463050 | OPN1MW | OPN1MW |
| ENST00000369935.5 | 5392 | 153448107 | 153461633 | + | seg_651 | 153460750 | 153463050 | OPN1MW | OPN1MW |
| ENST00000369932.3 | 5393 | 153461812 | 153482755 | − | seg_651 | 153460750 | 153463050 | OPN1MW | OPN1MW |
| ENST00000369932.3 | 5394 | 153461812 | 153482755 | − | seg_652 | 153477600 | 153479200 | TEX28P1 | OPN1MW |
| ENST00000369932.3 | 5395 | 153461812 | 153482755 | − | seg_653 | 153481700 | 153485800 | TEX28P1 | OPN1MW |
| ENST00000488220.1 | 5396 | 153485266 | 153496120 | + | seg_653 | 153481700 | 153485800 | TEX28P1 | OPN1MW |
| ENST00000369929.4 | 5397 | 153485225 | 153498755 | + | seg_653 | 153481700 | 153485800 | TEX28P1 | OPN1MW |
| ENST00000430419.1 | 5398 | 153492665 | 153498746 | + | seg_654 | 153498150 | 153500900 | OPN1MW2 | OPN1MW |
| ENST00000361930.3 | 5399 | 153498932 | 153523462 | − | seg_654 | 153498150 | 153500900 | OPN1MW2 | OPN1MW |
| ENST00000369926.1 | 5400 | 153498930 | 153523564 | − | seg_654 | 153498150 | 153500900 | OPN1MW2 | OPN1MW |
| ENST00000369929.4 | 5401 | 153485225 | 153498755 | + | seg_654 | 153498150 | 153500900 | OPN1MW2 | OPN1MW |
| ENST00000217905.7 | 5402 | 153524152 | 153558076 | + | seg_655 | 153551150 | 153553600 | TKTL1 | EMD |
| ENST00000441970.3 | 5403 | 153524027 | 153558713 | + | seg_655 | 153551150 | 153553600 | TKTL1 | EMD |
| ENST00000369915.3 | 5404 | 153524024 | 153558700 | + | seg_655 | 153551150 | 153553600 | TKTL1 | EMD |
| ENST00000465168.1 | 5405 | 153548651 | 153553731 | + | seg_655 | 153551150 | 153553600 | TKTL1 | EMD |
| ENST00000369912.2 | 5406 | 153533409 | 153558700 | + | seg_655 | 153551150 | 153553600 | TKTL1 | EMD |
| ENST00000433825.1 | 5407 | 153562310 | 153563387 | − | seg_657 | 153563100 | 153564150 | FLNA | EMD |
| ENST00000474786.1 | 5408 | 153618315 | 153628507 | + | seg_659 | 153617900 | 153619700 | RPL10 | EMD |
| ENST00000455739.2 | 5409 | 155227361 | 155237484 | + | seg_663 | 155235050 | 155236450 | IL9R | F8 |
| ENST00000494962.1 | 5410 | 155235779 | 155237711 | + | seg_663 | 155235050 | 155236450 | IL9R | F8 |
| ENST00000424344.3 | 5411 | 155227246 | 155240482 | + | seg_663 | 155235050 | 155236450 | IL9R | F8 |
| ENST00000244174.5 | 5412 | 155227246 | 155240273 | + | seg_663 | 155235050 | 155236450 | IL9R | F8 |
| ENST00000540897.1 | 5413 | 155227371 | 155240482 | + | seg_663 | 155235050 | 155236450 | IL9R | F8 |
| ENST00000369423.2 | 5414 | 155227371 | 155240482 | + | seg_663 | 155235050 | 155236450 | IL9R | F8 |
| ENST00000483543.1 | 5415 | 155233883 | 155251689 | + | seg_663 | 155235050 | 155236450 | IL9R | F8 |
| ENST00000399966.4 | 5416 | 155244288 | 155246502 | − | seg_664 | 155245550 | 155247000 | WASH6P | F8 |
| ENST00000483543.1 | 5417 | 155233883 | 155251689 | + | seg_664 | 155245550 | 155247000 | WASH6P | F8 |
| ENST00000482170.1 | 5418 | 155251664 | 155253054 | + | seg_665 | 155253000 | 155254000 | WASH6P | F8 |
| ENST00000483079.1 | 5419 | 155252451 | 155253196 | + | seg_665 | 155253000 | 155254000 | WASH6P | F8 |
| ENST00000484415.1 | 5420 | 155251664 | 155255328 | + | seg_665 | 155253000 | 155254000 | WASH6P | F8 |
| ENST00000492963.1 | 5421 | 155251353 | 155255331 | + | seg_665 | 155253000 | 155254000 | WASH6P | F8 |

TABLE XVII-continued paRNAs associated with SUZ12 STRONG sites in K562 cells

| Transcript ID | SIN | Start | Stop | Strand | Suz12 ID | Suz12 Start | Suz12 End | Closest gene | disease gene |
|---|---|---|---|---|---|---|---|---|---|
| ENST00000496301.1 | 5422 | 155253032 | 155255331 | + | seg_665 | 155253000 | 155254000 | WASH6P | F8 |
| ENST00000359512.2 | 5423 | 155249967 | 155255327 | + | seg_665 | 155253000 | 155254000 | WASH6P | F8 |
| ENST00000461007.1 | 5424 | 155250993 | 155255328 | + | seg_665 | 155253000 | 155254000 | WASH6P | F8 |
| ENST00000460206.1 | 5425 | 155251353 | 155255375 | + | seg_665 | 155253000 | 155254000 | WASH6P | F8 |
| ENST00000483286.1 | 5426 | 155253489 | 155255219 | + | seg_665 | 155253000 | 155254000 | WASH6P | F8 |
| ENST00000464205.1 | 5427 | 155253736 | 155255219 | + | seg_665 | 155253000 | 155254000 | WASH6P | F8 |
| ENST00000285718.7 | 5428 | 155250706 | 155255299 | + | seg_665 | 155253000 | 155254000 | WASH6P | F8 |
| ENST00000340131.7 | 5429 | 155251353 | 155255331 | + | seg_665 | 155253000 | 155254000 | WASH6P | F8 |

TABLE XVIII

Table XVIII lists the 503 paRNAs associated with strong EZH2 sites in GM12878 cells. Coordinates in reference to hg19 assembly.

paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000390665.3 | 5430 | 294698 | 347445 | − | seg_1 | 334650 | 336100 | PPP2R3B | OA1 = GPR143 |
| ENST00000445792.2 | 5431 | 305631 | 347690 | − | seg_1 | 334650 | 336100 | PPP2R3B | OA1 = GPR143 |
| ENST00000381625.4 | 5432 | 308346 | 334779 | − | seg_1 | 334650 | 336100 | PPP2R3B | OA1 = GPR143 |
| ENST00000381567.3 | 5433 | 1314890 | 1331527 | − | seg_2 | 1330550 | 1331800 | CRLF2 | OA1 = GPR143 |
| ENST00000400841.2 | 5434 | 1314894 | 1331530 | − | seg_2 | 1330550 | 1331800 | CRLF2 | OA1 = GPR143 |
| ENST00000467626.1 | 5435 | 1314894 | 1331616 | − | seg_2 | 1330550 | 1331800 | CRLF2 | OA1 = GPR143 |
| ENST00000381566.1 | 5436 | 1317790 | 1331527 | − | seg_2 | 1330550 | 1331800 | CRLF2 | OA1 = GPR143 |
| ENST00000381297.4 | 5437 | 1581465 | 1656000 | − | seg_3 | 1610000 | 1611450 | P2RY8 | OA1 = GPR143 |
| ENST00000381297.4 | 5438 | 1581465 | 1656000 | − | seg_4 | 1639800 | 1641400 | P2RY8 | OA1 = GPR143 |
| ENST00000460672.1 | 5439 | 1585330 | 1613246 | − | seg_3 | 1610000 | 1611450 | P2RY8 | OA1 = GPR143 |
| ENST00000381174.5 | 5440 | 2670091 | 2733968 | + | seg_6 | 2730100 | 2731700 | GYG2 | OA1 = GPR143 |
| ENST00000419513.2 | 5441 | 2670093 | 2732589 | + | seg_6 | 2730100 | 2731700 | GYG2 | OA1 = GPR143 |
| ENST00000426774.1 | 5442 | 2670093 | 2734539 | + | seg_6 | 2730100 | 2731700 | GYG2 | OA1 = GPR143 |
| ENST00000533923.2 | 5443 | 2670231 | 2732581 | + | seg_6 | 2730100 | 2731700 | GYG2 | OA1 = GPR143 |
| ENST00000381077.5 | 5444 | 6966961 | 7066231 | − | seg_8 | 7001450 | 7003250 | HDHD1 | OA1 = GPR143 |
| ENST00000544385.1 | 5445 | 6966961 | 7066231 | − | seg_8 | 7001450 | 7003250 | HDHD1 | OA1 = GPR143 |
| ENST00000412827.2 | 5446 | 6967559 | 7066194 | − | seg_8 | 7001450 | 7003250 | HDHD1 | OA1 = GPR143 |
| ENST00000424830.2 | 5447 | 6967804 | 7066199 | − | seg_8 | 7001450 | 7003250 | HDHD1 | OA1 = GPR143 |
| ENST00000540122.1 | 5448 | 6975627 | 7066231 | − | seg_8 | 7001450 | 7003250 | HDHD1 | OA1 = GPR143 |
| ENST00000486446.2 | 5449 | 6975801 | 7066166 | − | seg_8 | 7001450 | 7003250 | HDHD1 | OA1 = GPR143 |
| ENST00000498474.2 | 5450 | 7002792 | 7066193 | − | seg_8 | 7001450 | 7003250 | HDHD1 | OA1 = GPR143 |
| ENST00000217961.4 | 5451 | 7137497 | 7272851 | + | seg_10 | 7247600 | 7248900 | STS | OA1 = GPR143 |
| ENST00000380913.3 | 5452 | 9754496 | 9917483 | + | seg_14 | 9754800 | 9756400 | SHROOM2 | OA1 = GPR143 |
| ENST00000380833.4 | 5453 | 10125024 | 10205700 | + | seg_15 | 10123700 | 10128400 | CLCN4 | OA1 = GPR143 |
| ENST00000380829.1 | 5454 | 10126488 | 10201737 | + | seg_15 | 10123700 | 10128400 | CLCN4 | OA1 = GPR143 |
| ENST00000421085.2 | 5455 | 10126540 | 10201760 | + | seg_15 | 10123700 | 10128400 | CLCN4 | OA1 = GPR143 |
| ENST00000454850.1 | 5456 | 10126572 | 10174759 | + | seg_15 | 10123700 | 10128400 | CLCN4 | OA1 = GPR143 |
| ENST00000317552.4 | 5457 | 10413350 | 10588674 | − | seg_16 | 10587050 | 10589450 | MID1 | OA1 = GPR143 |
| ENST00000453318.2 | 5458 | 10413350 | 10645779 | − | seg_16 | 10587050 | 10589450 | MID1 | OA1 = GPR143 |
| ENST00000380782.1 | 5459 | 10413596 | 10588459 | − | seg_16 | 10587050 | 10589450 | MID1 | OA1 = GPR143 |
| ENST00000380785.1 | 5460 | 10413596 | 10851762 | − | seg_16 | 10587050 | 10589450 | MID1 | OA1 = GPR143 |
| ENST00000380787.1 | 5461 | 10413596 | 10851773 | − | seg_16 | 10587050 | 10589450 | MID1 | OA1 = GPR143 |
| ENST00000413894.1 | 5462 | 10423115 | 10645727 | − | seg_16 | 10587050 | 10589450 | MID1 | OA1 = GPR143 |
| ENST00000423614.1 | 5463 | 10534995 | 10588625 | − | seg_16 | 10587050 | 10589450 | MID1 | OA1 = GPR143 |
| ENST00000312196.4 | 5464 | 11776278 | 11793870 | + | seg_17 | 11777450 | 11778850 | MSL3 | SEDL = TRAPPC2 |
| ENST00000337339.2 | 5465 | 11776356 | 11786096 | + | seg_17 | 11777450 | 11778850 | MSL3 | SEDL = TRAPPC2 |
| ENST00000468149.1 | 5466 | 11776372 | 11793350 | + | seg_17 | 11777450 | 11778850 | MSL3 | SEDL = TRAPPC2 |
| ENST00000361672.2 | 5467 | 11776410 | 11793350 | + | seg_17 | 11777450 | 11778850 | MSL3 | SEDL = TRAPPC2 |
| ENST00000476743.1 | 5468 | 11776701 | 11780338 | + | seg_17 | 11777450 | 11778850 | MSL3 | SEDL = TRAPPC2 |
| ENST00000421368.2 | 5469 | 11776705 | 11781076 | + | seg_17 | 11777450 | 11778850 | MSL3 | SEDL = TRAPPC2 |
| ENST00000398527.2 | 5470 | 11776728 | 11793574 | + | seg_17 | 11777450 | 11778850 | MSL3 | SEDL = TRAPPC2 |
| ENST00000380693.3 | 5471 | 11777671 | 11793870 | + | seg_17 | 11777450 | 11778850 | MSL3 | SEDL = TRAPPC2 |
| ENST00000380692.2 | 5472 | 11777747 | 11783765 | + | seg_17 | 11777450 | 11778850 | MSL3 | SEDL = TRAPPC2 |
| ENST00000478462.1 | 5473 | 11777760 | 11779173 | + | seg_17 | 11777450 | 11778850 | MSL3 | SEDL = TRAPPC2 |
| ENST00000482871.1 | 5474 | 11778162 | 11781026 | + | seg_17 | 11777450 | 11778850 | MSL3 | SEDL = TRAPPC2 |
| ENST00000473806.1 | 5475 | 11778257 | 11779701 | + | seg_17 | 11777450 | 11778850 | MSL3 | SEDL = TRAPPC2 |
| ENST00000483645.1 | 5476 | 11778305 | 11781043 | + | seg_17 | 11777450 | 11778850 | MSL3 | SEDL = TRAPPC2 |
| ENST00000494268.1 | 5477 | 11778341 | 11782370 | + | seg_17 | 11777450 | 11778850 | MSL3 | SEDL = TRAPPC2 |
| ENST00000487782.1 | 5478 | 11778594 | 11786803 | + | seg_17 | 11777450 | 11778850 | MSL3 | SEDL = TRAPPC2 |
| ENST00000380682.1 | 5479 | 12156585 | 12742642 | + | seg_19 | 12328750 | 12329950 | FRMPD4 | SEDL = TRAPPC2 |
| ENST00000380682.1 | 5480 | 12156585 | 12742642 | + | seg_20 | 12511300 | 12512400 | PRPS2 | SEDL = TRAPPC2 |
| ENST00000380659.3 | 5481 | 12885202 | 12908499 | + | seg_23 | 12907700 | 12908700 | TLR8 | SEDL = TRAPPC2 |
| ENST00000446964.1 | 5482 | 13395307 | 13421138 | + | seg_29 | 13400400 | 13401500 | ATXN3L | SEDL = TRAPPC2 |
| ENST00000467590.1 | 5483 | 13680863 | 13700083 | + | seg_30 | 13690350 | 13691400 | TCEANC | SEDL = TRAPPC2 |
| ENST00000380550.3 | 5484 | 13752832 | 13787480 | + | seg_31 | 13769950 | 13771750 | OFD1 | OFD1 |
| ENST00000398395.3 | 5485 | 13752851 | 13771024 | + | seg_31 | 13769950 | 13771750 | OFD1 | OFD1 |
| ENST00000340096.6 | 5486 | 13752864 | 13787472 | + | seg_31 | 13769950 | 13771750 | OFD1 | OFD1 |

TABLE XVIII-continued

Table XVIII lists the 503 paRNAs associated with strong EZH2 sites in GM12878 cells. Coordinates in reference to hg19 assembly.
paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000380567.1 | 5487 | 13752864 | 13787472 | + | seg_31 | 13769950 | 13771750 | OFD1 | OFD1 |
| ENST00000490265.1 | 5488 | 13752880 | 13787472 | + | seg_31 | 13769950 | 13771750 | OFD1 | OFD1 |
| ENST00000543598.1 | 5489 | 13753017 | 13787430 | + | seg_31 | 13769950 | 13771750 | OFD1 | OFD1 |
| ENST00000454189.2 | 5490 | 13789575 | 13956757 | − | seg_32 | 13861350 | 13862450 | GPM6B | OFD1 |
| ENST00000454189.2 | 5491 | 13789575 | 13956757 | − | seg_33 | 13954750 | 13956950 | GPM6B | OFD1 |
| ENST00000398361.3 | 5492 | 13792456 | 13956534 | − | seg_32 | 13861350 | 13862450 | GPM6B | OFD1 |
| ENST00000398361.3 | 5493 | 13792456 | 13956534 | − | seg_33 | 13954750 | 13956950 | GPM6B | OFD1 |
| ENST00000493085.1 | 5494 | 13797972 | 13907176 | − | seg_32 | 13861350 | 13862450 | GPM6B | OFD1 |
| ENST00000468080.1 | 5495 | 13798027 | 13907731 | − | seg_32 | 13861350 | 13862450 | GPM6B | OFD1 |
| ENST00000380523.4 | 5496 | 14026398 | 14048011 | − | seg_34 | 14044850 | 14046750 | GEMIN8 | OFD1 |
| ENST00000398355.3 | 5497 | 14026792 | 14048012 | − | seg_34 | 14044850 | 14046750 | GEMIN8 | OFD1 |
| ENST00000332885.3 | 5498 | 14027230 | 14047734 | − | seg_34 | 14044850 | 14046750 | GEMIN8 | OFD1 |
| ENST00000477386.1 | 5499 | 14038196 | 14045263 | − | seg_34 | 14044850 | 14046750 | GEMIN8 | OFD1 |
| ENST00000297904.3 | 5500 | 15363713 | 15402498 | − | seg_37 | 15366600 | 15367950 | PIGA | PIGA |
| ENST00000421585.1 | 5501 | 15621004 | 15639607 | + | seg_38 | 15635900 | 15637200 | ACE2 | PIGA |
| ENST00000380342.3 | 5502 | 15645441 | 15683154 | − | seg_39 | 15661250 | 15663050 | TMEM27 | PIGA |
| ENST00000329235.2 | 5503 | 15843929 | 15873054 | − | seg_41 | 15870450 | 15871500 | AP1S2 | PIGA |
| ENST00000452376.1 | 5504 | 15845015 | 15870636 | − | seg_41 | 15870450 | 15871500 | AP1S2 | PIGA |
| ENST00000380291.1 | 5505 | 15848182 | 15872927 | − | seg_41 | 15870450 | 15871500 | AP1S2 | PIGA |
| ENST00000545766.1 | 5506 | 15849325 | 15872936 | − | seg_41 | 15870450 | 15871500 | AP1S2 | PIGA |
| ENST00000450644.1 | 5507 | 15849566 | 15870625 | − | seg_41 | 15870450 | 15871500 | AP1S2 | PIGA |
| ENST00000421527.2 | 5508 | 15850187 | 15872936 | − | seg_41 | 15870450 | 15871500 | AP1S2 | PIGA |
| ENST00000340245.5 | 5509 | 15858670 | 15872939 | − | seg_41 | 15870450 | 15871500 | AP1S2 | PIGA |
| ENST00000443824.1 | 5510 | 16606126 | 16730340 | − | seg_45 | 16728700 | 16730200 | SYAP1 | CC = NHS |
| ENST00000359276.4 | 5511 | 16606429 | 16730775 | − | seg_45 | 16728700 | 16730200 | SYAP1 | CC = NHS |
| ENST00000380241.3 | 5512 | 16606429 | 16731059 | − | seg_45 | 16728700 | 16730200 | SYAP1 | CC = NHS |
| ENST00000380207.1 | 5513 | 16656945 | 16731059 | − | seg_45 | 16728700 | 16730200 | SYAP1 | CC = NHS |
| ENST00000380063.2 | 5514 | 16964814 | 17167136 | + | seg_47 | 17016300 | 17017600 | REPS2 | CC = NHS |
| ENST00000380063.2 | 5515 | 16964814 | 17167136 | + | seg_48 | 17092400 | 17093800 | REPS2 | CC = NHS |
| ENST00000357277.3 | 5516 | 16964814 | 17171395 | + | seg_47 | 17016300 | 17017600 | REPS2 | CC = NHS |
| ENST00000357277.3 | 5517 | 16964814 | 17171395 | + | seg_48 | 17092400 | 17093800 | REPS2 | CC = NHS |
| ENST00000303843.7 | 5518 | 16964985 | 17171395 | + | seg_47 | 17016300 | 17017600 | REPS2 | CC = NHS |
| ENST00000303843.7 | 5519 | 16964985 | 17171395 | + | seg_48 | 17092400 | 17093800 | REPS2 | CC = NHS |
| ENST00000481792.1 | 5520 | 16965193 | 17040494 | + | seg_47 | 17016300 | 17017600 | REPS2 | CC = NHS |
| ENST00000380064.4 | 5521 | 16996667 | 17165745 | + | seg_47 | 17016300 | 17017600 | REPS2 | CC = NHS |
| ENST00000380064.4 | 5522 | 16996667 | 17165745 | + | seg_48 | 17092400 | 17093800 | REPS2 | CC = NHS |
| ENST00000469714.1 | 5523 | 17092636 | 17165752 | + | seg_48 | 17092400 | 17093800 | REPS2 | CC = NHS |
| ENST00000380060.3 | 5524 | 17393543 | 17754114 | + | seg_49 | 17395100 | 17396300 | NHS | CC = NHS |
| ENST00000380060.3 | 5525 | 17393543 | 17754114 | + | seg_50 | 17502900 | 17504050 | NHS | CC = NHS |
| ENST00000251900.4 | 5526 | 18257434 | 18372847 | − | seg_53 | 18371700 | 18372700 | SCML2 | CDKL5 |
| ENST00000442006.2 | 5527 | 18259388 | 18372806 | − | seg_53 | 18371700 | 18372700 | SCML2 | CDKL5 |
| ENST00000543067.1 | 5528 | 21392536 | 21660980 | + | seg_57 | 21392500 | 21393700 | CNKSR2 | PHEX |
| ENST00000543067.1 | 5529 | 21392536 | 21660980 | + | seg_58 | 21456000 | 21457750 | CNKSR2 | PHEX |
| ENST00000425654.2 | 5530 | 21392536 | 21672812 | + | seg_57 | 21392500 | 21393700 | CNKSR2 | PHEX |
| ENST00000425654.2 | 5531 | 21392536 | 21672812 | + | seg_58 | 21456000 | 21457750 | CNKSR2 | PHEX |
| ENST00000279451.4 | 5532 | 21392560 | 21660980 | + | seg_57 | 21392500 | 21393700 | CNKSR2 | PHEX |
| ENST00000279451.4 | 5533 | 21392560 | 21660980 | + | seg_58 | 21456000 | 21457750 | CNKSR2 | PHEX |
| ENST00000379510.3 | 5534 | 21392980 | 21672813 | + | seg_57 | 21392500 | 21393700 | CNKSR2 | PHEX |
| ENST00000379510.3 | 5535 | 21392980 | 21672813 | + | seg_58 | 21456000 | 21457750 | CNKSR2 | PHEX |
| ENST00000480138.1 | 5536 | 21450755 | 21488996 | + | seg_58 | 21456000 | 21457750 | CNKSR2 | PHEX |
| ENST00000379374.4 | 5537 | 22050559 | 22269427 | + | seg_59 | 22244450 | 22245550 | ZNF645 | PHEX |
| ENST00000537599.1 | 5538 | 22051016 | 22266300 | + | seg_59 | 22244450 | 22245550 | ZNF645 | PHEX |
| ENST00000535894.1 | 5539 | 22056171 | 22266413 | + | seg_59 | 22244450 | 22245550 | ZNF645 | PHEX |
| ENST00000418858.3 | 5540 | 22115822 | 22266209 | + | seg_59 | 22244450 | 22245550 | ZNF645 | PHEX |
| ENST00000455399.1 | 5541 | 22407432 | 23082236 | − | seg_60 | 22543750 | 22544950 | ZNF645 | PHEX |
| ENST00000253039.4 | 5542 | 24072833 | 24096088 | + | seg_62 | 24071600 | 24072950 | EIF2S3 | SAT = SAT1 |
| ENST00000427551.1 | 5543 | 24164342 | 24167771 | − | seg_63 | 24163650 | 24165150 | ZFX | SAT = SAT1 |
| ENST00000379145.2 | 5544 | 24576204 | 24690794 | − | seg_64 | 24664100 | 24665300 | PCYT1B | SAT = SAT1 |
| ENST00000356768.4 | 5545 | 24579959 | 24665275 | − | seg_64 | 24664100 | 24665300 | PCYT1B | SAT = SAT1 |
| ENST00000379144.2 | 5546 | 24579959 | 24665353 | − | seg_64 | 24664100 | 24665300 | PCYT1B | SAT = SAT1 |
| ENST00000496020.1 | 5547 | 24580518 | 24665155 | − | seg_64 | 24664100 | 24665300 | PCYT1B | SAT = SAT1 |
| ENST00000379044.4 | 5548 | 25021811 | 25034065 | − | seg_65 | 25024050 | 25042800 | ARX | SAT = SAT1 |
| ENST00000378993.1 | 5549 | 28605516 | 29974840 | + | seg_66 | 29296100 | 29297200 | IL1RAPL1 | DAX1 = NR0B1 |
| ENST00000378993.1 | 5550 | 28605516 | 29974840 | + | seg_67 | 29464050 | 29465100 | IL1RAPL1 | DAX1 = NR0B1 |
| ENST00000378993.1 | 5551 | 28605516 | 29974840 | + | seg_68 | 29572800 | 29574700 | MAGEB2 | DAX1 = NR0B1 |
| ENST00000302196.4 | 5552 | 28807461 | 29973937 | + | seg_66 | 29296100 | 29297200 | IL1RAPL1 | DAX1 = NR0B1 |
| ENST00000302196.4 | 5553 | 28807461 | 29973937 | + | seg_67 | 29464050 | 29465100 | IL1RAPL1 | DAX1 = NR0B1 |
| ENST00000302196.4 | 5554 | 28807461 | 29973937 | + | seg_68 | 29572800 | 29574700 | MAGEB2 | DAX1 = NR0B1 |
| ENST00000378943.3 | 5555 | 30671476 | 30748725 | + | seg_72 | 30731150 | 30732450 | GK | DAX1 = NR0B1 |
| ENST00000378946.3 | 5556 | 30671476 | 30748725 | + | seg_72 | 30731150 | 30732450 | GK | DAX1 = NR0B1 |
| ENST00000534212.2 | 5557 | 30671476 | 30748725 | + | seg_72 | 30731150 | 30732450 | GK | DAX1 = NR0B1 |
| ENST00000378945.3 | 5558 | 30671595 | 30747287 | + | seg_72 | 30731150 | 30732450 | GK | DAX1 = NR0B1 |
| ENST00000427190.1 | 5559 | 30671606 | 30747366 | + | seg_72 | 30731150 | 30732450 | GK | DAX1 = NR0B1 |
| ENST00000481024.1 | 5560 | 30671606 | 30747366 | + | seg_72 | 30731150 | 30732450 | GK | DAX1 = NR0B1 |
| ENST00000451432.2 | 5561 | 30671613 | 30747555 | + | seg_72 | 30731150 | 30732450 | GK | DAX1 = NR0B1 |

TABLE XVIII-continued

Table XVIII lists the 503 paRNAs associated with strong EZH2 sites in GM12878 cells. Coordinates in reference to hg19 assembly.
paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000497961.1 | 5562 | 30716324 | 30740049 | + | seg_72 | 30731150 | 30732450 | GK | DAX1 = NR0B1 |
| ENST00000464659.1 | 5563 | 30718115 | 30742291 | − | seg_72 | 30731150 | 30732450 | GK | DAX1 = NR0B1 |
| ENST00000288422.2 | 5564 | 30848454 | 30993201 | − | seg_74 | 30989450 | 30990650 | FTHL17 | DAX1 = NR0B1 |
| ENST00000378932.2 | 5565 | 30848454 | 30993201 | − | seg_74 | 30989450 | 30990650 | FTHL17 | DAX1 = NR0B1 |
| ENST00000378684.4 | 5566 | 31132808 | 32430174 | − | seg_75 | 31188900 | 31190050 | DMD | DAX1 = NR0B1 |
| ENST00000378684.4 | 5567 | 31132808 | 32430174 | − | seg_76 | 31789800 | 31791200 | DMD | DAX1 = NR0B1 |
| ENST00000378684.4 | 5568 | 31132808 | 32430174 | − | seg_77 | 32372400 | 32373550 | DMD | DAX1 = NR0B1 |
| ENST00000378682.4 | 5569 | 31132808 | 32430326 | − | seg_75 | 31188900 | 31190050 | DMD | DAX1 = NR0B1 |
| ENST00000378682.4 | 5570 | 31132808 | 32430326 | − | seg_76 | 31789800 | 31791200 | DMD | DAX1 = NR0B1 |
| ENST00000378682.4 | 5571 | 31132808 | 32430326 | − | seg_77 | 32372400 | 32373550 | DMD | DAX1 = NR0B1 |
| ENST00000534884.1 | 5572 | 31132808 | 33038324 | − | seg_75 | 31188900 | 31190050 | DMD | DAX1 = NR0B1 |
| ENST00000534884.1 | 5573 | 31132808 | 33038324 | − | seg_76 | 31789800 | 31791200 | DMD | DAX1 = NR0B1 |
| ENST00000534884.1 | 5574 | 31132808 | 33038324 | − | seg_77 | 32372400 | 32373550 | DMD | DAX1 = NR0B1 |
| ENST00000534884.1 | 5575 | 31132808 | 33038324 | − | seg_78 | 32690150 | 32691150 | DMD | DAX1 = NR0B1 |
| ENST00000378723.3 | 5576 | 31137336 | 31285069 | − | seg_75 | 31188900 | 31190050 | DMD | DAX1 = NR0B1 |
| ENST00000358062.2 | 5577 | 31137338 | 31893490 | − | seg_75 | 31188900 | 31190050 | DMD | DAX1 = NR0B1 |
| ENST00000358062.2 | 5578 | 31137338 | 31893490 | − | seg_76 | 31789800 | 31791200 | DMD | DAX1 = NR0B1 |
| ENST00000343523.2 | 5579 | 31137345 | 32173586 | − | seg_75 | 31188900 | 31190050 | DMD | DAX1 = NR0B1 |
| ENST00000343523.2 | 5580 | 31137345 | 32173586 | − | seg_76 | 31789800 | 31791200 | DMD | DAX1 = NR0B1 |
| ENST00000359836.1 | 5581 | 31137345 | 32173586 | − | seg_75 | 31188900 | 31190050 | DMD | DAX1 = NR0B1 |
| ENST00000359836.1 | 5582 | 31137345 | 32173586 | − | seg_76 | 31789800 | 31791200 | DMD | DAX1 = NR0B1 |
| ENST00000378707.3 | 5583 | 31137345 | 32173586 | − | seg_75 | 31188900 | 31190050 | DMD | DAX1 = NR0B1 |
| ENST00000378707.3 | 5584 | 31137345 | 32173586 | − | seg_76 | 31789800 | 31791200 | DMD | DAX1 = NR0B1 |
| ENST00000541735.1 | 5585 | 31137345 | 32173586 | − | seg_75 | 31188900 | 31190050 | DMD | DAX1 = NR0B1 |
| ENST00000541735.1 | 5586 | 31137345 | 32173586 | − | seg_76 | 31789800 | 31791200 | DMD | DAX1 = NR0B1 |
| ENST00000378677.2 | 5587 | 31137345 | 33146477 | − | seg_75 | 31188900 | 31190050 | DMD | DAX1 = NR0B1 |
| ENST00000378677.2 | 5588 | 31137345 | 33146477 | − | seg_76 | 31789800 | 31791200 | DMD | DAX1 = NR0B1 |
| ENST00000378677.2 | 5589 | 31137345 | 33146477 | − | seg_77 | 32372400 | 32373550 | DMD | DAX1 = NR0B1 |
| ENST00000378677.2 | 5590 | 31137345 | 33146477 | − | seg_78 | 32690150 | 32691150 | DMD | DAX1 = NR0B1 |
| ENST00000535280.1 | 5591 | 31137345 | 33146544 | − | seg_75 | 31188900 | 31190050 | DMD | DAX1 = NR0B1 |
| ENST00000535280.1 | 5592 | 31137345 | 33146544 | − | seg_76 | 31789800 | 31791200 | DMD | DAX1 = NR0B1 |
| ENST00000535280.1 | 5593 | 31137345 | 33146544 | − | seg_77 | 32372400 | 32373550 | DMD | DAX1 = NR0B1 |
| ENST00000535280.1 | 5594 | 31137345 | 33146544 | − | seg_78 | 32690150 | 32691150 | DMD | DAX1 = NR0B1 |
| ENST00000357033.4 | 5595 | 31137345 | 33229636 | − | seg_75 | 31188900 | 31190050 | DMD | DAX1 = NR0B1 |
| ENST00000357033.4 | 5596 | 31137345 | 33229636 | − | seg_76 | 31789800 | 31791200 | DMD | DAX1 = NR0B1 |
| ENST00000357033.4 | 5597 | 31137345 | 33229636 | − | seg_77 | 32372400 | 32373550 | DMD | DAX1 = NR0B1 |
| ENST00000357033.4 | 5598 | 31137345 | 33229636 | − | seg_78 | 32690150 | 32691150 | DMD | DAX1 = NR0B1 |
| ENST00000542849.1 | 5599 | 31137345 | 33229673 | − | seg_75 | 31188900 | 31190050 | DMD | DAX1 = NR0B1 |
| ENST00000542849.1 | 5600 | 31137345 | 33229673 | − | seg_76 | 31789800 | 31791200 | DMD | DAX1 = NR0B1 |
| ENST00000542849.1 | 5601 | 31137345 | 33229673 | − | seg_77 | 32372400 | 32373550 | DMD | DAX1 = NR0B1 |
| ENST00000542849.1 | 5602 | 31137345 | 33229673 | − | seg_78 | 32690150 | 32691150 | DMD | DAX1 = NR0B1 |
| ENST00000378702.4 | 5603 | 31139301 | 31284974 | − | seg_75 | 31188900 | 31190050 | DMD | DAX1 = NR0B1 |
| ENST00000465285.1 | 5604 | 31139514 | 31947809 | − | seg_75 | 31188900 | 31190050 | DMD | DAX1 = NR0B1 |
| ENST00000465285.1 | 5605 | 31139514 | 31947809 | − | seg_76 | 31789800 | 31791200 | DMD | DAX1 = NR0B1 |
| ENST00000474231.1 | 5606 | 31139514 | 32173586 | − | seg_75 | 31188900 | 31190050 | DMD | DAX1 = NR0B1 |
| ENST00000474231.1 | 5607 | 31139514 | 32173586 | − | seg_76 | 31789800 | 31791200 | DMD | DAX1 = NR0B1 |
| ENST00000361471.4 | 5608 | 31139673 | 31285024 | − | seg_75 | 31188900 | 31190050 | DMD | DAX1 = NR0B1 |
| ENST00000378680.2 | 5609 | 31139790 | 31285066 | − | seg_75 | 31188900 | 31190050 | DMD | DAX1 = NR0B1 |
| ENST00000378705.3 | 5610 | 31187703 | 31224717 | − | seg_75 | 31188900 | 31190050 | DMD | DAX1 = NR0B1 |
| ENST00000471779.1 | 5611 | 31747803 | 31854900 | − | seg_76 | 31789800 | 31791200 | DMD | DAX1 = NR0B1 |
| ENST00000488902.1 | 5612 | 31950233 | 33229671 | − | seg_77 | 32372400 | 32373550 | DMD | DAX1 = NR0B1 |
| ENST00000488902.1 | 5613 | 31950233 | 33229671 | − | seg_78 | 32690150 | 32691150 | DMD | DAX1 = NR0B1 |
| ENST00000420596.1 | 5614 | 32382798 | 33229429 | − | seg_78 | 32690150 | 32691150 | DMD | DAX1 = NR0B1 |
| ENST00000448370.1 | 5615 | 32382798 | 33229429 | − | seg_78 | 32690150 | 32691150 | DMD | DAX1 = NR0B1 |
| ENST00000288447.4 | 5616 | 32534713 | 33357558 | − | seg_78 | 32690150 | 32691150 | DMD | DAX1 = NR0B1 |
| ENST00000480751.1 | 5617 | 32591709 | 32834670 | − | seg_78 | 32690150 | 32691150 | DMD | DAX1 = NR0B1 |
| ENST00000447523.1 | 5618 | 32591728 | 32867919 | − | seg_78 | 32690150 | 32691150 | DMD | DAX1 = NR0B1 |
| ENST00000378628.4 | 5619 | 37208528 | 37316548 | + | seg_79 | 37222250 | 37223300 | PRRG1 | XK |
| ENST00000491253.1 | 5620 | 37208562 | 37312900 | + | seg_79 | 37222250 | 37223300 | PRRG1 | XK |
| ENST00000466533.1 | 5621 | 37208583 | 37312664 | + | seg_79 | 37222250 | 37223300 | PRRG1 | XK |
| ENST00000542554.1 | 5622 | 37208583 | 37316545 | + | seg_79 | 37222250 | 37223300 | PRRG1 | XK |
| ENST00000543642.1 | 5623 | 37208583 | 37316545 | + | seg_79 | 37222250 | 37223300 | PRRG1 | XK |
| ENST00000465127.1 | 5624 | 37208583 | 38546928 | + | seg_79 | 37222250 | 37223300 | PRRG1 | XK |
| ENST00000465127.1 | 5625 | 37208583 | 38546928 | + | seg_80 | 37645650 | 37647450 | CYBB | CYBB |
| ENST00000465127.1 | 5626 | 37208583 | 38546928 | + | seg_81 | 37765500 | 37766650 | DYNLT3 | CYBB |
| ENST00000465127.1 | 5627 | 37208583 | 38546928 | + | seg_82 | 38135850 | 38136950 | RPGR | RPGR |
| ENST00000465127.1 | 5628 | 37208583 | 38546928 | + | seg_83 | 38537450 | 38538750 | TSPAN7 | OTC |
| ENST00000484460.1 | 5629 | 37208617 | 37312561 | + | seg_79 | 37222250 | 37223300 | PRRG1 | XK |
| ENST00000449135.2 | 5630 | 37208625 | 37316542 | + | seg_79 | 37222250 | 37223300 | PRRG1 | XK |
| ENST00000463135.1 | 5631 | 37208632 | 37301477 | + | seg_79 | 37222250 | 37223300 | PRRG1 | XK |
| ENST00000378588.4 | 5632 | 37639264 | 37672714 | + | seg_80 | 37645650 | 37647450 | CYBB | CYBB |
| ENST00000545017.1 | 5633 | 37639312 | 37670356 | + | seg_80 | 37645650 | 37647450 | CYBB | CYBB |
| ENST00000536160.1 | 5634 | 37639317 | 37670388 | + | seg_80 | 37645650 | 37647450 | CYBB | CYBB |
| ENST00000449263.1 | 5635 | 37765400 | 37808658 | + | seg_81 | 37765500 | 37766650 | DYNLT3 | CYBB |
| ENST00000309513.3 | 5636 | 38128424 | 38186788 | − | seg_82 | 38135850 | 38136950 | RPGR | RPGR |

TABLE XVIII-continued

Table XVIII lists the 503 paRNAs associated with strong EZH2 sites in GM12878 cells. Coordinates in reference to hg19 assembly.
paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000338898.3 | 5637 | 38128424 | 38186788 | − | seg_82 | 38135850 | 38136950 | RPGR | RPGR |
| ENST00000339363.3 | 5638 | 38128424 | 38186788 | − | seg_82 | 38135850 | 38136950 | RPGR | RPGR |
| ENST00000482855.1 | 5639 | 38128602 | 38186675 | − | seg_82 | 38135850 | 38136950 | RPGR | RPGR |
| ENST00000318842.6 | 5640 | 38128606 | 38186817 | − | seg_82 | 38135850 | 38136950 | RPGR | RPGR |
| ENST00000474584.1 | 5641 | 38128773 | 38186759 | − | seg_82 | 38135850 | 38136950 | RPGR | RPGR |
| ENST00000494707.1 | 5642 | 38132688 | 38150718 | − | seg_82 | 38135850 | 38136950 | RPGR | RPGR |
| ENST00000378482.2 | 5643 | 38420623 | 38548167 | + | seg_83 | 38537450 | 38538750 | TSPAN7 | OTC |
| ENST00000422612.2 | 5644 | 38420795 | 38547422 | + | seg_83 | 38537450 | 38538750 | TSPAN7 | OTC |
| ENST00000471410.1 | 5645 | 38420795 | 38547422 | + | seg_83 | 38537450 | 38538750 | TSPAN7 | OTC |
| ENST00000475216.1 | 5646 | 38420797 | 38547525 | + | seg_83 | 38537450 | 38538750 | TSPAN7 | OTC |
| ENST00000545599.1 | 5647 | 38420797 | 38547525 | + | seg_83 | 38537450 | 38538750 | TSPAN7 | OTC |
| ENST00000286824.6 | 5648 | 38420797 | 38547651 | + | seg_83 | 38537450 | 38538750 | TSPAN7 | OTC |
| ENST00000419600.2 | 5649 | 38525350 | 38548169 | + | seg_83 | 38537450 | 38538750 | TSPAN7 | OTC |
| ENST00000447651.1 | 5650 | 39868529 | 39871435 | + | seg_87 | 39871150 | 39873000 | BCOR | CSNB1 = NYX |
| EN6T00000399959.2 | 5651 | 41192651 | 41209462 | + | seg_90 | 41209250 | 41211000 | DDX3X | CSNB1 = NYX |
| ENST00000478993.1 | 5652 | 41192651 | 41223725 | + | seg_90 | 41209250 | 41211000 | DDX3X | CSNB1 = NYX |
| ENST00000421587.2 | 5653 | 41374187 | 41782265 | − | seg_91 | 41579300 | 41581500 | GPR82 | CSNB1 = NYX |
| ENST00000318588.9 | 5654 | 41374187 | 41782287 | − | seg_91 | 41579300 | 41581500 | GPR82 | CSNB1 = NYX |
| ENST00000361962.4 | 5655 | 41374187 | 41782287 | − | seg_91 | 41579300 | 41581500 | GPR82 | CSNB1 = NYX |
| ENST00000378163.1 | 5656 | 41378518 | 41782716 | − | seg_91 | 41579300 | 41581500 | GPR82 | CSNB1 = NYX |
| ENST00000378158.1 | 5657 | 41378906 | 41782592 | − | seg_91 | 41579300 | 41581500 | GPR82 | CSNB1 = NYX |
| ENST00000378166.4 | 5658 | 41379343 | 41782268 | − | seg_91 | 41579300 | 41581500 | GPR82 | CSNB1 = NYX |
| ENST00000442742.2 | 5659 | 41379589 | 41782260 | − | seg_91 | 41579300 | 41581500 | GPR82 | CSNB1 = NYX |
| ENST00000378154.1 | 5660 | 41418750 | 41782716 | − | seg_91 | 41579300 | 41581500 | GPR82 | CSNB1 = NYX |
| ENST00000414772.1 | 5661 | 45707328 | 45710447 | − | seg_94 | 45708550 | 45711000 | KRBOX4 | UBA1 |
| ENST00000456532.1 | 5662 | 45707509 | 45710920 | − | seg_94 | 45708550 | 45711000 | KRBOX4 | UBA1 |
| ENST00000328306.4 | 5663 | 46464753 | 46618490 | − | seg_95 | 46497450 | 46498550 | CHST7 | UBA1 |
| ENST00000489574.1 | 5664 | 46465730 | 46529121 | − | seg_95 | 46497450 | 46498550 | CHST7 | UBA1 |
| ENST00000424392.1 | 5665 | 46771711 | 46887378 | + | seg_97 | 46772150 | 46774250 | CXorf31 | UBA1 |
| ENST00000424392.1 | 5666 | 46771711 | 46887378 | + | seg_98 | 46819250 | 46820950 | PHF16 | UBA1 |
| ENST00000424392.1 | 5667 | 46771711 | 46887378 | + | seg_99 | 46839750 | 46841250 | PHF16 | UBA1 |
| ENST00000397189.1 | 5668 | 46771736 | 46920641 | + | seg_97 | 46772150 | 46774250 | CXorf31 | UBA1 |
| ENST00000397189.1 | 5669 | 46771736 | 46920641 | + | seg_98 | 46819250 | 46820950 | PHF16 | UBA1 |
| ENST00000397189.1 | 5670 | 46771736 | 46920641 | + | seg_99 | 46839750 | 46841250 | PHF16 | UBA1 |
| ENST00000218343.4 | 5671 | 46771868 | 46920640 | + | seg_97 | 46772150 | 46774250 | CXorf31 | UBA1 |
| ENST00000218343.4 | 5672 | 46771868 | 46920640 | + | seg_98 | 46819250 | 46820950 | PHF16 | UBA1 |
| ENST00000218343.4 | 5673 | 46771868 | 46920640 | + | seg_99 | 46839750 | 46841250 | PHF16 | UBA1 |
| ENST00000455411.1 | 5674 | 46772231 | 46884185 | + | seg_97 | 46772150 | 46774250 | CXorf31 | UBAI |
| ENST00000455411.1 | 5675 | 46772231 | 46884185 | + | seg_98 | 46819250 | 46820950 | PHF16 | UBA1 |
| ENST00000455411.1 | 5676 | 46772231 | 46884185 | + | seg_99 | 46839750 | 46841250 | PHF16 | UBA1 |
| ENST00000376020.2 | 5677 | 50334647 | 50557044 | − | seg_100 | 50489150 | 50490250 | SHROOM4 | CLCN5 |
| ENST00000289292.7 | 5678 | 50334647 | 50557302 | − | seg_100 | 50489150 | 50490250 | SHROOM4 | CLCN5 |
| ENST00000396435.3 | 5679 | 53262058 | 53350522 | − | seg_101 | 53349050 | 53352550 | IQSEC2 | MRX1 = IQSEC2 |
| ENST00000375368.5 | 5680 | 53262059 | 53350522 | − | seg_101 | 53349050 | 53352550 | IQSEC2 | MRX1 = IQSEC2 |
| ENST00000432596.1 | 5681 | 53352187 | 53352973 | + | seg_101 | 53349050 | 53352550 | IQSEC2 | MRX1 = IQSEC2 |
| ENST00000342160.3 | 5682 | 53559057 | 53711114 | − | seg_104 | 53659750 | 53660850 | HUWE1 | MRX1 = IQSEC2 |
| ENST00000342160.3 | 5683 | 53559057 | 53711114 | − | seg_105 | 53677550 | 53678650 | HUWE1 | MRX1 = IQSEC2 |
| ENST00000262854.6 | 5684 | 53559105 | 53713673 | − | seg_104 | 53659750 | 53660850 | HUWE1 | MRX1 = IQSEC2 |
| ENST00000262854.6 | 5685 | 53559105 | 53713673 | − | seg_105 | 53677550 | 53678650 | HUWE1 | MRX1 = IQSEC2 |
| ENST00000218328.8 | 5686 | 53611171 | 53713673 | − | seg_104 | 53659750 | 53660850 | HUWE1 | MRX1 = IQSEC2 |
| ENST00000218328.8 | 5687 | 53611171 | 53713673 | − | seg_105 | 53677550 | 53678650 | HUWE1 | MRX1 = IQSEC2 |
| ENST00000432528.2 | 5688 | 53659006 | 53713673 | − | seg_104 | 53659750 | 53660850 | HUWE1 | MRX1 = IQSEC2 |
| ENST00000432528.2 | 5689 | 53659006 | 53713673 | − | seg_105 | 53677550 | 53678650 | HUWE1 | MRX1 = IQSEC2 |
| ENST00000446750.1 | 5690 | 53674384 | 53711114 | − | seg_105 | 53677550 | 53678650 | HUWE1 | MRX1 = IQSEC2 |
| ENST00000476898.1 | 5691 | 56258854 | 56295641 | + | seg_106 | 56267800 | 56269150 | KLF8 | ALAS2 |
| ENST00000374928.3 | 5692 | 56258870 | 56314322 | + | seg_106 | 56267800 | 56269150 | KLF8 | ALAS2 |
| ENST00000462627.1 | 5693 | 56258907 | 56314317 | + | seg_106 | 56267800 | 56269150 | KLF8 | ALAS2 |
| ENST00000468660.1 | 5694 | 56259480 | 56311102 | + | seg_106 | 56267800 | 56269150 | KLF8 | ALAS2 |
| ENST00000358094.5 | 5695 | 56259622 | 56311530 | + | seg_106 | 56267800 | 56269150 | KLF8 | ALAS2 |
| ENST00000253401.6 | 5696 | 62854847 | 62974993 | − | seg_109 | 62906550 | 62907850 | ARHGEF9 | AR |
| ENST00000374878.1 | 5697 | 62854847 | 63005413 | − | seg_109 | 62906550 | 62907850 | ARHGEF9 | AR |
| ENST00000374870.4 | 5698 | 62854856 | 62975031 | − | seg_109 | 62906550 | 62907850 | ARHGEF9 | AR |
| ENST00000437457.2 | 5699 | 62854856 | 63005426 | − | seg_109 | 62906550 | 62907850 | ARHGEF9 | AR |
| ENST00000495564.1 | 5700 | 62857860 | 62974991 | − | seg_109 | 62906550 | 62907850 | ARHGEF9 | AR |
| ENST00000374872.1 | 5701 | 62857862 | 62974988 | − | seg_109 | 62906550 | 62907850 | ARHGEF9 | AR |
| ENST00000374807.5 | 5702 | 64732462 | 64754634 | − | seg_111 | 64754100 | 64755650 | LAS1L | AR |
| ENST00000374811.3 | 5703 | 64732462 | 64754636 | − | seg_111 | 64754100 | 64755650 | LAS1L | AR |
| ENST00000312391.8 | 5704 | 64732463 | 64754636 | − | seg_111 | 64754100 | 64755650 | LAS1L | AR |
| ENST00000374804.5 | 5705 | 64732463 | 64754636 | − | seg_111 | 64754100 | 64755650 | LAS1L | AR |
| ENST00000484069.1 | 5706 | 64732463 | 64754655 | − | seg_111 | 64754100 | 64755650 | LAS1L | AR |
| ENST00000544310.1 | 5707 | 64741799 | 64754636 | − | seg_111 | 64754100 | 64755650 | LAS1L | AR |
| ENST00000204961.4 | 5708 | 68048840 | 68061990 | + | seg_113 | 68049150 | 68050700 | EFNB1 | ED1 = EDA |
| ENST00000252338.4 | 5709 | 68725084 | 68752351 | + | seg_117 | 68725350 | 68726600 | FAM155B | ED1 = EDA |
| ENST00000333026.3 | 5710 | 69397333 | 69425395 | + | seg_118 | 69416400 | 69418200 | DGAT2L6 | ED1 = EDA |
| ENST00000374388.3 | 5711 | 69509879 | 69635312 | + | seg_119 | 69555900 | 69556900 | KIF4A | ED1 = EDA |

TABLE XVIII-continued

Table XVIII lists the 503 paRNAs associated with strong EZH2 sites in GM12878 cells. Coordinates in reference to hg19 assembly.
paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000374403.3 | 5712 | 69509940 | 69640682 | + | seg_119 | 69555900 | 69556900 | KIF4A | ED1 = EDA |
| ENST00000194900.4 | 5713 | 69664711 | 69725337 | + | seg_120 | 69663400 | 69665750 | DLG3 | GJB1 |
| ENST00000194900.4 | 5714 | 69664711 | 69725337 | + | seg_121 | 69690000 | 69691650 | DLG3 | GJB1 |
| ENST00000374360.3 | 5715 | 69664819 | 69725337 | + | seg_120 | 69663400 | 69665750 | DLG3 | GJB1 |
| ENST00000374360.3 | 5716 | 69664819 | 69725337 | + | seg_121 | 69690000 | 69691650 | DLG3 | GJB1 |
| ENST00000463252.1 | 5717 | 69664986 | 69723796 | + | seg_120 | 69663400 | 69665750 | DLG3 | GJB1 |
| ENST00000463252.1 | 5718 | 69664986 | 69723796 | + | seg_121 | 69690000 | 69691650 | DLG3 | GJB1 |
| ENST00000374355.3 | 5719 | 69672155 | 69725337 | + | seg_121 | 69690000 | 69691650 | DLG3 | GJB1 |
| ENST00000542398.1 | 5720 | 69674946 | 69725335 | + | seg_121 | 69690000 | 69691650 | DLG3 | GJB1 |
| ENST00000489733.1 | 5721 | 69674953 | 69718408 | + | seg_121 | 69690000 | 69691650 | DLG3 | GJB1 |
| ENST00000494493.1 | 5722 | 69674957 | 69712087 | + | seg_121 | 69690000 | 69691650 | DLG3 | GJB1 |
| ENST00000540800.1 | 5723 | 71130938 | 71363424 | + | seg_122 | 71320750 | 71321750 | RGAG4 | GJB1 |
| ENST00000540800.1 | 5724 | 71130938 | 71363424 | + | seg_123 | 71351100 | 71353000 | RGAG4 | GJB1 |
| ENST00000545866.1 | 5725 | 71346958 | 71351758 | − | seg_123 | 71351100 | 71353000 | RGAG4 | GJB1 |
| ENST00000479991.1 | 5726 | 71346960 | 71351751 | − | seg_123 | 71351100 | 71353000 | RGAG4 | GJB1 |
| ENST00000513469.1 | 5727 | 71352000 | 71354556 | + | seg_123 | 71351100 | 71353000 | RGAG4 | GJB1 |
| ENST00000439980.2 | 5728 | 71401615 | 71522776 | + | seg_124 | 71495000 | 71496100 | RPS4X | GJB1 |
| ENST00000316084.6 | 5729 | 71491892 | 71497150 | − | seg_124 | 71495000 | 71496100 | RPS4X | GJB1 |
| ENST00000486733.1 | 5730 | 71492563 | 71496077 | − | seg_124 | 71495000 | 71496100 | RPS4X | GJB1 |
| ENST00000373626.3 | 5731 | 71494105 | 71497098 | − | seg_124 | 71495000 | 71496100 | RPS4X | GJB1 |
| ENST00000453707.2 | 5732 | 71521488 | 71527000 | − | seg_125 | 71523650 | 71529700 | CITED1 | GJB1 |
| ENST00000431381.1 | 5733 | 71521490 | 71525764 | − | seg_125 | 71523650 | 71529700 | CITED1 | GJB1 |
| ENST00000445983.1 | 5734 | 71521490 | 71525764 | − | seg_125 | 71523650 | 71529700 | CITED1 | GJB1 |
| ENST00000373619.3 | 5735 | 71521497 | 71527037 | − | seg_125 | 71523650 | 71529700 | CITED1 | GJB1 |
| ENST00000246139.5 | 5736 | 71521500 | 71526837 | − | seg_125 | 71523650 | 71529700 | CITED1 | GJB1 |
| ENST00000417400.1 | 5737 | 71521733 | 71525747 | − | seg_125 | 71523650 | 71529700 | CITED1 | GJB1 |
| ENST00000427412.1 | 5738 | 71521818 | 71525415 | − | seg_125 | 71523650 | 71529700 | CITED1 | GJB1 |
| ENST00000450875.1 | 5739 | 71521904 | 71525742 | − | seg_125 | 71523650 | 71529700 | CITED1 | GJB1 |
| ENST00000454225.1 | 5740 | 71522056 | 71526757 | − | seg_125 | 71523650 | 71529700 | CITED1 | GJB1 |
| ENST00000373542.4 | 5741 | 71798664 | 71933888 | − | seg_126 | 71833400 | 71834600 | HDAC8 | GJB1 |
| ENST00000373545.3 | 5742 | 71798664 | 71934167 | − | seg_126 | 71833400 | 71834600 | HDAC8 | GJB1 |
| ENST00000339490.3 | 5743 | 71798665 | 71934029 | − | seg_126 | 71833400 | 71834600 | HDAC8 | GJB1 |
| ENST00000541944.1 | 5744 | 71798665 | 71934029 | − | seg_126 | 71833400 | 71834600 | HDAC8 | GJB1 |
| ENST00000373539.3 | 5745 | 71800477 | 71934106 | − | seg_126 | 71833400 | 71834600 | HDAC8 | GJB1 |
| ENST00000276033.4 | 5746 | 73640638 | 73753752 | + | seg_127 | 73639250 | 73642650 | SLC16A2 | ABCB7 |
| ENST00000544091.1 | 5747 | 78200829 | 78217437 | + | seg_130 | 78211700 | 78214250 | P2RY10 | PGK1 |
| ENST00000461541.1 | 5748 | 78200918 | 78216368 | + | seg_130 | 78211700 | 78214250 | P2RY10 | PGK1 |
| ENST00000475374.1 | 5749 | 78200918 | 78216577 | + | seg_130 | 78211700 | 78214250 | P2RY10 | PGK1 |
| ENST00000171757.2 | 5750 | 78200918 | 78217451 | + | seg_130 | 78211700 | 78214250 | P2RY10 | PGK1 |
| ENST00000358130.2 | 5751 | 80369200 | 80457441 | − | seg_135 | 80385100 | 80386100 | HMGN5 | PGK1 |
| ENST00000436386.1 | 5752 | 80370691 | 80457412 | − | seg_135 | 80385100 | 80386100 | HMGN5 | PGK1 |
| ENST00000451455.1 | 5753 | 80371703 | 80457385 | − | seg_135 | 80385100 | 80386100 | HMGN5 | PGK1 |
| ENST00000395337.2 | 5754 | 91034260 | 91139006 | + | seg_138 | 91034350 | 91035850 | PCDH11X | CHM |
| ENST00000355827.4 | 5755 | 95939662 | 96724837 | + | seg_139 | 96703000 | 96704200 | RPA4 | BTK |
| ENST00000373054.4 | 5756 | 95939662 | 96854316 | + | seg_139 | 96703000 | 96704200 | RPA4 | BTK |
| ENST00000373061.3 | 5757 | 95939662 | 96855597 | + | seg_139 | 96703000 | 96704200 | RPA4 | BTK |
| ENST00000373049.4 | 5758 | 95939711 | 96724834 | + | seg_139 | 96703000 | 96704200 | RPA4 | BTK |
| ENST00000324765.8 | 5759 | 95939711 | 96859996 | + | seg_139 | 96703000 | 96704200 | RPA4 | BTK |
| ENST00000537885.1 | 5760 | 95940016 | 96724764 | + | seg_139 | 96703000 | 96704200 | RPA4 | BTK |
| ENST00000439759.1 | 5761 | 96686257 | 96819492 | − | seg_139 | 96703000 | 96704200 | RPA4 | BTK |
| ENST00000420881.2 | 5762 | 99546642 | 99663595 | − | seg_140 | 99622650 | 99623950 | PCDH19 | BTK |
| ENST00000373034.4 | 5763 | 99546642 | 99665271 | − | seg_140 | 99622650 | 99623950 | PCDH19 | BTK |
| ENST00000255531.7 | 5764 | 99546644 | 99665271 | − | seg_140 | 99622650 | 99623950 | PCDH19 | BTK |
| ENST00000372989.1 | 5765 | 99929488 | 99986498 | − | seg_143 | 99985450 | 99986650 | SYTL4 | BTK |
| ENST00000276141.6 | 5766 | 99929491 | 99986522 | − | seg_143 | 99985450 | 99986650 | SYTL4 | BTK |
| ENST00000454200.2 | 5767 | 99929491 | 99986522 | − | seg_143 | 99985450 | 99986650 | SYTL4 | BTK |
| ENST00000455616.1 | 5768 | 99929491 | 99986522 | − | seg_143 | 99985450 | 99986650 | SYTL4 | BTK |
| ENST00000263033.5 | 5769 | 99930894 | 99987108 | − | seg_143 | 99985450 | 99986650 | SYTL4 | BTK |
| ENST00000372981.1 | 5770 | 99939693 | 99987107 | − | seg_143 | 99985450 | 99986650 | SYTL4 | BTK |
| ENST00000491326.1 | 5771 | 99986402 | 99987110 | − | seg_143 | 99985450 | 99986650 | SYTL4 | BTK |
| ENST00000361298.4 | 5772 | 102631268 | 102633005 | + | seg_144 | 102632100 | 102633150 | NGFRAP1 | GLA |
| ENST00000372645.3 | 5773 | 102631323 | 102633005 | + | seg_144 | 102632100 | 102633150 | NGFRAP1 | GLA |
| ENST00000372635.1 | 5774 | 102631335 | 102632988 | + | seg_144 | 102632100 | 102633150 | NGFRAP1 | GLA |
| ENST00000372634.1 | 5775 | 102631844 | 102632999 | + | seg_144 | 102632100 | 102633150 | NGFRAP1 | GLA |
| ENST00000299872.7 | 5776 | 102632109 | 102632992 | + | seg_144 | 102632100 | 102633150 | NGFRAP1 | GLA |
| ENST00000360458.1 | 5777 | 102930424 | 102942992 | − | seg_145 | 102942900 | 102943900 | MORF4L2 | GLA |
| ENST00000433176.2 | 5778 | 102930428 | 102943086 | − | seg_145 | 102942900 | 102943900 | MORF4L2 | GLA |
| ENST00000434230.1 | 5779 | 102931423 | 102942966 | − | seg_145 | 102942900 | 102943900 | MORF4L2 | GLA |
| ENST00000418819.1 | 5780 | 102931425 | 102942969 | − | seg_145 | 102942900 | 102943900 | MORF4L2 | GLA |
| ENST00000492116.1 | 5781 | 102931622 | 102943050 | − | seg_145 | 102942900 | 102943900 | MORF4L2 | GLA |
| ENST00000488331.1 | 5782 | 102939902 | 102942955 | − | seg_145 | 102942900 | 102943900 | MORF4L2 | GLA |
| ENST00000435306.1 | 5783 | 102942212 | 102946700 | + | seg_145 | 102942900 | 102943900 | MORF4L2 | GLA |
| ENST00000418562.1 | 5784 | 105937024 | 106033435 | + | seg_147 | 105938200 | 105940150 | RNF128 | TBG = SERPINA7 |
| ENST00000418562.1 | 5785 | 105937024 | 106033435 | + | seg_148 | 105968900 | 105969900 | RNF128 | TBG = SERPINA7 |
| ENST00000324342.3 | 5786 | 105937068 | 106040223 | + | seg_147 | 105938200 | 105940150 | RNF128 | TBG = SERPINA7 |

TABLE XVIII-continued

Table XVIII lists the 503 paRNAs associated with strong EZH2 sites in GM12878 cells. Coordinates in reference to hg19 assembly.
paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000324342.3 | 5787 | 105937068 | 106040223 | + | seg_148 | 105968900 | 105969900 | RNF128 | TBG = SERPINA7 |
| ENST00000255499.2 | 5788 | 105969894 | 106040223 | + | seg_148 | 105968900 | 105969900 | RNF128 | TBG = SERPINA7 |
| ENST00000357242.5 | 5789 | 106045910 | 106119375 | + | seg_149 | 106044700 | 106046300 | TBC1D8B | TBG = SERPINA7 |
| ENST00000357242.5 | 5790 | 106045910 | 106119375 | + | seg_150 | 106117050 | 106118200 | TBC1D8B | PRPS1 |
| ENST00000310452.2 | 5791 | 106045919 | 106093061 | + | seg_149 | 106044700 | 106046300 | TBC1D8B | TBG = SERPINA7 |
| ENST00000481617.2 | 5792 | 106045935 | 106073313 | + | seg_149 | 106044700 | 106046300 | TBC1D8B | TBG = SERPINA7 |
| ENST00000276175.3 | 5793 | 106046043 | 106117347 | + | seg_149 | 106044700 | 106046300 | TBC1D8B | TBG = SERPINA7 |
| ENST00000276175.3 | 5794 | 106046043 | 106117347 | + | seg_150 | 106117050 | 106118200 | TBC1D8B | PRPS1 |
| ENST00000358740.3 | 5795 | 106057103 | 106236570 | − | seg_150 | 106117050 | 106118200 | TBC1D8B | PRPS1 |
| ENST00000413086.3 | 5796 | 106083914 | 106119375 | + | seg_150 | 106117050 | 106118200 | TBC1D8B | PRPS1 |
| ENST00000394972.3 | 5797 | 106096743 | 106118337 | + | seg_150 | 106117050 | 106118200 | TBC1D8B | PRPS1 |
| ENST00000451923.1 | 5798 | 107068985 | 107084611 | + | seg_153 | 107067250 | 107070800 | MID2 | PRPS1 |
| ENST00000262843.6 | 5799 | 107069109 | 107170423 | + | seg_153 | 107067250 | 107070800 | MID2 | PRPS1 |
| ENST00000443968.2 | 5800 | 107069644 | 107170423 | + | seg_153 | 107067250 | 107070800 | MID2 | PRPS1 |
| ENST00000415430.3 | 5801 | 107288200 | 107322414 | + | seg_154 | 107314500 | 107315550 | PSMD10 | COL4A5 |
| ENST00000217957.5 | 5802 | 107288244 | 107322327 | + | seg_154 | 107314500 | 107315550 | PSMD10 | COL4A5 |
| ENST00000485533.1 | 5803 | 107307969 | 107316494 | + | seg_154 | 107314500 | 107315550 | PSMD10 | COL4A5 |
| ENST00000334504.7 | 5804 | 107398837 | 107681660 | − | seg_155 | 107494550 | 107495800 | COL4A6 | COL4A5 |
| ENST00000334504.7 | 5805 | 107398837 | 107681660 | − | seg_156 | 107670350 | 107671350 | COL4A6 | COL4A5 |
| ENST00000372216.4 | 5806 | 107398837 | 107682702 | − | seg_155 | 107494550 | 107495800 | COL4A6 | COL4A5 |
| ENST00000372216.4 | 5807 | 107398837 | 107682702 | − | seg_156 | 107670350 | 107671350 | COL4A6 | COL4A5 |
| ENST00000394872.2 | 5808 | 107398838 | 107681658 | − | seg_155 | 107494550 | 107495800 | COL4A6 | COL4A5 |
| ENST00000394872.2 | 5809 | 107398838 | 107681658 | − | seg_156 | 107670350 | 107671350 | COL4A6 | COL4A5 |
| ENST00000541389.1 | 5810 | 107399121 | 107681660 | − | seg_155 | 107494550 | 107495800 | COL4A6 | COL4A5 |
| ENST00000541389.1 | 5811 | 107399121 | 107681660 | − | seg_156 | 107670350 | 107671350 | COL4A6 | COL4A5 |
| ENST00000538570.1 | 5812 | 107399275 | 107681556 | − | seg_155 | 107494550 | 107495800 | COL4A6 | COL4A5 |
| ENST00000538570.1 | 5813 | 107399275 | 107681556 | − | seg_156 | 107670350 | 107671350 | COL4A6 | COL4A5 |
| ENST00000545689.1 | 5814 | 107399275 | 107681556 | − | seg_155 | 107494550 | 107495800 | COL4A6 | COL4A5 |
| ENST00000545689.1 | 5815 | 107399275 | 107681556 | − | seg_156 | 107670350 | 107671350 | COL4A6 | COL4A5 |
| ENST00000468338.1 | 5816 | 107457022 | 107682702 | − | seg_155 | 107494550 | 107495800 | COL4A6 | COL4A5 |
| ENST00000468338.1 | 5817 | 107457022 | 107682702 | − | seg_156 | 107670350 | 107671350 | COL4A6 | COL4A5 |
| ENST00000461897.1 | 5818 | 107510872 | 107681660 | − | seg_156 | 107670350 | 107671350 | COL4A6 | COL4A5 |
| ENST00000477085.1 | 5819 | 107510872 | 107682727 | − | seg_156 | 107670350 | 107671350 | COL4A6 | COL4A5 |
| ENST00000372072.3 | 5820 | 109245863 | 109421012 | + | seg_158 | 109388700 | 109390200 | TMEM164 | COL4A5 |
| ENST00000372073.1 | 5821 | 109246323 | 109421016 | + | seg_158 | 109388700 | 109390200 | TMEM164 | COL4A5 |
| ENST00000372068.2 | 5822 | 109246342 | 109421012 | + | seg_158 | 109388700 | 109390200 | TMEM164 | COL4A5 |
| ENST00000501872.2 | 5823 | 109246343 | 109420900 | + | seg_158 | 109388700 | 109390200 | TMEM164 | COL4A5 |
| ENST00000288381.4 | 5824 | 109246343 | 109421016 | + | seg_158 | 109388700 | 109390200 | TMEM164 | COL4A5 |
| ENST00000461715.1 | 5825 | 109308329 | 109414739 | + | seg_158 | 109388700 | 109390200 | TMEM164 | COL4A5 |
| ENST00000464177.1 | 5826 | 109388083 | 109425962 | + | seg_158 | 109388700 | 109390200 | TMEM164 | COL4A5 |
| ENST00000372057.1 | 5827 | 109439638 | 109683461 | − | seg_159 | 109606250 | 109607300 | GNG5P2 | COL4A5 |
| ENST00000372057.1 | 5828 | 109439638 | 109683461 | − | seg_160 | 109634900 | 109636050 | GNG5P2 | COL4A5 |
| ENST00000520821.1 | 5829 | 109602044 | 109694109 | + | seg_159 | 109606250 | 109607300 | GNG5P2 | COL4A5 |
| ENST00000520821.1 | 5830 | 109602044 | 109694109 | + | seg_160 | 109634900 | 109636050 | GNG5P2 | COL4A5 |
| ENST00000520821.1 | 5831 | 109602044 | 109694109 | + | seg_161 | 109693150 | 109694700 | RGAG1 | COL4A5 |
| ENST00000465301.2 | 5832 | 109662285 | 109699562 | + | seg_161 | 109693150 | 109694700 | RGAG1 | COL4A5 |
| ENST00000540483.1 | 5833 | 109693793 | 109698741 | + | seg_161 | 109693150 | 109694700 | RGAG1 | COL4A5 |
| ENST00000540313.1 | 5834 | 109693793 | 109699554 | + | seg_161 | 109693150 | 109694700 | RGAG1 | COL4A5 |
| ENST00000372045.1 | 5835 | 109917084 | 110038993 | − | seg_162 | 109938700 | 109940350 | CHRDL1 | COL4A5 |
| ENST00000218054.4 | 5836 | 109917092 | 110039076 | − | seg_162 | 109938700 | 109940350 | CHRDL1 | COL4A5 |
| ENST00000434224.1 | 5837 | 109917092 | 110039286 | − | seg_162 | 109938700 | 109940350 | CHRDL1 | COL4A5 |
| ENST00000394797.4 | 5838 | 109918473 | 110038993 | − | seg_162 | 109938700 | 109940350 | CHRDL1 | COL4A5 |
| ENST00000372042.1 | 5839 | 109919004 | 110039039 | − | seg_162 | 109938700 | 109940350 | CHRDL1 | COL4A5 |
| ENST00000482160.1 | 5840 | 109919169 | 110039047 | − | seg_162 | 109938700 | 109940350 | CHRDL1 | COL4A5 |
| ENST00000444321.2 | 5841 | 109919285 | 110039047 | − | seg_162 | 109938700 | 109940350 | CHRDL1 | COL4A5 |
| ENST00000487141.1 | 5842 | 110909043 | 110956525 | + | seg_164 | 110955050 | 110956250 | ALG13 | COL4A5 |
| ENST00000251943.4 | 5843 | 110924346 | 111003873 | + | seg_164 | 110955050 | 110956250 | ALG13 | COL4A5 |
| ENST00000394780.3 | 5844 | 110924435 | 111003872 | + | seg_164 | 110955050 | 110956250 | ALG13 | COL4A5 |
| ENST00000495283.1 | 5845 | 110924460 | 110967105 | + | seg_164 | 110955050 | 110956250 | ALG13 | COL4A5 |
| ENST00000262839.2 | 5846 | 111017543 | 111326004 | − | seg_165 | 111165850 | 111167200 | TRPC5 | COL4A5 |
| ENST00000371968.3 | 5847 | 111873876 | 111923282 | − | seg_167 | 111921950 | 111923200 | LHFPL1 | COL4A5 |
| ENST00000536453.1 | 5848 | 111873879 | 111923375 | − | seg_167 | 111921950 | 111923200 | LHFPL1 | COL4A5 |
| ENST00000478229.1 | 5849 | 111874502 | 111923282 | − | seg_167 | 111921950 | 111923200 | LHFPL1 | COL4A5 |
| ENST00000371822.5 | 5850 | 117480036 | 117583921 | + | seg_170 | 117505350 | 117506550 | WDR44 | COL4A5 |
| ENST00000254029.3 | 5851 | 117480072 | 117583924 | + | seg_170 | 117505350 | 117506550 | WDR44 | COL4A5 |
| ENST00000371825.3 | 5852 | 117480106 | 117583900 | + | seg_170 | 117505350 | 117506550 | WDR44 | COL4A5 |
| ENST00000493448.1 | 5853 | 117480162 | 117527178 | + | seg_170 | 117505350 | 117506550 | WDR44 | COL4A5 |
| ENST00000276204.6 | 5854 | 117629861 | 117820126 | + | seg_171 | 117661700 | 117662750 | DOCK11 | COL4A5 |
| ENST00000276202.7 | 5855 | 117629872 | 117820110 | + | seg_171 | 117661700 | 117662750 | DOCK11 | COL4A5 |
| ENST00000310164.2 | 5856 | 117957753 | 117960931 | + | seg_172 | 117957150 | 117960300 | ZCCHC12 | COL4A5 |
| ENST00000412422.1 | 5857 | 117973519 | 117991849 | + | seg_173 | 117985600 | 117986600 | ZCCHC12 | COL4A5 |
| ENST00000481285.1 | 5858 | 118108581 | 118151946 | + | seg_174 | 118109100 | 118110500 | LONRF3 | COL4A5 |
| ENST00000304778.7 | 5859 | 118108581 | 118152318 | + | seg_174 | 118109100 | 118110500 | LONRF3 | COL4A5 |
| ENST00000365713.2 | 5860 | 118108581 | 118156888 | + | seg_174 | 118109100 | 118110500 | LONRF3 | COL4A5 |
| ENST00000371628.3 | 5861 | 118108713 | 118151892 | + | seg_174 | 118109100 | 118110500 | LONRF3 | COL4A5 |

TABLE XVIII-continued

Table XVIII lists the 503 paRNAs associated with strong EZH2 sites in GM12878 cells. Coordinates in reference to hg19 assembly.
paRNAs associated with EZH2 STRONG sites in GM12878 cells

| Transcript ID | SIN | Start | Stop | Strand | Ezh2 ID | Ezh2 Start | Ezh2 End | Closest gene | Disease gene |
|---|---|---|---|---|---|---|---|---|---|
| ENST00000439603.1 | 5862 | 118109325 | 118151950 | + | seg_174 | 118109100 | 118110500 | LONRF3 | COL4A5 |
| ENST00000472173.1 | 5863 | 118110295 | 118151946 | + | seg_174 | 118109100 | 118110500 | LONRF3 | COL4A5 |
| ENST00000422289.2 | 5864 | 118110295 | 118151947 | + | seg_174 | 118109100 | 118110500 | LONRF3 | COL4A5 |
| ENST00000309720.5 | 5865 | 119392505 | 119445288 | − | seg_179 | 119443250 | 119445250 | TMEM255A | OCRL |
| ENST00000371369.4 | 5866 | 119392505 | 119445391 | − | seg_179 | 119443250 | 119445250 | TMEM255A | OCRL |
| ENST00000440464.1 | 5867 | 119392506 | 119445391 | − | seg_179 | 119443250 | 119445250 | TMEM255A | OCRL |
| ENST00000519908.1 | 5868 | 119402218 | 119445411 | − | seg_179 | 119443250 | 119445250 | TMEM255A | OCRL |
| ENST00000480821.1 | 5869 | 119443748 | 119445257 | − | seg_179 | 119443250 | 119445250 | TMEM255A | OCRL |
| ENST00000422498.1 | 5870 | 124337654 | 124338187 | − | seg_183 | 124337400 | 124339100 | TENM1 | OCRL |
| ENST00000488135.1 | 5871 | 129115083 | 129147127 | + | seg_186 | 129114500 | 129116250 | BCORL1 | OCRL |
| ENST00000066465.7 | 5872 | 129336682 | 129402873 | − | seg_187 | 129398550 | 129399700 | ZNF280C | OCRL |
| ENST00000370978.4 | 5873 | 129336685 | 129402873 | − | seg_187 | 129398550 | 129399700 | ZNF280C | OCRL |
| ENST00000447817.1 | 5874 | 129349167 | 129402857 | − | seg_187 | 129398550 | 129399700 | ZNF280C | OCRL |
| ENST00000370837.1 | 5875 | 131760038 | 132091358 | − | seg_189 | 131866700 | 131867750 | HS6ST2 | NYS1 = FRMD7 |
| ENST00000461959.1 | 5876 | 131760044 | 132091354 | − | seg_189 | 131866700 | 131867750 | HS6ST2 | NYS1 = FRMD7 |
| ENST00000370836.2 | 5877 | 131760044 | 132095423 | − | seg_189 | 131866700 | 131867750 | HS6ST2 | NYS1 = FRMD7 |
| ENST00000521489.1 | 5878 | 131761998 | 132095423 | − | seg_189 | 131866700 | 131867750 | HS6ST2 | NYS1 = FRMD7 |
| ENST00000370833.2 | 5879 | 131762251 | 132091344 | − | seg_189 | 131866700 | 131867750 | HS6ST2 | NYS1 = FRMD7 |
| ENST00000319809.6 | 5880 | 131762877 | 132091305 | − | seg_189 | 131866700 | 131867750 | HS6ST2 | NYS1 = FRMD7 |
| ENST00000370828.3 | 5881 | 132434131 | 132549518 | − | seg_190 | 132547800 | 132548950 | GPC4 | HPRT1 = HPRT |
| ENST00000536418.1 | 5882 | 132435064 | 132549205 | − | seg_190 | 132547800 | 132548950 | GPC4 | HPRT1 = HPRT |
| ENST00000535467.1 | 5883 | 132436668 | 132548587 | − | seg_190 | 132547800 | 132548950 | GPC4 | HPRT1 = HPRT |
| ENST00000298556.7 | 5884 | 133594183 | 133634698 | + | seg_192 | 133603350 | 133604800 | HPRT1 | HPRT1 = HPRT |
| ENST00000370796.4 | 5885 | 133594195 | 133634107 | + | seg_192 | 133603350 | 133604800 | HPRT1 | HPRT1 = HPRT |
| ENST00000462974.1 | 5886 | 133594381 | 133632671 | + | seg_192 | 133603350 | 133604800 | HPRT1 | HPRT1 = HPRT |
| ENST00000434384.1 | 5887 | 133684003 | 133693953 | + | seg_194 | 133684650 | 133685700 | PLAC1 | HPRT1 = HPRT |
| ENST00000339249.4 | 5888 | 134478721 | 134497077 | + | seg_195 | 134491550 | 134493250 | ZNF449 | HPRT1 = HPRT |
| ENST00000394155.2 | 5889 | 135229559 | 135293518 | + | seg_197 | 135231600 | 135232650 | FHL1 | HPRT1 = HPRT |
| ENST00000370690.3 | 5890 | 135229624 | 135293518 | + | seg_197 | 135231600 | 135232650 | FHL1 | HPRT1 = HPRT |
| ENST00000536581.1 | 5891 | 135229692 | 135292637 | + | seg_197 | 135231600 | 135232650 | FHL1 | HPRT1 = HPRT |
| ENST00000420362.1 | 5892 | 135229825 | 135290725 | + | seg_197 | 135231600 | 135232650 | FHL1 | HPRT1 = HPRT |
| ENST00000458357.1 | 5893 | 135230270 | 135290084 | + | seg_197 | 135231600 | 135232650 | FHL1 | HPRT1 = HPRT |
| ENST00000535737.1 | 5894 | 135230737 | 135293518 | + | seg_197 | 135231600 | 135232650 | FHL1 | HPRT1 = HPRT |
| ENST00000287538.5 | 5895 | 136648301 | 136653744 | + | seg_201 | 136650000 | 136652650 | ZIC3 | F9 |
| ENST00000370606.3 | 5896 | 136648677 | 136659850 | + | seg_201 | 136650000 | 136652650 | ZIC3 | F9 |
| ENST00000478471.1 | 5897 | 136650964 | 136652154 | + | seg_201 | 136650000 | 136652650 | ZIC3 | F9 |
| ENST00000370603.3 | 5898 | 137715011 | 138286269 | − | seg_202 | 138275750 | 138278250 | FGF13 | F9 |
| ENST00000370603.3 | 5899 | 137715011 | 138286269 | − | seg_203 | 138285450 | 138287700 | FGF13 | F9 |
| ENST00000541469.1 | 5900 | 137715011 | 138286269 | − | seg_202 | 138275750 | 138278250 | FGF13 | F9 |
| ENST00000541469.1 | 5901 | 137715011 | 138286269 | − | seg_203 | 138285450 | 138287700 | FGF13 | F9 |
| ENST00000436198.1 | 5902 | 137715116 | 138287168 | − | seg_202 | 138275750 | 138278250 | FGF13 | F9 |
| ENST00000436198.1 | 5903 | 137715116 | 138287168 | − | seg_203 | 138285450 | 138287700 | FGF13 | F9 |
| ENST00000448673.1 | 5904 | 137791014 | 138304939 | − | seg_202 | 138275750 | 138278250 | FGF13 | F9 |
| ENST00000448673.1 | 5905 | 137791014 | 138304939 | − | seg_203 | 138285450 | 138287700 | FGF13 | F9 |
| ENST00000421460.1 | 5906 | 137939674 | 138285687 | − | seg_202 | 138275750 | 138278250 | FGF13 | F9 |
| ENST00000421460.1 | 5907 | 137939674 | 138285687 | − | seg_203 | 138285450 | 138287700 | FGF13 | F9 |
| ENST00000370536.2 | 5908 | 139585152 | 139587225 | − | seg_205 | 139583350 | 139585350 | SOX3 | F9 |
| ENST00000498732.1 | 5909 | 139791945 | 139854839 | + | seg_206 | 139847900 | 139849150 | CDR1 | F9 |
| ENST00000456981.1 | 5910 | 147579633 | 147582135 | − | seg_207 | 147582000 | 147584900 | AFF2 | FMR1 |
| ENST00000370457.5 | 5911 | 147582139 | 148082193 | + | seg_207 | 147582000 | 147584900 | AFF2 | FMR1 |
| ENST00000370460.2 | 5912 | 147582139 | 148082193 | + | seg_207 | 147582000 | 147584900 | AFF2 | FMR1 |
| ENST00000342251.3 | 5913 | 147582228 | 148075954 | + | seg_207 | 147582000 | 147584900 | AFF2 | FMR1 |
| ENST00000370458.1 | 5914 | 147582529 | 147985907 | + | seg_207 | 147582000 | 147584900 | AFF2 | FMR1 |
| ENST00000468306.1 | 5915 | 149529689 | 149638367 | + | seg_210 | 149529400 | 149535200 | MAMLD1 | MTM1 |
| ENST00000445612.2 | 5916 | 149529836 | 149680503 | + | seg_210 | 149529400 | 149535200 | MAMLD1 | MTM1 |
| ENST00000370401.2 | 5917 | 149531551 | 149682448 | + | seg_210 | 149529400 | 149535200 | MAMLD1 | MTM1 |
| ENST00000432680.2 | 5918 | 149531686 | 149681395 | + | seg_210 | 149529400 | 149535200 | MAMLD1 | MTM1 |
| ENST00000454196.1 | 5919 | 150343664 | 150346308 | − | seg_212 | 150345300 | 150346350 | GPR50 | MTM1 |
| ENST00000535473.1 | 5920 | 150345056 | 150348932 | + | seg_212 | 150345300 | 150346350 | GPR50 | MTM1 |
| ENST00000218316.3 | 5921 | 150345125 | 150349937 | + | seg_212 | 150345300 | 150346350 | GPR50 | MTMI |
| ENST00000477033.1 | 5922 | 152907946 | 152913467 | + | seg_213 | 152910650 | 152911850 | DUSP9 | ABCD1 |
| ENST00000370167.4 | 5923 | 152907988 | 152916781 | + | seg_213 | 152910650 | 152911850 | DUSP9 | ABCD1 |
| ENST00000433144.1 | 5924 | 152908932 | 152916777 | + | seg_213 | 152910650 | 152911850 | DUSP9 | ABCD1 |
| ENST00000164640.4 | 5925 | 153067621 | 153095945 | − | seg_214 | 153094250 | 153095900 | PDZD4 | L1CAM |
| ENST00000393758.2 | 5926 | 153067623 | 153095351 | − | seg_214 | 153094250 | 153095900 | PDZD4 | L1CAM |
| ENST00000544474.1 | 5927 | 153068742 | 153095813 | − | seg_214 | 153094250 | 153095900 | PDZD4 | L1CAM |
| ENST00000475140.1 | 5928 | 153070548 | 153095311 | − | seg_214 | 153094250 | 153095900 | PDZD4 | L1CAM |
| ENST00000483693.1 | 5929 | 153071000 | 153095598 | − | seg_214 | 153094250 | 153095900 | PDZD4 | L1CAM |
| ENST00000480418.1 | 5930 | 153071037 | 153096020 | − | seg_214 | 153094250 | 153095900 | PDZD4 | L1CAM |
| ENST00000468491.1 | 5931 | 153072782 | 153095125 | − | seg_214 | 153094250 | 153095900 | PDZD4 | L1CAM |
| ENST00000480650.1 | 5932 | 153073438 | 153095792 | − | seg_214 | 153094250 | 153095900 | PDZD4 | L1CAM |

REFERENCES

Bailey, J. A., Carrel, L., Chakravarti, A., and Eichler, E. E. 2000. Molecular evidence for a relationship between LINE-1 elements and X chromosome inactivation: the Lyon repeat hypothesis. *Proc Natl Acad Sci USA* 97: 6634-6639.

Bailey, T. L., Williams, N., Misleh, C., and Li, W. W. 2006. MEME: discovering and analyzing DNA and protein sequence motifs. *Nucleic Acids Res* 34: W369-373.

Barski, A., Cuddapah, S., Cui, K., Roh, T. Y., Schones, D. E., Wang, Z., Wei, G., Chepelev, I., and Zhao, K. 2007. High-resolution profiling of histone methylations in the human genome. *Cell* 129: 823-837.

Berletch, J. B., Yang, F., and Disteche, C. M. 2010. Escape from X inactivation in mice and humans. *Genome Biol* 11: 213.

Bernstein, B. E., Mikkelsen, T. S., Xie, X., Kamal, M., Huebert, D. J., Cuff, J., Fry, B., Meissner, A., Wernig, M., Plath, K. et al. 2006. A bivalent chromatin structure marks key developmental genes in embryonic stem cells. *Cell* 125: 315-326.

Boyer, L. A., Plath, K., Zeitlinger, J., Brambrink, T., Medeiros, L. A., Lee, T. I., Levine, S. S., Wernig, M., Tajonar, A., Ray, M. K. et al. 2006. Polycomb complexes repress developmental regulators in murine embryonic stem cells. *Nature* 441: 349-353.

Brockdorff, N., Ashworth, A., Kay, G. F., McCabe, V. M., Norris, D. P., Cooper, P. J., Swift, S., and Rastan, S. 1992. The product of the mouse Xist gene is a 15 kb inactive X-specific transcript containing no conserved ORF and located in the nucleus. *Cell* 71: 515-526.

Brown, C. J., Hendrich, B. D., Rupert, J. L., Lafreniere, R. G., Xing, Y., Lawrence, J., and Willard, H. F. 1992. The human XIST gene: analysis of a 17 kb inactive X-specific RNA that contains conserved repeats and is highly localized within the nucleus. *Cell* 71: 527-542.

Cantrell, M. A., Carstens, B. C., and Wichman, H. A. 2009. X chromosome inactivation and Xist evolution in a rodent lacking LINE-1 activity. *PLoS One* 4: e6252.

Carrel, L. and Willard, H. F. 2005. X-inactivation profile reveals extensive variability in X-linked gene expression in females. *Nature* 434: 400-404.

Chow, J. C., Ciaudo, C., Fazzari, M. J., Mise, N., Servant, N., Glass, J. L., Attreed, M., Avner, P., Wutz, A., Barillot, E. et al. 2010. LINE-1 activity in facultative heterochromatin formation during X chromosome inactivation. *Cell* 141: 956-969.

Chow, J. C., Yen, Z., Ziesche, S. M., and Brown, C. J. 2005. Silencing of the mammalian X chromosome. *Annu Rev Genomics Hum Genet* 6: 69-92.

Chureau, C., Chantalat, S., Romito, A., Galvani, A., Duret, L., Avner, P., and Rougeulle, C. 2011. Ftx is a non-coding RNA which affects Xist expression and chromatin structure within the X-inactivation center region. *Hum Mol Genet* 20: 705-718.

Clemson, C. M., McNeil, J. A., Willard, H. F., and Lawrence, J. B. 1996. XIST RNA paints the inactive X chromosome at interphase: evidence for a novel RNA involved in nuclear/chromosome structure. *J Cell Biol* 132: 259-275.

Gartler, S. M. and Riggs, A. D. 1983. Mammalian X-chromosome inactivation. *Annu Rev Genet* 17: 155-190.

Greenfield, A., Carrel, L., Pennisi, D., Philippe, C., Quaderi, N., Siggers, P., Steiner, K., Tam, P. P., Monaco, A. P.,
Willard, H. F. et al. 1998. The UTX gene escapes X inactivation in mice and humans. *Hum Mol Genet* 7: 737-742.

Hasegawa, Y., Brockdorff, N., Kawano, S., Tsutui, K., and Nakagawa, S. 2010. The matrix protein hnRNP U is required for chromosomal localization of Xist RNA. *Dev Cell* 19: 469-476.

Helbig, R. and Fackelmayer, F. O. 2003. Scaffold attachment factor A (SAF-A) is concentrated in inactive X chromosome territories through its RGG domain. *Chromosoma* 112: 173-182.

Jeon, Y. and Lee, J. T. 2011. YY1 tethers Xist RNA to the inactive X nucleation center. *Cell* 146: 119-133.

Johnston, C. M., Newall, A. E., Brockdorff, N., and Nesterova, T. B. 2002. Enox, a novel gene that maps 10 kb upstream of Xist and partially escapes X inactivation. *Genomics* 80: 236-244.

Keane, T. M., Goodstadt, L., Danecek, P., White, M. A., Wong, K., Yalcin, B., Heger, A., Again, A., Slater, G., Goodson, M. et al. 2011. Mouse genomic variation and its effect on phenotypes and gene regulation. *Nature* 477: 289-294.

Ku, M., Koche, R. P., Rheinbay, E., Mendenhall, E. M., Endoh, M., Mikkelsen, T. S., Presser, A., Nusbaum, C., Xie, X., Chi, A. S. et al. 2008. Genomewide analysis of PRC1 and PRC2 occupancy identifies two classes of bivalent domains. *PLoS Genet* 4: e1000242.

Lee, J. T. 2011. Gracefully ageing at 50, X-chromosome inactivation becomes a paradigm for RNA and chromatin control. *Nat Rev Mol Cell Biol* 12: 815-826.

Lee, J. T., Davidow, L. S., and Warshawsky, D. 1999. Tsix, a gene antisense to Xist at the X-inactivation centre. *Nat Genet* 21: 400-404.

Lee, T. I., Johnstone, S. E., and Young, R. A. 2006. Chromatin immunoprecipitation and microarray-based analysis of protein location. *Nat Protoc* 1: 729-748.

Lyon, M. F. 1999. Imprinting and X-chromosome inactivation. *Results Probl Cell Differ* 25: 73-90.

Lyon, M. F. 2000. LINE-1 elements and X chromosome inactivation: a function for "junk" DNA? *Proc Natl Acad Sci USA* 97: 6248-6249.

Marks, H., Chow, J. C., Denissov, S., Francoijs, K. J., Brockdorff, N., Heard, E., and Stunnenberg, H. G. 2009. High-resolution analysis of epigenetic changes associated with X inactivation. *Genome Res* 19: 1361-1373.

Mikkelsen, T. S., Ku, M., Jaffe, D. B., Issac, B., Lieberman, E., Giannoukos, G., Alvarez, P., Brockman, W., Kim, T. K., Koche, R. P. et al. 2007. Genome-wide maps of chromatin state in pluripotent and lineage-committed cells. *Nature* 448: 553-560.

Namekawa, S. H., Payer, B., Huynh, K. D., Jaenisch, R., and Lee, J. T. 2010. Two-step imprinted X inactivation: repeat versus genic silencing in the mouse. *Mol Cell Biol* 30: 3187-3205.

Ogawa, Y., Sun, B. K., and Lee, J. T. 2008. Intersection of the RNA interference and X-inactivation pathways. *Science* 320: 1336-1341.

Payer, B. and Lee, J. T. 2008. X chromosome dosage compensation: how mammals keep the balance. *Annu Rev Genet* 42: 733-772.

Plath, K., Fang, J., Mlynarczyk-Evans, S. K., Cao, R., Worringer, K. A., Wang, H., de la Cruz, C. C., Otte, A. P., Panning, B., and Zhang, Y. 2003. Role of histone H3 lysine 27 methylation in X inactivation. *Science* 300: 131-135.

Pullirsch, D., Hartel, R., Kishimoto, H., Leeb, M., Steiner, G., and Wutz, A. 2010. The Trithorax group protein Ash2l and Saf-A are recruited to the inactive X chromosome at the onset of stable X inactivation. *Development* 137: 935-943.

Reinius, B., Shi, C., Hengshuo, L., Sandhu, K. S., Radomska, K. J., Rosen, G. D., Lu, L., Kullander, K., Williams, R. W., and Jazin, E. 2010. Female-biased expression of long non-coding RNAs in domains that escape X-inactivation in mouse. *BMC Genomics* 11: 614.

Silva, J., Mak, W., Zvetkova, I., Appanah, R., Nesterova, T. B., Webster, Z., Peters, A. H., Jenuwein, T., Otte, A. P., and Brockdorff, N. 2003. Establishment of histone h3 methylation on the inactive X chromosome requires transient recruitment of Eed-Enx1 polycomb group complexes. *Dev Cell* 4: 481-495.

Simon, J. A. and Kingston, R. E. 2009. Mechanisms of polycomb gene silencing: knowns and unknowns. *Nat Rev Mol Cell Biol* 10: 697-708.

Splinter, E., de Wit, E., Nora, E. P., Klous, P., van de Werken, H. J., Zhu, Y., Kaaij, L. J., van Ijcken, W., Gribnau, J., Heard, E. et al. 2011. The inactive X chromosome adopts a unique three-dimensional conformation that is dependent on Xist RNA. *Genes Dev* 25: 1371-1383.

Wang, Z., Willard, H. F., Mukherjee, S., and Furey, T. S. 2006. Evidence of influence of genomic DNA sequence on human X chromosome inactivation. *PLoS Comput Biol* 2: e113.

Wutz, A. and Gribnau, J. 2007. X inactivation Xplained. *Curr Opin Genet Dev* 17: 387-393.

Yang, F., Babak, T., Shendure, J., and Disteche, C. M. 2010. Global survey of escape from X inactivation by RNA-sequencing in mouse. *Genome Res* 20: 614-622.

Zhao, J., Sun, B. K., Erwin, J. A., Song, J. J., and Lee, J. T. 2008. Polycomb proteins targeted by a short repeat RNA to the mouse X chromosome. *Science* 322: 750-756.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

For example, other embodiments can include the following:

2. The method of claim 1, wherein the inactive X-linked allele is associated with an X-linked disorder, and the oligonucleotide is administered in a therapeutically effective amount.

3. The method of claim 1, wherein the cell is in a living subject.

4. The method of claim 1, wherein the inhibitory oligonucleotide is identical or complementary to at least 8 consecutive nucleotides of a nucleotide sequence of a PRC2 binding site in a region of a gene encoding the allele on the X Chromosome that is marked concurrently by H3K4me3 and H3K27me3 and coincides with a CpG island.

5. The method of claim 1, wherein the oligonucleotide does not comprise three or more consecutive guanosine nucleotides.

6. The method of claim 1, wherein the oligonucleotide is 8 to 30 nucleotides in length.

7. The method of claim 1, wherein at least one nucleotide of the oligonucleotide is a nucleotide analogue.

8. The method of claim 1, wherein at least one nucleotide of the oligonucleotide comprises a 2' O-methyl.

9. The method of claim 1, wherein the oligonucleotide comprises at least one ribonucleotide, at least one deoxyribonucleotide, or at least one bridged nucleotide.

10. The method of claim 9, wherein the bridged nucleotide is a LNA nucleotide, a cEt nucleotide or a ENA modified nucleotide.

11. The method of claim 1, wherein each nucleotide of the oligonucleotide is a LNA nucleotide.

12. The method of claim 1, wherein one or more of the nucleotides of the oligonucleotide comprise 2'-fluoro-deoxyribonucleotides, 2'-O-methyl nucleotides, ENA nucleotide analogues, or LNA nucleotides.

13. The method of claim 1, wherein the nucleotides of the oligonucleotide comprise phosphorothioate internucleotide linkages between at least two nucleotides.

14. The method of claim 1, wherein the nucleotides of the oligonucleotide comprise phosphorothioate internucleotide linkages between at least two nucleotides.

15. The method of claim 1, wherein the oligonucleotide is a gapmer or a mixmer.

16. A method of activating an inactive X-linked allele of Mecp2 in a cell, the method comprising administering to the cell an inhibitory oligonucleotide complementary to 10 to 50 nucleotides of a PRC2 binding site in a region of a gene

SEQUENCE LISTING (10169 sequences)

SEQ ID NO: 1 - DNA, 4553 bp, mus musculus
  misc_feature (2)..(2): n is a, c, g, or t
snaggcatagaggaaggtggaggcggagaaggtggaggggaaggtggaggcggccgggaaggtggacgccaccgggaaggtggagacagcagggaaggtggacgccaccgggaaggtggagatcgcggagggtccgggccgcggggctgagctcaagctggagctggagcaggagcccgagccggagcccgagccggagcccgagcgggagcccgagcgggagcccgagccggagccggagcgggagcccgagccggagccccagccagagcccgagccggagcccgagcccgagccccagccggagccggaacccgaacagaagccggagcccgagccggagcccgaacccgagcccttacaggagcctgagcctgagcctgagcctgagcctgagcctgagcctgagaggcagcccgagaaggagccgaaggatgagaacccagcgcagagcggtgttggcggcagcggcgacgaggttcctccccccacccttccctccgaccctccgcggccccctgatccctctccgcgtcgcagtcgtgccccgcgccgccgaccccggccccggccccagactaggcttcgtaccccgccgcagcctaggccacggcccccaccccggccccggccccggcgtggtcctgggggcggatgcctggatgtggattttgctgtggggccaccaggttgttcccacgtgaacagctttaaggtgggagagaactggaggcaggaattgcgggttatctaccagtgcttcgtgtggtgtggaaccccagagaccaggaaaagcaaggcaaagtcgtgcgtctgccatgtgtgtggcacccatttaaacagactccactcttgcctttcctgcgtcttctttggctgcttcacagagaaacacatccacgagcacgctgagacaaaacagcacaacttagcggtagatctttattatggaggcatatactgcttcatgtgtaaagactatgtgtatgacatagacattgagcaaattgccaaagaagagcaaggagaagccttgaaattacaagcgtccacctcgacagaggtttctcagcaacagtgttcagtgccgggacttggggagaaatatcccacctgggaaacgaccaaacctgaactagaacttctggggcacaacccacggagaagaaggatcgcctccagctttaccatcggcttacgaggactaattaatcttggcaacacgtgttttatgaactgcattgtccaggccttgacccacactccaatactgagagatttctttctctctgacaggcaccggtgtgaaatgcccagccctgagttgtgtctggtctgtgagatgtcgtcgctctttcgggagctgtattctggaaacccatctcctcatgtgccctataagttactgcacctggtgtggatacacgctcgtcatctagcagggtacaggcagcaggatgcccacgagttcctcatcgctgcgctagatgtcctgcataggcactgcaaaggtgacgatgttggcaaggtggccagcaaccccaaccactgtaactgcatcatagaccaaatcttcacaggtggcctgcagtccgatgtcacctgtcaagcctgccatggtgtctccaccactatagacccatgctgggacattagtctggacttgcctggctcttgcacatccttctggcccatgagccctgggagggagagcagtttgaatggcgaaagccacatcccaggcatcaccactctcacggactgcttgcgaaggtttacaaggccagagcacttaggaagtagtgccaaaatcaagtgtggtagttgccaaagctaccaagaatctaccaaacagctcactatgaagaagttaccagtagttgcctgctttcatttcaaacggtttgaacactcagcgaaacagaggcgcaagatcactacgtacatttcctttcctctggagctggatatgacaccatttatggcgtcaagtaaagagacccgggtgaatggacagttgcagctcccaaccaatagtgcgaacaacgagaataagtattccttgtttgctgtggttaatcaccaaggaaccttggagagtggccactacaccagcttcattcggcaccacagggaccagtggttcaagtgtgatgatgccgtaatcaccaaggccagtattaaggatgtgctggacagtgaagggtatttactgttctatcacaaacaggtcctggaacctgagccagaaaaggtgaaagaaatgactccacaagcctactgaagcaccacacaggcctacctagaatggaagatgacaccagtactacaccaggcatcgagatttaattgatctatgtgactgaggccgatgggccttgctgagtaagaattgaacagtatccagtgtcccaaaaagtcctgatcagaagagaaataaataggaggggagggagaagaggctctagcctaagcagtcatgtgaaggaaattaagtggcaggagtgttctggatggggaagggtaggcagagcagggaaattgtgacactggttcatatcctatattcctccaaaagattgtgtgggaaggtgtaggggggaggggggtggtgttggggtgtgtgtgtgcccttgtaactgtaaaacatctttctccatgggtgtctcagcttcaattgaccaatcatgtaacagccacatgtttgtggggggaggggaatgaaaaagtttcttaaaatgtagcccattgtgtacatggggatgaaagcagagacatggaggaggcgaggatatctcattgacaaacacctttgccagtttctttgtattcgtgatttttgtgctatgaaatgcagtattaaaaacaagaaagctcacctgggctagcgaaagaagaaataaccaggcttatggaaggggagcggcagatgctccaaaagtagagagggctagaaatgctgtaagataagcaattaacaaggacaggcctcagctgacagtgtaggtgtgtgtgtatgtgtgtgtgtttatgtgtgtgtgtatgtgtgtattttttttaaagctgtatgatgtacttgagcaaatcagtgaacctctttgtgattcttttctcatctgtatcatgcagataattcctaccttaaagggtcgctgttaaagataaatgatatacaatgtgtcaaagtcaaaggcttggaactttgtagagactcagtaaactgtttgttggctctgaatctgaattttatttggactgggccagaatgtatcggaggtgaataccaatcccacctgagacctgtggacagaaatgacaccaccatgtcacatgcagtcataaacaagatcaatcttaattctccccagggcatggaccccactgttgtgtataggccaccataatcagtgtcatacctctgattgattgggggcagaggagcacaactatcacattttgtccctttagaaagacaatgacattgttttaatgactcaggcatccacccgatagtgtttggtggtttggggtgttttgttgtgccttcagaaagcattgtgagcgtagctccagtatttaccagcaagcagagatcagaagacttccaaaattcggggctccatcagcttagcgatgctggcagaatggcttgctccactggacagagcagcctggagagaggtaagctgaaacagatgggaagacctcgggatagggaaaactctgtgcatcctttcctcagccctggttacaaaaagtagctgttgcctggaaagtcctgggacttagctcaatgtggatcagatgcatgggcattggatccattgtctctaataaaaggggtggggttcccaacagcttcccaagtttacttagtggccaactcatttggaaatacaggcttagatggttgtgggtagaatccattgatctcataatttttgtttattttgatatagggttgaacccagggccttgcatgtgctaggcaagcactctgcccctgagctatatctcctagcacatctgagtccttgtgaaggcaggagcagcggtttcttttggatcctgggttacatcttcagcccctggcacatagttcctggcatataacgagcaggtacttaaaacatttactggatggatggatggatggatggatggatggatggatggaacatactccttccttccattattatccaaatgcttttaataccacagtccttagaagaaaatggtttgctgttatttagggtgtttttttttttttttttttttttaggatggggaggtaaatgggcagtttcagataccatttggtcagttatttggccaatctagggggatgggattggtagccctgttgaggaagacacagctatgtccccattcttcatttctgccatgtgaagaattcactcagatgtgtgccagcagattttgactgcttgcacagaaattgtcctttaacatttccaagtgtttaatttggaaacaaattcaaactcacagaaaatgtataaaaataataaaaacacccttttgcactc

SEQ ID NO: 2 - DNA, 2118 bp, mus musculus
gtggtggcgcgggggccacgcagacctggggtgtccccgtccggactgagggagcgcggtggttgtggcagctggacccaaaagggactttcactgaaggaggcggcagcggaagcaggcgacgcccccgggaatgctcccgccgaagccccctagcggaggccgcttctgcagccaggccccgtttcctttaattcaatatttcccaaacttgctggttcacgacaatcacgtgggggagcgtgttaaaattacagattcctcggctccacccgcaggcctactgaatcagactcttgaagggaggtactccggaacctggatctctaactagggccggagaaactgctagtgatcaggcaagtttgggaaacacagctctaattcattgaggctggcgggaagtggggcggggaccgcgcagtctctttaaggcgcttccagctctccgctccaatcgctgctctgaccccctaggcggtctcctcccctctagtactgccctcaagggtgcagcttcccctagcctgtggggcggggggcccgaagggttgtcttgtctagaaacgtttctgaggccataaaatatcccttcacagtctggtacttgagaataaaggcgggagctccgacatccatcattccagcggctgaacctgcctccagcagctgaacgtacccccaacatgtctcagtctccccctctaggtccaactcctgctctcccagaaacgatgaagctcaaactttactggggaccagcctgaaccccagatctagagggacaacagtgctcccaaggccgctccacctgaagggacatgtctctttgagaaacttatcagcccatcctgtgctggctccttgcctcccactcaggctccaaaggccctgggtgggatgactggttgacagctggcctccagatacagcactccagatactgagcagcctgtgggcagaaacagtcactccaaggccagcaggggaaaccagacactgcaaggctgttcctacaggttgcacctcccttacgctgcaaggaacccaaactacaaagtctgagacccataagatttagcagagtcttgggtgggcagcacgtaggaataaagcgggtatctttggagctgccagtgaggagagagtctgggggcctgctgtatgaaaagcagcatcatagagcccaggaagaatgagtccagaacaaacagctcaggtcttgggcagagtggggatgtcagaagcagctgcaactgctgcttctggagggtgcagccaaaggcagggatcagcacgtggggagagagtgagctaagaagagtccagtgcctcagtgtgacagccggctgtacctggtgcacatggatggtcctactctagggggctctgctgtctacaaagcatccctggtcagcattggaaatcagcctccacctgagtcatgcttcatagaggaagcaaagacatactccttggggattagtcagggagctggagcccttatggaggctgtgtggttcctagctagcctaaggctaccttagtgcctgccttccctaagtcagctctgttttcaattccttgaagtgtccttccaacaaatgcctgccctttgtcacctgcaactagaggaagtccaaccagtatggctaccaaaggaatgatgcagctgctaagaatgactgagctcatggagcacgagtgaagaaggcaaggaaggagaacgttcatcctatcctcacaggctaccaaccaacaaagaaatctaaagatcgccatgcttaggagtcctgctgctgaataatggctatgtaacccagttgccccactactcatcagcttcctgtgaagctcacagaggaacctgggcactgccaaggccagaaaactctggaagtggggggctctgccatcattcaccccaccatctatggccaggcactaagagctatgtactatgtattaagagcactgagccaaagacaccccaggattagatttggctttcctaaaaggaacacacatgctaaagaagtggctttaggacaactagcagaaaagaagcaccaaatatttaaataaataaataaatgaatgaatggatgaatgaatgaa

SEQ ID NO: 3 - DNA, 30932 bp, mus musculus
cagaggggacgctgtgctctgggaatgttgatgttttccagtgagtgtaactgagttccagatggaatccttggagagccgagtcttactgtatatagtaagacagaccgctctgtttatgcacagtgccgacgcctctgagctcaaacctcggggaaagtaaagcatagactgggagccgaaaggagaagctgggaagaaggctgccgactttgaaattcgaggcggaggacttgagaacgagcgctcaacccggattggccagtgggtgtcgtcaaggctttacgcgcctcttcaattggctggtgtctgcagtcgtcccggcgggcgagccttttgcccacgtacttccgtgcagggggcggggctgcgtcctgttgtgcatgcgcacaaccaggaagccccacccggtagttgaggaacctgcggaggggcggggcgaagcggtgcttgttttggttgtgtttcctctgaagccgaatcccggaaccaggtagcagagagctcggccggccttggagggagacaaggctgcgaccaatccgtctccgtaccgtcccactggacttcacatccgggatctcctcctgggcgtgacccgcgtcccgtctgcggtcctcgaaccggtgtcctgatctctttatccaggccttgctgttcccgtcgtgcctcgcgcacgaccgtagccccctcatccgggttctctcccggcgttctccgcgtttgctttgctgtggggtacttggcggtgccgccatgactattctccccaaaaagaagccgccacctcccgacgccgacccggccaacgaaccgccgccgcccgggccgctgcccccggcgcctcggcgcggtgcgggtgtaggcgtgggtggcggcggcacgggtgtgggcggaggagagcgcgaccgtgactccggcgtcgtgggggcccgtccccgggcttcgccgccacctcagggcccgctcccggggccgcctggtgctcttcatcgttgggcactggccgtgccgcctggcgcagtcgcgggccctcggccacagcaggcttctccacctccttgtgggggccccggtggccccggcggcggtcctggtgacgctcttggtgcgacaactgcgggggtgggcgcggcaggggtggtggtgggcgtgggtggtaccgtgggcgtgggcggctgctgctcggggcccgggcacagcaagcggcggcgtcaagctcccggcgttggcgcagttggcggggccagtccggaacgtgaagaggtcggagcgggctacaacagtgaagacgagtatgaagctgccgcagcgcgaatcgaggccatggatcccgccactgtagaacaggtaagggctggaaggtgaggggctgttgggcagaaacagcgagtgagtctaccaggctgagaaggagcgcaagaaaatgtttgagattggtccaagaaacccaggtcttgatgctgggcttgacattctttcctggtggtggaggcatggcttcccccgaggacttgataggggctctaagttaagtaagttaaagtactcttttgcagtcctgagatcttctctaagtgactggcattgggaattccccaggagtcgcagatacgatggagcccttccttagaggaagctctcaggcctctctaagggactttggttcagtaactttttcctttaggacaagtgtgagattccctcccgcaaagaactcgaattaaggtggtgtcctcagagaaatagtctaagcatacccaagaaacttaaacccttgatgtaggaaggacctctctcttttgctgagtctgctcaccagccatgtggcctcctcaggagtcctaagcctgtatttggggacctagacttgcttgtagaattgaaggtttagagtatacccacacaccttttagatagtgatttccaaagtatccctccagtgttgtgaaacgtctttctggaagataaaattctcagtggcttagggacaaaggccaaaaccagtacctagaagcagaactgtggctcacagtcggtgttgacgtaaagacctctttgcttatggcccggggtttaattacagatgttccaggcaagaggacttcttcagaacacagtttcagtcatgggctggtgtctatgctcttgtgtgtgtgtgtgtgtgtgtgtgtgtgtgtgtgtgttcatatatttccctaaggatggatggatggatatatatatatatatatatatgtgtgtgtgtgtgtgtgtgtgtgtgtatatatatatatatatgtcgtacctattgaaatttacttcagggattcaacatctcagttctccctttctgtgcatctggaattctctgatacccaaggggctgagctgttaatctcataggaaaagagctctcaagtcactagacccagattaagttccttggaaaagaaaacttgagagtctctctcaggaagcgctccatctcatgtggagaactctcacctattgactttgcggatggggtctagagtctggcctggaaacattgcgtcctgtccaatccctgcctcagaaactccagcctcaggacatgggcagtttggagacccagaggccatgtcagatacctccctctaaatctgccttcaagggcctgagactctgttctgtgaaggacataataaggctttctttaggaacaggaaccccatccttgccactgaagactgtttgtagaggtaatgcctgaagttcttcctcctgtaccttgagatgctcctcacacccagtctgacatttcccaccaggactgggtggggcatggttataggtttcctgaggaatgaggaaattctcaacatcacatcagttgtgtgaggaattgttctacaccttaggatctgaggcctgaatcttttggggctgtcacctaagatgacctaagtatcctcttcataggaggcttttaggaacataagtctcttttggggtttatttgaacctgggaatgatacagttttgaggaaattagttttaggcctctttccatcttcctcaggaaaaagagattcctttgccttggggactgagacctgagtccttgcttaggcatgcagctctcctcccaccacaccaggtgattctttctcaccagggagaggacatgaagtcatcttcaatatggccagaggcttccttctttggacagagcacctgggtgttctggtttcttcttaccctcaggtcagagccaagaaggctgtcaggtcttgggaccagaagcctgaggcatcccttggactggtagaggttctgaccctattttcattgtttctcacttctggaaatttctcttacattccatttccttttggttgaaaaatttgttttacaggggtcagagtgtggtctcacatccactgttgttcttcttttcctgtcatttctggcggaacaatcatctagactcatctagagatgtcaggttcaggaggttttgttgttgttttgagacagggtttctctgtatagccctggctgtcctggaactcactctgtagaccaggctggcctcaaactcagaaattcgcttgcctctgcctccggagtgctgggattaaagtgtgtgccaccacttcctgacttccaggagttgtttgtttttcttcaaaacaagatttctctatgtagtatttttctggaacttgctctgtagaccaggctggcctttaacttggctatccaagtgctgggattacaggtgtgtgcacaaccactgcctgactgtgtgcaggagttacagatccctgctttttgtaaagtctctttacccttacagaggtatgtatcccttatccaggggaaagagaaggtatgttgttggagatgcaaaaggccacattcttataccccttgcagttccgcccttatatttatcttcataagaacttagaaataagaactgacggactcatgaaacctgctcttccctgtgatgggagaggctttctgttctatgggcacaaagggaagaaggagctactcctagtctccctgactcgcctggcccagctttgagcctcttgaggatgagaagaaggggtattggtcctgccactccaatcttggttcatagctgttgcagatgctcataacatagaggctgtttcagtactgacagaggggattagtctgaatggtaaatctggttccagttctgcgaatatgtactcctgtttcctttaggattctccgagtaccttgggttggagtcctggggaaatgatgtcatagggtgccttttgtcagagcctagccactgaaaacaatggcttataagcatcctaagccaggagaactcagagatcttggagtaaaggacaaacatgctgagatagtggaaaatgctaggtttagcagtacagtcagtgtgtctggttctacctctcagtcagccacattctgcagagtgaactagtacagcttctgttctctgcacctgatttactttcactaatgtgttggtgtgttgcagtcaactttggctttaagggatttcaaagccccctattcctgcactagatagtgaatagtgggtatcttttgaagaggagctgggttccttctctttccactttgcttcttttccagtcatagaagtttgctgggcaggtcaaagccttttttgtataagggttaaggatgatgtgtggcagtgttgtagccagctatcaagttccacagttacatgtggaaagaatttgggatttggagctggacaggctggagttcaaactccagtgttaactgttgaactgttttaagattgtagaactctcatttagggcaaaattcatgagggttactagagtgtaaacatctagccttgtccaccttggctagttcttttcactcaggatgagcaattggccccaggataatcttttctcctcaagaggctttgcctatccatggtactcatctcttggcatctagaagcctgcccatctggaattgggtggttggctgcatttgagtgcttgtttgtttgtttgtttgtttgtttttttgagacagggtttctctgtgtagccctggctgtggctgtcctggaactcactttatagaccaggctggcctcgaactcagaaattcgagttctgcctctgcctcctgagtgcttaaaggcgtgtgattaaaggcgtgcaccaacacgcctttgcgagtgctttttctatactaaacttttgtgtggtctttggatagttcccttttccaggtcttttgttttgggggtttgtttatttttcaagacagggtttcctctgtagctctggctgtcctggaacttactctgtagaccaactggcttcagaactcagaggtctgacctgcctctctctgactgttgagttccagggttaaagctgtgtgccaccatacctcacactacttgggtcttggtttttctacctattaaatgggtagttgtgaggacagtggttggactcattgcagtgaagaaaggtgtaatctcatctttaattctctgttttacactcttctcaacctttattggattttatgtgggaccccttggctctggggatggctcagaatttctctatgtaatggtcctggtggtccttgaatttactctgtagaccagactggcctttgaactcagagaactggctgcctcttcctcctgaatgctgtaattaaggcctgcgccaccactgaccacctagaatgttatcttttagaagatgtgatgtgatgtttgcacttcttgggagtgcttataagttcttcagtgtttttgcatttgtttactgtgctgaaactagggcgctcaattttctggcatgaaggctcatgagtatgatcccatcatttgggaggttgaggcaagaggattgccaagagtttgaggccagcctgagctatggtgttgagaccctgtctaaaataaccaaaataaaaagtgtacaattcagtggctttcaaaacagccatagaattgtacttctgtcaccagttttatttttttatttatttttatttattttttttggtttttcgagacagggtttctctgtgtagtcctggctgtcctggactcgctctgtagaccaggctggcctcgaactcagaaatccacctgcctctgcctcccaagtgctgggattaaaggcgtgcgccaccacgccctgtcaccagttttaaaatgtttttaatattatagacccttttatagcttttaatgccccccattccttcctccctttccagctcctggcaacctattaatttgtctggattgaactattttgaaacaagtagaatcatacactaacgtcatcctttgtaactttgtctcttttggatagcatgtgttcagagcacatcatggcatagcatttacctatactttgtttttattgcctagtaataaaatcttgggttttttaatcctctggtggcccagaaatagttttttttggggggtgggggtcttctctttcttctattctggtaggcttgtgtgggtccttagagaagcagtatgtctgtttctcattggatggattgcctgtgtttattatccctggagcagagccagtgttcctgggtgttttgggtgagggggtggtgttggctccaggtttgctgggacaaggctgtgaggcctagaatactaaacacctcttggccatgggctctgagaagacatctgtccaatgccgttgccatccttccctgtacccttccccctttattggcagttcttttacccacaggctgggtcagcaacttcccaggctgagagggaggattctgggcccctactgccttttaattctaaccctctctcgggaggtggatcactcagaatggaagccttgctgtgtatagtctcacagccacaaagccctagagctcacaccaaaggagtactacaaggggggatatattaatttcctgtggttgttgtgacaaataaccatggactgtttggcttagaataacagataaattctgtttcagttttggtggtcaaatgttcaaaatgggtttcacttggccaaaatcaaggtgttggtgtttactgaacatcctccagcaagtctgggaaagagtctagactttctccctttctgatggccgcatcacttcagtttccacctctttctctggatgcatgtgtatgttttccttttctgtatgaaatctcctgtaaatcttctccctcttctcactctgtacaggtgtagcactttgcttttgacaaacgcaacgtaaggaagagaagagtttactgttacttacagctggaggggatacagtccagcctcatatggggaaggctgctggcaggagtgtaaggcagccgctcatatgtctgcagccaggaagcagagagatggatgctggtggtacacggtctacttttctccttaagcacaggacccctcaagcccatggggtggtgtcatgtttagggtgggccttcactcctccgttaatgctcttgaaattccctatagaagcacaccaagatgtatgtttcttaggtgatttcaaatccatttgagttgataatgagggttaactatcacaaatctacccattctcaactcctaagccttactacctttaaatatcaatattttactcctgttcctccacatttgatagcaatctcaaggtagataacacatttagttcattgtaagagtagtcaaattcttagcagttctaacattgttcaaaaatcttaagttcaaggcctggtgaggtgtggtgtataccattaataatagcacctgggaggtagaggcaggtagatctaagtagttctaggccagccaaagttgcatagtgagacttaattgtgagtctctgtaaaattaacaaacaagttacattatctaatatacaagggcactgagcaaacattcccattccagaagagaggagtgaagatattagcaaagagattagatgaaagcaagactgaaacctatcagggaatctagttcatgcccaacacctgggctttttatggcatcacctgtgttccaacaagcttgggtagttgtgctctcatcagctctgatgctttgagcatatgtagcctctgtcttgagtcagcttcactaagttcctaaaacagaggctctcaacctgggcactgaaccctttcataggatcacattggaaaacacagatatttacatgatgattcattagagtagcaaaactacacttaagaaataacactgaaaatagttttttctttccattttttattaggtatttagctcatttacatttccaatgctataccaaaagtcccccatacccacccacccccactcccctacccacccactccccctttttggccctggcgttcccctgtactggggcatataaagtttgcgtgtccaatgggcctctttccagtgatggttatggttggggtcaccacaacgtgaggagctgtattaaagggtcgtagcattaggaagattaagaaccgctgccctaaagcttttcttgacagatctttctggcatctctggtacccttgaggtcacctttgcaaaaagcattacctttatagcttcataaaatggtctcttagggtcttagtgcaggcaatctggccctgctaccttggtgcaagactgtgtgatcaccttgttgaattctggatgtctgaaaacgcacatgatgtggatgatgtcaagttatgctaccagctcaagatggaacctagttgtattagagcacaggcgctgtggcctttctctgccttctagagcatttcctgcagtttactctagagtctctgctttttaggcattatgttcttcatgtttccggttttatagcctggagcctttactgggtaggtaggctcttatccccaaggcagtatatataccatatagagtttagggtttttcttaattgcacagatttcattatacttctagacactttgtccaaaccaaactttttaaggcagtcaagctcctttcctcaccaaactgcacatttctagccctttatttatttatttatttatttatttatttattgagttaggggctcatgtaggtcattgtggcctcaaatttggtaatgtaactcaggctgactttcctttcctcttgtctctacctgccaaatgttacgactataaacataagcacaatatccagttaaaccttgtttatgcttttttttcctccccaaactgtacattttccacatctagtatggtttgcatgtcctcagtggattaatgcagtgagtagtaaccacaagtagaacgaaagcctagaggttatgctgactaacaatttgacaagcaatttagtccattacttttgcatttagccttgctcaaatgatcaggtgggcataatgattgccagaattaaaaaaaaaaaaatggccagccgggcgtgatggcgcatgcctttaatcccagcacttgggaggcagagagaggcaggaggatttctgagttcgaggccagcctggtctacaaagtgagttccaggacagccagggctatacagagaaaccctgtcttgaaaaaaaaaaaaaaagaggaagaaaaacaaaaacaaatggcctctagtcctttgacatatctgagatctctttaaccaggacttaattgttcgcatttctgtattctgttagtcatcattcctactagaatagactgttaagctctactttggcactctaggtcttctgtagcccacagaactaaaccttttaagattcttcctgcaaccacctctaaatgcctacaaattgtatggtcatgtatacacagcagtgaccccacttctgggtactaactttatctcttttctcttgttgctgtaacagaatacctgacaaaagcaacttaagagatttatttgaggggtacagccccatcacagtgggcaaggcatggcagtgggaacgtaagatagcctttcatgttgcatcagggaagaagtgaagaatactgatgctcaacttcctctttccttttcccgttttttattcagcccgagaccccagcctatacgatggtgtcatgtacattcaggtaatgagttagacttacctggcaactccctgaagaaattcccatctagagttgtcttttaagtgattccaagtctagtcaagttaaaaataaacttgctgggcatggtggcgcacgcctttaatcccagcacttgggaggcagaggcaggctgatctctgacttcgaggccagcctggtctacagagtgagttccaggacagccagggctacacagagaaaccctgtctcgtaacacacccgcccccaaaaattaacatccacacctgagattgtgcctagactccagtgttccagtcacttctgcaaaacccttttaaaaacacatacaggttttaggcattaggtctgatattttcaggtggacattattcagtctaatccagatcgggagggaatgggaactcattaagagatgtcctgctgctgggttaggtatatgcactggtcttaccatgttttccaccagccggaagtagttggcttgatagcactttggaaagatgtagttacaaactgataaggtactcctttaatcccagcactctcggcaggcagatctctagtagtttgaggccagcctggtctatatagtgagttcaaagacagccagggctacatagaccttgtctcatctcctccccttcactctactggacaaagtactgcctagtatcccacgtactaggaagtgtatattcccatttcacagattggaacactatggctcaaagcagttcatcacttggcttttatttggtagaactgcattgaaacctaaatcagtggttccatagcctattctaacttctcttaggcttttaggtgtttttgtttgtttgtttgtttttggtttttcaagatagggtttctctgtatagccctggctgtcctggaactcactctgtagaccaggctggcctcgaactcagaaattcaagttttgcctctgcctccggagtgttgggattaaaggcgtgcaccaccaccgcctggtggcttttacgttgttaaaccagcttttaaacagggtcctgtcttaactcctgggatactatggtatcagagagctttgtctagtccttttgctaaggcttagagatggggagagagactctgctccaggattggtcttgaacatgtaaagttcaggattgagacttgatcttctcgggtcaggacaccaatacagaatacatctacagattgttggactgttctccagccttctagcacttcctaaacatcttcttcccaaagtgagagaggaagaaagctagagctctaggttttcaaactgtgatacgaaggccagtggatgcttagtgatacatcctctagatgcaggcctagatgccatagttatcgtaggacccacactctatttgtgcaaaaggtctgtctagtcagacttcctttatttttaggcacatcagaactcctccaggacttgctaccaggcatgtgtcaccgctcatggtacatcatgtgctgtgtctctactactaggctttgctactaccctgactgcagctcctttctgcctttgtaaagtgtgggtaatgctgcttcctgccacttgggttgcagtgaggacaatgaaatgaggtcacttttgtatctggcacctggcataggacaaagcactcagctaatatgagttcatcctttctggcttttccctgcttagctgcctagttttgcttgcgtctttgctctcctatacacattgccaggctttgagcatctctggtgcttggtgacagaaatgactttatttcttatccacttatcaagcaagttttgatcctttgctcaagtgccagctttaatgtcagggtaaggtctcttcctgcttcacaaaagcaagggagcattcatttgttttgcagccccactcaaactgtacgtcatcactgcgtatttctgtacccttcccttcaaagtttaccagggtagagacggaagtctgattcatttttctgtcttcattgtccatcccagaatgactcctattttgtgagatgagaactaggccccctctttttctctttgtatcccttctatcttcctcatctaccttggagaatgctgttctcccccctttaactctccctattttaaggtatggggctatggttaaaagtttcttttctgaggcagaggcaggcggatttctgagttggaggccagcctggtctacaaagtaagttccaggacagccagggctatacagagaaaccctgtctcggaaaaccaaaaaaaaaaaaaaaaaaaaaagtttcttttctgggcaccccttgacaggctaggccttgtgagtcttggagatggctaaaaatgtgggcaaacgatgaacttctatgacagtgcacagcctccagggcaggatgagcacccgtgctgctggaaggttgtgcacagatgggtttgtgctacccagggaagcacattaaaggcttacaggtatatttgtcatctctgcaaatgacgcgacaccttcctgatgtagtggccccagagggtggggctggctaggttttcctttgtctatgttcatcctctttctagacactcacctaggacttcttgagtggacatcatctctttttttgggggggggagctggcctcatctctgccccccaccagtgctggaattaaaagcatgccctaccatgccaggtttgtatctctctctctctctctctctctctctctctctctctcacacacacacacacacacacacacaaagatttatttattcatttaatgtatatgagtacactgttgctgtcttcagacacaccagcagagagcatcagatcccattacagatggttgtgagccaccatgttgttgctgggagttgaactcgggacctctggaagagcagtcagcagtctcaaccactgagccatctctccagcccttgtacatcgctttttgttggtcttttcctcttttatgtttagtgaccacctcaccagtataggctattacagagccaacctcctgctctcttggcagatgtgttgagaagaccaaatgcttctcagtttgtaactggtatgagtttaggcagcttccctacaaccagaaaacactgcagtgatggagctggctgggtttagacctccggacactatgcctactctggtttttctacccatttcctgtagtggggtacaaaaatggccctttgtgatcaactttagcagggagcctataagttcctaggaacagggcttcctattttgtagtgcagctgtgttgctaggtcaagctgtctgcttctggcagccagcagatggcgtgagaggcctgagaaagatctgcttctgcctccttttgaaatggaaatgttttaagttgtcaaggtcattattattattattttaatctagaagtatgagtttgtatatgttgattaaccaaacactttggaatcaaatgtgatttgaattttaggaactactcagaatttcaatttcctggtgtttatactttatattatataatactttaacaggctgaagaagcacctcatgatcaagtgcctaaatgtttctgtgggaaaatgtttgagccttcaccctcaagtagggtatttggtatattctgtttaggttatgatgggacatgaattagatgaagactttgagttttctgtatttctttctttctttctttttttctttattctttttttttggggggggttgtttgtttgttttttgagacagggtttctctttatagccctggctgtcctggaactcactttgtaaaccaggctggcctcgaactcagaaatcctcctgcctctgcctcccaagtgctgggattaaaggcgtgcgccaccacgtcgggctttgtattttttcaggtcttttgatgttcaaagcatttagagatttggaatttcagataattgtatatctttatcttctgtatgtgagtataccattgctgtcttcagacgcatcagaagagggcatctgatcccattacagatggttgtgagccaccatgaggttgctgggaattgaactcaggacctctggaagagcagtcagggcttttgactgctgagccatctctgtagcccctagggattatatatatatttgtttgttttttgagacagggtttatctgtatagctgtagctgtcctggaactcactctgtagaccaggctagcctcgaactcagaaatccacctgcctctgcctctcaagtgctgggattaaaggtgtgtgccaccattgcccggctagggattatattttattgtctacttttttttcaattttgtgatatatatatatatatatatatatatatcatacatatacacacatatatacatatacacatacatatttatgtttatatttatttatttaatttatatatgtgagtacattgttgaactcaggacctttggaagaacagtcagtgctctgaagcactgaaccatctctccagcccgggaaactttttactagaacaccacattctccatctaggaacttatgaggtctaggtccctggctgcctgggccaggtcttgcaagattgagagcagggctctgaaagtagatgaagtttctgttttcagggaatctggggcctccctgggattgtcttgtccttgtccatagacttaagtctcctgctttgtagtcacagagtagtcaagaagggctgtgaactttccagtatccttttggccaatcacctggtcttctcaggaacttgaaggcagcacctggagaagggtatgggcttccctgttgctgatcttcctactttttcctccagcaggaacactggtttgaaaaggccttgcgggacaagaaaggcttcatcatcaagcagatgaaggaggacggtgcctgtctatttcgggctgtaggtgagtctctatcttggttttgagggctgaggggcttaaggcttctgagctgtgtcctagtagtcagtagcagtccttgagacaggattgtggcagaggtaactgcttgatattttaggataaacaggcgcggagctcttgttaacgtttggcctctggtgttggattgtgttaaatgagtaatgataacagcaattgtagtgataaagggacaccactgttgacatactgctctgccaagattccaggaaacccacttattctgtcagttaggtaggtggtcggttggttggttagttttcaagtcagtgttttctctgtgtagccctccctgtcctggaatttgctctgtagaccaggctggcctggaactctgagatctgcctgcctgtgccttctgagtgctgggattaaaggtgtgcaccaccacctggtgtggaaacccttttattaaccccaagtccaggtgaacgtgagactgaaaaatgtctcagaagtggggagtgactagtctaaggttatacaaaagtatgtagagtcaggattttgtgtgtggattaactgtatcatattgtcactttggtgtttctctggtatcgtatattgcggatggtgcatatttagtgcctgtgtttatgcttgtgtatataataaaattgggcatggtgaagcagtttttctcccagcattcaggaggcaaaagcagggtggatctctttgagttcaaggacagtctggtctacattgcaagttctatgacagccaaagcttatatttgtcttgtctaaaaaagaaaaatctagatctttacaaatttctatattagagttttttgtcttttaacttgcacaaaagtagagaaaacagtgaaccctttcagatttagtgacgtagcttcacaaagtgattaacacatggatagccttactttatgaactatatcgtattatcatttcattcataaatatttctctatgcttctttttaaagatttatttatttattttatgtatatgagtacactgtagctgtacagatggttgtgagccttcatgtggttgttgggaattgaatttaggacctctgcttgctctggtcaacccccgtcactcaggttgaccctgctcagtcctactagctctggcccaaagatttatttatcattataaaaaagtacactgtagctgtcttcagatgcaccagaagagggtgtcaggtctcattatgggtggttgtgagccaccatgtggttgctgggatttgaactcagaaagagcagtcagtgctcttacccactgaaccatcttgccagccccttctctgtttctttcttttttctttttcttttatttttttccgagacagggtttctctgtatagccctggctgtcctggaactcactttgtagaccaggctggccttgaactcagaaatctgcctgcctctgcctcccaagtgctaggattaaagacgtgcgccaccactgcccggccttctctgtgcttctttaacagatacatctatattgttttctcttgttttcatataagtaaagtcctgttgtcatacctaaaaaattttttttctttcctgagacagagtcttgttctctagcccaggctagcttggaacttggaataatccttcttcagcctcttttttttttttttttaaagatttgtttctttattatatgtaagtacacagtagctgtcttcagacacaccagaagagggagtcagatcttgttacggatggttgtgagccaccatgtggttgctgggatttgaactcaggacctttggaagaacagtcggtgctcttaacctctgagccatctcaccagcccctttttcagcctcttaagagctgaaattatagatgtaagtcggtatgtacaactaagaattggtaaattttttttgagactctggtcgtcctggctgttctggaactttctgtgtaaactaggttggccttaaattctcagaggtcacctgccttagcctctcaattgctggggttaaagtcatatgctactgtgccagcttagaattagtaatttcttgatattgtctgttaagcctgagctagatctttgaccaaacaaggagttttgaaatcccatactgacatgaagggatcctagattgtggcctgttctctcctcccacaccagtggttctgctatcttcgaaggaaaattgttccctgacatttttgaactgggaatcagaagatgtggctcttaggctggctgtctccccatcggtgaaatgggtgctccctgggctccatcagttctttctaggtctgctcttggtttctcggtgatccgcatgtttgttataagctgtttggtccttagcaagtgtctcttctttcttaatcctctttcattagttgaagagtgggttaaaggactcccctgtggtgatggttttgatatggtttgatttactttggtaaatctctttaatgcatacttggtcattatggaacagtagcactagtaaagtctggctactcttctcagttgtttcccagactcagagctagaaatatttgtggaatgggtgggacaaaggaccacaagcagaagctattcaggtaatgatttctgttgctttggagaaaaatcccaacccttctagccatctggctcagttatgttctccctgggaaatttactagagaaagacctgagtttggaaatatcttagggataaaaggaaagcagagaatgaacaggtgaggatctattagtttctgggttccatattaacctcgggatggatgttagaagaagcaagattgcttttggacatctgggctcagatgttctctgaggcagcttggagcccttgagcacctggtgtgaatagttatccacatcaagagcaggtttgtatgcgtatgtctgtttagttacccccccccccccatcagggccttccagtaaggggcccaagcatacaggaagagctgaccacagcagctttaaggcctttccttatcagcactatggctacacatttcccctgactgggctgccctcagcttttctctgtaaaacctcaagtcctatgggctctcccctgaagtacgtggcccctggtctctaggcctcctctagaggtttccctggtgcagagtacacaacatgtgctggacaaggggactttgtccccaggctttccgctgtccccctgtttctagcctagcttatacagggacagatggccatcacctcactctttctacaaaggcctgcaagcattaactttttaccatgtattgactaatggagggaacatgtaactgagagctggaattgagtgagttgcacacatacattacactttgctgtttctctaaccctgcttgctgtgtgctacacatccagctgggcgctttaggccttcctgagacttttggatcattatgccatgaaatagaagctctgaaaagaagggcagaaagtatagctcagtactagctcttgtctagcatttgggggaccctggatttgatgctcagcattgccaaggattgaaggagaagtgacaatggtagagtttgcacagaggatgaccctaggagcccctagctccgtggtttttaacctgtggcttgcaaccccctttggggtcatataaccatttttgcctaagaccattggaaaaacgatatttacaagtagtaaatgcaaaattacagttgtgtagtagcacacgtagtttgtttgtttgtttgtttttttggtttttcgggacagggtttctctgtgtagtcctggctgtcctggaactcactctgtagaccaggctggcctcaaactcagaaatccgcctgcctctgcctcccaagtgctgggattaaaggcgtgcaccactactgctcggctctttgtccattctttgacctctctagattttccttctacctagaagcatttattcttccattgttgagggtccagtgcaggtggttttctgtcctttgttttgcctctgacatccagagagcacttttgaatcagtatcaattgcttgtacccatttctccctagtacctcctcctagagatttatgagcatcagtgatctaccaggtggaggcaggtatcctgtgacccacccagtccctgctgtgctctgataaccttctagaaacatgagcctccctccctccctttccctccatttgactttgactaggcagaagtgtctagctctggccatggcaatggtgctggtctctggaccaagtagaagccacatagttgtgtctgcatggacttcagaagagagtagcgtagctagggctctgttatagcccagaagtattatccaggcccacttctggttgagatagggtctcactctaggaactttttaggttagaccaggtgcccttgtaccttgagcttgtgatagtcgtcatatcttgaccttctgtgtattggggttacagacatattgctaccatgctttcttgtttgacagattttctttgtgacagggtttctttagaactctctgtagaatgtggaccgtagaacttaatctgtagatgaggctagaatctgtagatgaggctagaatctgtagatgaggctagcctccaactcagagatattcctgcctctgcctcccgaatgctgggattagaggtgtgcatcactggccagccttagatttgcgagctttataaaatgagaaactgagaccttaagagaaagccaggaccttgtcttgtctaagtccaccagccaatgtaagaacaacagtgtttgaaattgtattaagacatagtggattcctatgttttatttcttgtacacctgccacctttgatatctctttgctcagaatcatttgtgttttcccatttttgccaggggaatcctcaaacagaaaaacttatatctcagattggtaggagggtggggcaggggatctcccagaggtctgaggtgatatatcttgcccatagtctgtacccagtgggacagttgggtgtgtataccctgtcataccatggctacttgataggtgggtagaaccttttcctggatgctgcttcctcaatgaggccagggtttccacgagagcatgagttcagtggagagcagactaggttgctgttgcccttgtagctctgtccatctaacccacatttgtgtggtttgggtttaggttctccacgaaagccaaacttcctttctttattaaacatgtatgtgcgtgcatgcataccatagtatgtgtatatggaggtcagagaaaaactcaaagagtctgttctctccttcctccttccaccctgtaggttctagggatggaactctggttgtcagtctcggcagcaggtgcctttacctcttgagccatctgcatagcccgaagtttgcctttctgtctttagcagaacttaatggtaggtagcaacctgaggagtagatggttctcaggtccctccaaagcaagagaagacttttcatttatagcactttagaaataatgtgggcttgagccggtaaagggaaataaatggttcagccagtaaaggtgcttgttgctgagcctggcaacctgagttcaatccttaggactcaagtgatgagaggaaaaaacagactctttcttacaggttctcttctgacctatacatgtgctgggacatacagatgcacaaaatagataaatgtaataataaaatggtagaaaagaaaagtggagctggagagagctcagtagttaagagtacttgctgctcttccttccagaggactctaagttgggttcccaggactcacagtggcgcacaactttccttaatgctagttccagagggtccactgccctctcctgtttgtgggcatcaggtatgcgcgcagcacacatgtacatgtgacaaaactagtatacatacagcaaaataatctttgtaggggggaaggaggaaaagtaatctctatcttacttcttgtaagtgtggacaaatgcaggttacattttagggagcctgaagaaggaggacttccccatacagcagaggagaaagatgaaacaaatttgctagaagtgttggtcattcctctcccttacaaaggctgggaaggaagtagtataagttcctaggtatgcacagcttcttgtctagtgttaagcctttcttgattggtgacaaaggcatgtactcactgtatgctgtggttctgtgttgtggaatgggtcatgtgggtatttagtctgtttcagtcttttgtagaccctgctgactgcatgtgggcacatatgtgcacttccttgtatctttgtatgttcacagaaagcaaagtagcgtggtccatggggaggaaggttgatgttgaatctagggaagtgtgcagccagatacttgttaattctatattcagtcccaggcctttttttgtttgtttttttttttttgtttttccgagacagggtttctctgtgtagccctgactgtcctggaactcactgtgtagaccaggctggcctcaaactcagaaatctgcctgcccctgcctcccaagtgctgggattaaaggcgtgcaccaccaccgcccggcctgtcccaagccttttccttgttccaaccaatttcttgtggattagcaaggaaactgaagtacagaggatcaggcccagccctaagagaaggctgtgagggatggggtagggaatgtcacttggggccacctattgactcctttcttcctttagagctaaatacgtgctaagtatgtgatcctgagccagccgtgatacttctgtatcaatgccacccccatccctagcacagataactttgtcctttttgattttgagtgaagatcaaatgagttgttttaaaagtctgtagtaaaactaatgatagtaatgtgctgagaatttgtgagccctacttagaaagagaacagaggtggactatagctgggggaatcccctcccagctggaccctggaaaaaagcaggtgcatatgggcaagtgcagtgttagcaagaggaggagtttcagtttctttcaaaacattttctctgaattccccctgtatttgtgggtccagtgggccactctttctcccaccttgtacccctccccaggaagtgcatcctggcccccacatgctaacctgggagggctaggaaaattagaaaacctagttgatattaagtaatgatatgcttggggctggtgagatggctcagcagttaagagcactgactgctcttccaaaggtcctgagttcaaataccagcaaccacatggtgactcacaaccatccgtaacgaaatctgacgccctcttctggagtgtctgaagacagctacagtgtacttacatataatagatagataaataaatatatatatatttttaaaagttataatatgctttacctattaaagggttttttttcctctcttggtggggaagtactgtttgtatttccttgatctagagatcatcatcatcatcatcattattattattattattattattattattgatttctctgtgagccctagatgtcttggaactcactctatagaccaccctggccctgaactcacagagatcacttttgccacccaagtgctgggattaaaggtgtataccaccaccaactggctgcgatccgtattttacttcgtgttaatgattaagctataagctgggtatggcacacctgtaaccccacacttgagagaggaaaggaggaggattgttgtgaggttgatgccagcttgggctacagatcgagttctattccagccaagtgtctcaaactaagaaaataaaagtaaaaaattaaggaacagcttataatgagtcaataggtggtcccaagtgacatttccccatccaaggtgttttctaatagaatctgggatgagcctataagtattataacttgcctgtacccgaggacccaacataaaaagtcagtattattactttgataggaatttggttgttagagttttgaacaaaggcgcaaaaggtcggcgtttggaccattgcattcttcaaaaagaactagtagggcagggcatggtggcactcgcctttaatcccagcactcgggaggcagaggcaggtggatttctgagttcgaggccagcctggtctacagagtgagttccaggacagccagggctacgcagagaaaccctgtctcgaaaaaaacaaaaacaaacaaacaaaaaagaactagtagtgcttgtaataggaggggtagacctcctttttgcttttggggcttttctctgggggaggaagtgcaacagaaatgaggaagggcttaagaagcaattctctcagcactctagctgactgctgggtcgctagcagtatgataggagttgctgtcctcatgacaaatggggtgtctggttttgtttgttttgttgttttgagacagggtctctatatagctctagctgttcctgtactggaactctatgtagactaggctagccttgaactcacagaaagcctctgccttctgagtgcagggaatatgtgccagcattcctggcctggagtgcctggttttgactactgtttaggctttaggtacttgacagatgtcttgtagtcccatccccatactgaagattgaacctagcatgccatattctcccatagaaatatatttctatctctcctctctagtctttaccattttaagtggagaagagttactgtccccacttatggatgagggcatttcaactcagatgaaaggccttgtccagtgccgcacagctaagaggtggcatggactttcaccagaccccaaggcaagataaaggattcccaaatctggcatctagctctgacaaatagaaatcccaggcctctaagttaccttctgtaggagatccatgtttcccattaatttggcccagctcactgagcctgatagcccaccccatttaaccctttcattcccatcttagttcctgtttatggcagctgcagactgcactgcctccaaactgagcctacaaaaatagctcctctagcaccctaggcagccacagcagcctctgtggtcctggcttctaagaaaggcagcagcagccccccaccccacccccagcttgtatgcaggacatgtgatttactggaagtacttaggggggagtgtggccacagaagccacatccttgtttacatcggtgaaggggctaccccttcctgccttcacagccccttctccacccctcaggtatcgtcacctctgggatgacttgaggctggagctacccactttctctctcagtgcagcctttgattcctgtattatacagaaccctcatggagggaatcactgggcagtgaagacccctggcaagtcttcagagaaatagactggcaggcttgcttggtgggcacgttcccattcctagcattccctgcccctgtgccctagggggatcccattagaactgtgtatctctggggaaacacagggaaattcccttttcaaggcagccagtgaaagtcaggtttgcttaatcttcaagcccacattaattaagaaactcttgcttcctgtgcctcagcatatatgactgctcagcaaactgtactcaatttcttttactatatcaggtcctgagctgccggtgggcttaggtgtgagctgccccttatcttcagtggaggctttgtgtaatcagtctgtgtacacctttgagttggatggtagaggagttctaccactttacacagactgtccacattgtccacaagaaacctgtcaggtcacacctgtttgttttccacttcacagaggaggcataggaaactcagagagtcatttgtctctggctgtttacctcactagttactatttggcagaacttaaagtgttttccttcccttcagtttttaaaattctaatcatagccatgtgtgttgacgcacctctttaatcccagcactaggaggcagagactggtaggtagatctctggagttcaatgtcagcctggtctacagaatgagcttcaggatagccagggctactctgggaaagaaagagtgggggccaggaaggagagaggaaaggaaaggaaagaaaagattctaatcatggtggtagcctttaatcccatcactaagaaggcagaggctggcagaactctgtgagcttgaggccatcctagtctatgtatcaagtagcagagcagtcagagctatagactgagaccctatctcaaaaaaaaaaaagattctaatcttttttgtggtggtggtaggtattgaatgtagcgtttggtttggcttgaaatggagttttactagatctcaggtgatctaggctttgaacttggcaattctcttgactcagccttgattataggtatatactgctctcctttgtttcccccactgagacagggtttctgtgtttatcgctggctgtcctggagctcactctgtagaccaggctggcctcgagtcctgggattaaaggcatacaccactgtgcccaacttaaaaactttttgttatttcatttttattagtgggtatggagattgggatggtcactacatgtagaggtcagaggacaagttaagggagcaatttggttctctccttcaactgtatgagtcttgaggattgtactctagtgcctttatccactgagcatcttgctggcccttgactgtactactctcacctgtctaccctatacgctttcattcttcaagagtgtttgactttgctacttttttttttttttagacaggtagcctagcctggccttgacataatcttctggccattccacttgcacatcctgagggctgggatggtagacatgtaccaggccacctggctgatctgtgcatgttcagcatgttttcagcccttgcttgttatttccaccactcctttacaacacaaatgaaggctcaggccttggtgtagaaaagggagtttccctagtccttcagtctgtcttctccctaatgattgttgtatgactctgtgactcagagctctggtggtgacagctctgaccccatcctctcctttgttttgtcctcacacccccagctgaccaggtgtatggagaccaggacatgcatgaggttgttcgaaagcattgcatggactatctggtgagatccaagggaggccttggggcagcaggagggtagggggacccccgttgcacacaaaccttaattttccaatctattccacagatgaagaacgctgattacttctccaactatgtcacagaagacttcaccacctatatcaaccggaagcggaaaaacaactgccatggcaaccacattgaaatgcaggctatggcagagatgtacaaccgtcctgtggaggtgtatcaatatagcacaggtacttctgtagtgggtaggtgagggactaatggttcctcatcagagccaaccataccgggcccccctgtggatgctccctccttctctttctctgcagaacctatcaacacattccatgggatccatcaaaatgaagatgaacccatccgtgtcagctaccaccggaatatccactataattcagtggtgaatcctaacaaggccactattggtgtggggctgggcctaccgtcatttaagccaggggtaagtgggtccctgtgccccaggtagatatggatcattgactctgcccttagaccataaaactgtctccccctaagtttcacctgtctataaaattagtgagtcaccattgatcagaactcattctgtagcttttgatttgcctgtccatgaagtggctcactaatgttattctggttgagccttttaggatgtagagctcaatttgaagcagtaaggcagaccttggactaggtatccaagcttccacacaggtagatcttctccaacttcagagcacttacagttggagtcacagacttggaatgtagcagcttactggaatgggccctgtggacagattgtattgtttgggcctatactgaaagtccttcccacaggcccaagacctaattggtgtcagaagatgggagttgatttgcccagcatccactggcagataatcatttccgtctcacagtctctctcctcatcttccctgctccatcctccccctttcatcatgtcctctgatcctccctcttgccttcctcctaggctctttccccttctcctcaccccacttcctctcctccccaccccctctcctccctggtctctatcttcccttcaccccctcctgggggttttgaagtcttctattcaggtttcacttcctacaaaccgaaggtggtcctgcctaatcttaaacaacatcaacataccctccaaccttggtgggggggtggggttattttttaactaaattttagaaaagttacagatttgcaaaatgattgggagaatattagcatttccatatgccccactatgattaacatgaacatagtacatttgttgtcattaacaaatcagtatggattcattaagaacaatttcctcagtttctacttggtgagccttttccaggattctgtctcacatttaattgttccctttgacttcttgtgactttaacaaattctaaagaatttgactgcttttgttttgatctggtgacccactccaccggtttagaatgtcatctaatgggaatttcgctgcgtgtatgtagctattccagaatgaattttttctacttaattaatatcatttaagattcatctgtaacttttactttatttccttttcctttaaacgtctgaatgtttaaatgtttctctaattaatagacttcattgttcaaaactattttacatttgttttggggaggggtttgtggaggtctctctgttcatcaagcttggtgcaaagcccccttcctccttgagaacagtgttctcagtgtacagtttccatctagtctcttcccaaggaacagagacttgggtaatctgttaccatgtgtgaaccagtattaatacatgcctactagcctgacgttactgcctcattcctcccacttgttttgatgatctcaaaaattttaaggagaaccattcaaaagtattgcagggaaattatttttttttccagcatttttctaatgattttaactttgatattgggttcgggcagaagagcacagatatcaagaatatgtgttaggaatatgatcatgactgttgatgttgtctggcagaagtcataggaattttcccaccttttgactgctgtagtgttaggaaggaagtcatacttaaggaaagggaattatgtctgtcttcctgaattgatgttaatgtgagcttagggttagtgctgctatatctagttaaaatcccttgaccatttgcctccttctagcctttttcttgagtaaatttcccttttcctgagtaaattttcactttaaagtttagaaaactttccccatcacccagcagtcatttacatgactgctatttacatatacgggtataagctggggcagactcattaactggaccccctggagtccggtgatatctgcagttctttttatgtttagtgttactgattctattcatttttaaagtgcccaaggccaccacctgcttgtctttgcatacatttgtaattcatttaggtggttttgtcactgggagccttacttcttaactaatctttaaaaggcgattagcatacattaaggattagtctttgttttgtaaagttccttgggttttgacagatgcataataataccatgcatctatcttaggcacctattcattcagctagtttcagcccctaaaggttccccacgctttctcctgcaaccactgatctttattgactgcttttgcctatttcagaaagtcacgtaattgcaatcataagtatgtaagcttttaaaaatgctgctttcaggtagcaatatgcattaaggttcttccctggtttttcatggtttgttagctattctcttatcactgttccatttgtggaggcacactgttggtttaatcattcacctatttgaaagatatccttgcttgcttccaggttttgatgattatgaacaaagcttctgtaaactgctgtgttcaggtttttgtaggaacttaaattttatgattagttgtattaatatctggaagcaagattgcagaattataaaatcatgctgtgatttgtaagcaactgctagactattgtatgaagtggcctgatttgttccagtcgccatcacaatgaatgaaagttccattcctcttctttcccagcaattcatctttctactttttttgaattttagccattctcagtgttttttttaaaggctccttgattgttaaatgtgttgaacattgttttaatgctctaccactgagcttggtccccagcctgagtattggttacatatgtccattggccatctctatatcttttacctgtgcgattagatcacttacctacttttcatttttgtcattttgtagtgctaggaattaaacccatgtttttgtgtatgcattcattatcactgagctggccctatttttaaattggcttgatctaacctttttatacatgtatttcccctggtgtgctccatgatagaaaattatgttgtttagcatacatgcatttatgtatgttatgtatgtgcatttgaaaatgatgttgctagggacatggtggtacatgcctgaaattctagtagtcttgaggcagaggaagagaattgtgagttcaaaaacctaatgactgggctgcataccaagtcattgtttttggaaaacaaaacattaaccaaaattttaggaagtagtatttgcatttaatccctgaaatatactttgatgttctctattatttcattagcatcatgcctgtaatcccagcacttgtgagcctcaagctggaaggcaaattgccatgaattccaggccagcctggccttcttagtgagttcaagatcagtccaggcaatggccctctctcagaaagcaactaatgttgtagtgtcttaaaacttgatgcgaacttgcatgagaatacagtgtcctagcacccacacgatgccaatactgaccctttaattcctcacatagccatacccagcctcatatacgcttgattcctgcctccactccatgtctgtacttctctgttcatctttttcctttgccttatctgggaatatatgagaaaggcttcagcattgtgaaattgaatcattgctagatgaggcttctttaaatgaaggcctagacagaagagcccctcttatctccagacttaatgcttcacttgaggtgtcttgggtttgggcccatatatctgaccatagcagttcagattgccaggtcttatatctaagcctgctttcttcagttatggatggttctatacacaatccgctgaggagtgctttgtaaaaataacttctatgttgtctttgctaaggcctgtaggcctgcctttctgagcccattcaggctcttacccacgttcagagcatcaccgcacatccctgttcctctccccccctggcagtttgcagagcagtccctgatgaagaatgccataaagacatcagaagagtcatggattgaacagcaaatgctggaagacaagaaacgagctacagactgggaggccacaaatgaggccatagaggagcaggtggctcgagaatcttaccttcagtggctgagggatcaagagaaacaggcccgccaggtccggggacccagccaggtgggtcatggactctgtcattggcctgaccaagacctgttacttcttatcttttgacccctaattgacagggataaaataagagattttgac

SEQ ID NO: 4 - DNA, 30428 bp, mus musculus
ctgaagccgaatcccggaaccaggtagcagagagctcggccggccttggagggagacaaggctgcgaccaatccgtctccgtaccgtcccactggacttcacatccgggatctcctcctgggcgtgacccgcgtcccgtctgcggtcctcgaaccggtgtcctgatctctttatccaggccttgctgttcccgtcgtgcctcgcgcacgaccgtagccccctcatccgggttctctcccggcgttctccgcgtttgctttgctgtggggtacttggcggtgccgccatgactattctccccaaaaagaagccgccacctcccgacgccgacccggccaacgaaccgccgccgcccgggccgctgcccccggcgcctcggcgcggtgcgggtgtaggcgtgggtggcggcggcacgggtgtgggcggaggagagcgcgaccgtgactccggcgtcgtgggggcccgtccccgggcttcgccgccacctcagggcccgctcccggggccgcctggtgctcttcatcgttgggcactggccgtgccgcctggcgcagtcgcgggccctcggccacagcaggcttctccacctccttgtgggggccccggtggccccggcggcggtcctggtgacgctcttggtgcgacaactgcgggggtgggcgcggcaggggtggtggtgggcgtgggtggtaccgtgggcgtgggcggctgctgctcggggcccgggcacagcaagcggcggcgtcaagctcccggcgttggcgcagttggcggggccagtccggaacgtgaagaggtcggagcgggctacaacagtgaagacgagtatgaagctgccgcagcgcgaatcgaggccatggatcccgccactgtagaacaggtaagggctggaaggtgaggggctgttgggcagaaacagcgagtgagtctaccaggctgagaaggagcgcaagaaaatgtttgagattggtccaagaaacccaggtcttgatgctgggcttgacattctttcctggtggtggaggcatggcttcccccgaggacttgataggggctctaagttaagtaagttaaagtactcttttgcagtcctgagatcttctctaagtgactggcattgggaattccccaggagtcgcagatacgatggagcccttccttagaggaagctctcaggcctctctaagggactttggttcagtaactttttcctttaggacaagtgtgagattccctcccgcaaagaactcgaattaaggtggtgtcctcagagaaatagtctaagcatacccaagaaacttaaacccttgatgtaggaaggacctctctcttttgctgagtctgctcaccagccatgtggcctcctcaggagtcctaagcctgtatttggggacctagacttgcttgtagaattgaaggtttagagtatacccacacaccttttagatagtgatttccaaagtatccctccagtgttgtgaaacgtctttctggaagataaaattctcagtggcttagggacaaaggccaaaaccagtacctagaagcagaactgtggctcacagtcggtgttgacgtaaagacctctttgcttatggcccggggtttaattacagatgttccaggcaagaggacttcttcagaacacagtttcagtcatgggctggtgtctatgctcttgtgtgtgtgtgtgtgtgtgtgtgtgtgtgtgtgtgttcatatatttccctaaggatggatggatggatatatatatatatatatatatgtgtgtgtgtgtgtgtgtgtgtgtgtatatatatatatatatgtcgtacctattgaaatttacttcagggattcaacatctcagttctccctttctgtgcatctggaattctctgatacccaaggggctgagctgttaatctcataggaaaagagctctcaagtcactagacccagattaagttccttggaaaagaaaacttgagagtctctctcaggaagcgctccatctcatgtggagaactctcacctattgactttgcggatggggtctagagtctggcctggaaacattgcgtcctgtccaatccctgcctcagaaactccagcctcaggacatgggcagtttggagacccagaggccatgtcagatacctccctctaaatctgccttcaagggcctgagactctgttctgtgaaggacataataaggctttctttaggaacaggaaccccatccttgccactgaagactgtttgtagaggtaatgcctgaagttcttcctcctgtaccttgagatgctcctcacacccagtctgacatttcccaccaggactgggtggggcatggttataggtttcctgaggaatgaggaaattctcaacatcacatcagttgtgtgaggaattgttctacaccttaggatctgaggcctgaatcttttggggctgtcacctaagatgacctaagtatcctcttcataggaggcttttaggaacataagtctcttttggggtttatttgaacctgggaatgatacagttttgaggaaattagttttaggcctctttccatcttcctcaggaaaaagagattcctttgccttggggactgagacctgagtccttgcttaggcatgcagctctcctcccaccacaccaggtgattctttctcaccagggagaggacatgaagtcatcttcaatatggccagaggcttccttctttggacagagcacctgggtgttctggtttcttcttaccctcaggtcagagccaagaaggctgtcaggtcttgggaccagaagcctgaggcatcccttggactggtagaggttctgaccctattttcattgtttctcacttctggaaatttctcttacattccatttccttttggttgaaaaatttgttttacaggggtcagagtgtggtctcacatccactgttgttcttcttttcctgtcatttctggcggaacaatcatctagactcatctagagatgtcaggttcaggaggttttgttgttgttttgagacagggtttctctgtatagccctggctgtcctggaactcactctgtagaccaggctggcctcaaactcagaaattcgcttgcctctgcctccggagtgctgggattaaagtgtgtgccaccacttcctgacttccaggagttgtttgtttttcttcaaaacaagatttctctatgtagtatttttctggaacttgctctgtagaccaggctggcctttaacttggctatccaagtgctgggattacaggtgtgtgcacaaccactgcctgactgtgtgcaggagttacagatccctgctttttgtaaagtctctttacccttacagaggtatgtatcccttatccaggggaaagagaaggtatgttgttggagatgcaaaaggccacattcttataccccttgcagttccgcccttatatttatcttcataagaacttagaaataagaactgacggactcatgaaacctgctcttccctgtgatgggagaggctttctgttctatgggcacaaagggaagaaggagctactcctagtctccctgactcgcctggcccagctttgagcctcttgaggatgagaagaaggggtattggtcctgccactccaatcttggttcatagctgttgcagatgctcataacatagaggctgtttcagtactgacagaggggattagtctgaatggtaaatctggttccagttctgcgaatatgtactcctgtttcctttaggattctccgagtaccttgggttggagtcctggggaaatgatgtcatagggtgccttttgtcagagcctagccactgaaaacaatggcttataagcatcctaagccaggagaactcagagatcttggagtaaaggacaaacatgctgagatagtggaaaatgctaggtttagcagtacagtcagtgtgtctggttctacctctcagtcagccacattctgcagagtgaactagtacagcttctgttctctgcacctgatttactttcactaatgtgttggtgtgttgcagtcaactttggctttaagggatttcaaagccccctattcctgcactagatagtgaatagtgggtatcttttgaagaggagctgggttccttctctttccactttgcttcttttccagtcatagaagtttgctgggcaggtcaaagccttttttgtataagggttaaggatgatgtgtggcagtgttgtagccagctatcaagttccacagttacatgtggaaagaatttgggatttggagctggacaggctggagttcaaactccagtgttaactgttgaactgttttaagattgtagaactctcatttagggcaaaattcatgagggttactagagtgtaaacatctagccttgtccaccttggctagttcttttcactcaggatgagcaattggccccaggataatcttttctcctcaagaggctttgcctatccatggtactcatctcttggcatctagaagcctgcccatctggaattgggtggttggctgcatttgagtgcttgtttgtttgtttgtttgtttgtttttttgagacagggtttctctgtgtagccctggctgtggctgtcctggaactcactttatagaccaggctggcctcgaactcagaaattcgagttctgcctctgcctcctgagtgcttaaaggcgtgtgattaaaggcgtgcaccaacacgcctttgcgagtgctttttctatactaaacttttgtgtggtctttggatagttcccttttccaggtcttttgttttgggggtttgtttatttttcaagacagggtttcctctgtagctctggctgtcctggaacttactctgtagaccaactggcttcagaactcagaggtctgacctgcctctctctgactgttgagttccagggttaaagctgtgtgccaccatacctcacactacttgggtcttggtttttctacctattaaatgggtagttgtgaggacagtggttggactcattgcagtgaagaaaggtgtaatctcatctttaattctctgttttacactcttctcaacctttattggattttatgtgggaccccttggctctggggatggctcagaatttctctatgtaatggtcctggtggtccttgaatttactctgtagaccagactggcctttgaactcagagaactggctgcctcttcctcctgaatgctgtaattaaggcctgcgccaccactgaccacctagaatgttatcttttagaagatgtgatgtgatgtttgcacttcttgggagtgcttataagttcttcagtgtttttgcatttgtttactgtgctgaaactagggcgctcaattttctggcatgaaggctcatgagtatgatcccatcatttgggaggttgaggcaagaggattgccaagagtttgaggccagcctgagctatggtgttgagaccctgtctaaaataaccaaaataaaaagtgtacaattcagtggctttcaaaacagccatagaattgtacttctgtcaccagttttatttttttatttatttttatttattttttttggtttttcgagacagggtttctctgtgtagtcctggctgtcctggactcgctctgtagaccaggctggcctcgaactcagaaatccacctgcctctgcctcccaagtgctgggattaaaggcgtgcgccaccacgccctgtcaccagttttaaaatgtttttaatattatagacccttttatagcttttaatgccccccattccttcctccctttccagctcctggcaacctattaatttgtctggattgaactattttgaaacaagtagaatcatacactaacgtcatcctttgtaactttgtctcttttggatagcatgtgttcagagcacatcatggcatagcatttacctatactttgtttttattgcctagtaataaaatcttgggttttttaatcctctggtggcccagaaatagttttttttggggggtgggggtcttctctttcttctattctggtaggcttgtgtgggtccttagagaagcagtatgtctgtttctcattggatggattgcctgtgtttattatccctggagcagagccagtgttcctgggtgttttgggtgagggggtggtgttggctccaggtttgctgggacaaggctgtgaggcctagaatactaaacacctcttggccatgggctctgagaagacatctgtccaatgccgttgccatccttccctgtacccttccccctttattggcagttcttttacccacaggctgggtcagcaacttcccaggctgagagggaggattctgggcccctactgccttttaattctaaccctctctcgggaggtggatcactcagaatggaagccttgctgtgtatagtctcacagccacaaagccctagagctcacaccaaaggagtactacaaggggggatatattaatttcctgtggttgttgtgacaaataaccatggactgtttggcttagaataacagataaattctgtttcagttttggtggtcaaatgttcaaaatgggtttcacttggccaaaatcaaggtgttggtgtttactgaacatcctccagcaagtctgggaaagagtctagactttctccctttctgatggccgcatcacttcagtttccacctctttctctggatgcatgtgtatgttttccttttctgtatgaaatctcctgtaaatcttctccctcttctcactctgtacaggtgtagcactttgcttttgacaaacgcaacgtaaggaagagaagagtttactgttacttacagctggaggggatacagtccagcctcatatggggaaggctgctggcaggagtgtaaggcagccgctcatatgtctgcagccaggaagcagagagatggatgctggtggtacacggtctacttttctccttaagcacaggacccctcaagcccatggggtggtgtcatgtttagggtgggccttcactcctccgttaatgctcttgaaattccctatagaagcacaccaagatgtatgtttcttaggtgatttcaaatccatttgagttgataatgagggttaactatcacaaatctacccattctcaactcctaagccttactacctttaaatatcaatattttactcctgttcctccacatttgatagcaatctcaaggtagataacacatttagttcattgtaagagtagtcaaattcttagcagttctaacattgttcaaaaatcttaagttcaaggcctggtgaggtgtggtgtataccattaataatagcacctgggaggtagaggcaggtagatctaagtagttctaggccagccaaagttgcatagtgagacttaattgtgagtctctgtaaaattaacaaacaagttacattatctaatatacaagggcactgagcaaacattcccattccagaagagaggagtgaagatattagcaaagagattagatgaaagcaagactgaaacctatcagggaatctagttcatgcccaacacctgggctttttatggcatcacctgtgttccaacaagcttgggtagttgtgctctcatcagctctgatgctttgagcatatgtagcctctgtcttgagtcagcttcactaagttcctaaaacagaggctctcaacctgggcactgaaccctttcataggatcacattggaaaacacagatatttacatgatgattcattagagtagcaaaactacacttaagaaataacactgaaaatagttttttctttccattttttattaggtatttagctcatttacatttccaatgctataccaaaagtcccccatacccacccacccccactcccctacccacccactccccctttttggccctggcgttcccctgtactggggcatataaagtttgcgtgtccaatgggcctctttccagtgatggttatggttggggtcaccacaacgtgaggagctgtattaaagggtcgtagcattaggaagattaagaaccgctgccctaaagcttttcttgacagatctttctggcatctctggtacccttgaggtcacctttgcaaaaagcattacctttatagcttcataaaatggtctcttagggtcttagtgcaggcaatctggccctgctaccttggtgcaagactgtgtgatcaccttgttgaattctggatgtctgaaaacgcacatgatgtggatgatgtcaagttatgctaccagctcaagatggaacctagttgtattagagcacaggcgctgtggcctttctctgccttctagagcatttcctgcagtttactctagagtctctgctttttaggcattatgttcttcatgtttccggttttatagcctggagcctttactgggtaggtaggctcttatccccaaggcagtatatataccatatagagtttagggtttttcttaattgcacagatttcattatacttctagacactttgtccaaaccaaactttttaaggcagtcaagctcctttcctcaccaaactgcacatttctagccctttatttatttatttatttatttatttatttattgagttaggggctcatgtaggtcattgtggcctcaaatttggtaatgtaactcaggctgactttcctttcctcttgtctctacctgccaaatgttacgactataaacataagcacaatatccagttaaaccttgtttatgcttttttttcctccccaaactgtacattttccacatctagtatggtttgcatgtcctcagtggattaatgcagtgagtagtaaccacaagtagaacgaaagcctagaggttatgctgactaacaatttgacaagcaatttagtccattacttttgcatttagccttgctcaaatgatcaggtgggcataatgattgccagaattaaaaaaaaaaaaatggccagccgggcgtgatggcgcatgcctttaatcccagcacttgggaggcagagagaggcaggaggatttctgagttcgaggccagcctggtctacaaagtgagttccaggacagccagggctatacagagaaaccctgtcttgaaaaaaaaaaaaaaagaggaagaaaaacaaaaacaaatggcctctagtcctttgacatatctgagatctctttaaccaggacttaattgttcgcatttctgtattctgttagtcatcattcctactagaatagactgttaagctctactttggcactctaggtcttctgtagcccacagaactaaaccttttaagattcttcctgcaaccacctctaaatgcctacaaattgtatggtcatgtatacacagcagtgaccccacttctgggtactaactttatctcttttctcttgttgctgtaacagaatacctgacaaaagcaacttaagagatttatttgaggggtacagccccatcacagtgggcaaggcatggcagtgggaacgtaagatagcctttcatgttgcatcagggaagaagtgaagaatactgatgctcaacttcctctttccttttcccgttttttattcagcccgagaccccagcctatacgatggtgtcatgtacattcaggtaatgagttagacttacctggcaactccctgaagaaattcccatctagagttgtcttttaagtgattccaagtctagtcaagttaaaaataaacttgctgggcatggtggcgcacgcctttaatcccagcacttgggaggcagaggcaggctgatctctgacttcgaggccagcctggtctacagagtgagttccaggacagccagggctacacagagaaaccctgtctcgtaacacacccgcccccaaaaattaacatccacacctgagattgtgcctagactccagtgttccagtcacttctgcaaaacccttttaaaaacacatacaggttttaggcattaggtctgatattttcaggtggacattattcagtctaatccagatcgggagggaatgggaactcattaagagatgtcctgctgctgggttaggtatatgcactggtcttaccatgttttccaccagccggaagtagttggcttgatagcactttggaaagatgtagttacaaactgataaggtactcctttaatcccagcactctcggcaggcagatctctagtagtttgaggccagcctggtctatatagtgagttcaaagacagccagggctacatagaccttgtctcatctcctccccttcactctactggacaaagtactgcctagtatcccacgtactaggaagtgtatattcccatttcacagattggaacactatggctcaaagcagttcatcacttggcttttatttggtagaactgcattgaaacctaaatcagtggttccatagcctattctaacttctcttaggcttttaggtgtttttgtttgtttgtttgtttttggtttttcaagatagggtttctctgtatagccctggctgtcctggaactcactctgtagaccaggctggcctcgaactcagaaattcaagttttgcctctgcctccggagtgttgggattaaaggcgtgcaccaccaccgcctggtggcttttacgttgttaaaccagcttttaaacagggtcctgtcttaactcctgggatactatggtatcagagagctttgtctagtccttttgctaaggcttagagatggggagagagactctgctccaggattggtcttgaacatgtaaagttcaggattgagacttgatcttctcgggtcaggacaccaatacagaatacatctacagattgttggactgttctccagccttctagcacttcctaaacatcttcttcccaaagtgagagaggaagaaagctagagctctaggttttcaaactgtgatacgaaggccagtggatgcttagtgatacatcctctagatgcaggcctagatgccatagttatcgtaggacccacactctatttgtgcaaaaggtctgtctagtcagacttcctttatttttaggcacatcagaactcctccaggacttgctaccaggcatgtgtcaccgctcatggtacatcatgtgctgtgtctctactactaggctttgctactaccctgactgcagctcctttctgcctttgtaaagtgtgggtaatgctgcttcctgccacttgggttgcagtgaggacaatgaaatgaggtcacttttgtatctggcacctggcataggacaaagcactcagctaatatgagttcatcctttctggcttttccctgcttagctgcctagttttgcttgcgtctttgctctcctatacacattgccaggctttgagcatctctggtgcttggtgacagaaatgactttatttcttatccacttatcaagcaagttttgatcctttgctcaagtgccagctttaatgtcagggtaaggtctcttcctgcttcacaaaagcaagggagcattcatttgttttgcagccccactcaaactgtacgtcatcactgcgtatttctgtacccttcccttcaaagtttaccagggtagagacggaagtctgattcatttttctgtcttcattgtccatcccagaatgactcctattttgtgagatgagaactaggccccctctttttctctttgtatcccttctatcttcctcatctaccttggagaatgctgttctcccccctttaactctccctattttaaggtatggggctatggttaaaagtttcttttctgaggcagaggcaggcggatttctgagttggaggccagcctggtctacaaagtaagttccaggacagccagggctatacagagaaaccctgtctcggaaaaccaaaaaaaaaaaaaaaaaaaaaagtttcttttctgggcaccccttgacaggctaggccttgtgagtcttggagatggctaaaaatgtgggcaaacgatgaacttctatgacagtgcacagcctccagggcaggatgagcacccgtgctgctggaaggttgtgcacagatgggtttgtgctacccagggaagcacattaaaggcttacaggtatatttgtcatctctgcaaatgacgcgacaccttcctgatgtagtggccccagagggtggggctggctaggttttcctttgtctatgttcatcctctttctagacactcacctaggacttcttgagtggacatcatctctttttttgggggggggagctggcctcatctctgccccccaccagtgctggaattaaaagcatgccctaccatgccaggtttgtatctctctctctctctctctctctctctctctctctctcacacacacacacacacacacacacaaagatttatttattcatttaatgtatatgagtacactgttgctgtcttcagacacaccagcagagagcatcagatcccattacagatggttgtgagccaccatgttgttgctgggagttgaactcgggacctctggaagagcagtcagcagtctcaaccactgagccatctctccagcccttgtacatcgctttttgttggtcttttcctcttttatgtttagtgaccacctcaccagtataggctattacagagccaacctcctgctctcttggcagatgtgttgagaagaccaaatgcttctcagtttgtaactggtatgagtttaggcagcttccctacaaccagaaaacactgcagtgatggagctggctgggtttagacctccggacactatgcctactctggtttttctacccatttcctgtagtggggtacaaaaatggccctttgtgatcaactttagcagggagcctataagttcctaggaacagggcttcctattttgtagtgcagctgtgttgctaggtcaagctgtctgcttctggcagccagcagatggcgtgagaggcctgagaaagatctgcttctgcctccttttgaaatggaaatgttttaagttgtcaaggtcattattattattattttaatctagaagtatgagtttgtatatgttgattaaccaaacactttggaatcaaatgtgatttgaattttaggaactactcagaatttcaatttcctggtgtttatactttatattatataatactttaacaggctgaagaagcacctcatgatcaagtgcctaaatgtttctgtgggaaaatgtttgagccttcaccctcaagtagggtatttggtatattctgtttaggttatgatgggacatgaattagatgaagactttgagttttctgtatttctttctttctttctttttttctttattctttttttttggggggggttgtttgtttgttttttgagacagggtttctctttatagccctggctgtcctggaactcactttgtaaaccaggctggcctcgaactcagaaatcctcctgcctctgcctcccaagtgctgggattaaaggcgtgcgccaccacgtcgggctttgtattttttcaggtcttttgatgttcaaagcatttagagatttggaatttcagataattgtatatctttatcttctgtatgtgagtataccattgctgtcttcagacgcatcagaagagggcatctgatcccattacagatggttgtgagccaccatgaggttgctgggaattgaactcaggacctctggaagagcagtcagggcttttgactgctgagccatctctgtagcccctagggattatatatatatttgtttgttttttgagacagggtttatctgtatagctgtagctgtcctggaactcactctgtagaccaggctagcctcgaactcagaaatccacctgcctctgcctctcaagtgctgggattaaaggtgtgtgccaccattgcccggctagggattatattttattgtctacttttttttcaattttgtgatatatatatatatatatatatatatatcatacatatacacacatatatacatatacacatacatatttatgtttatatttatttatttaatttatatatgtgagtacattgttgaactcaggacctttggaagaacagtcagtgctctgaagcactgaaccatctctccagcccgggaaactttttactagaacaccacattctccatctaggaacttatgaggtctaggtccctggctgcctgggccaggtcttgcaagattgagagcagggctctgaaagtagatgaagtttctgttttcagggaatctggggcctccctgggattgtcttgtccttgtccatagacttaagtctcctgctttgtagtcacagagtagtcaagaagggctgtgaactttccagtatccttttggccaatcacctggtcttctcaggaacttgaaggcagcacctggagaagggtatgggcttccctgttgctgatcttcctactttttcctccagcaggaacactggtttgaaaaggccttgcgggacaagaaaggcttcatcatcaagcagatgaaggaggacggtgcctgtctatttcgggctgtaggtgagtctctatcttggttttgagggctgaggggcttaaggcttctgagctgtgtcctagtagtcagtagcagtccttgagacaggattgtggcagaggtaactgcttgatattttaggataaacaggcgcggagctcttgttaacgtttggcctctggtgttggattgtgttaaatgagtaatgataacagcaattgtagtgataaagggacaccactgttgacatactgctctgccaagattccaggaaacccacttattctgtcagttaggtaggtggtcggttggttggttagttttcaagtcagtgttttctctgtgtagccctccctgtcctggaatttgctctgtagaccaggctggcctggaactctgagatctgcctgcctgtgccttctgagtgctgggattaaaggtgtgcaccaccacctggtgtggaaacccttttattaaccccaagtccaggtgaacgtgagactgaaaaatgtctcagaagtggggagtgactagtctaaggttatacaaaagtatgtagagtcaggattttgtgtgtggattaactgtatcatattgtcactttggtgtttctctggtatcgtatattgcggatggtgcatatttagtgcctgtgtttatgcttgtgtatataataaaattgggcatggtgaagcagtttttctcccagcattcaggaggcaaaagcagggtggatctctttgagttcaaggacagtctggtctacattgcaagttctatgacagccaaagcttatatttgtcttgtctaaaaaagaaaaatctagatctttacaaatttctatattagagttttttgtcttttaacttgcacaaaagtagagaaaacagtgaaccctttcagatttagtgacgtagcttcacaaagtgattaacacatggatagccttactttatgaactatatcgtattatcatttcattcataaatatttctctatgcttctttttaaagatttatttatttattttatgtatatgagtacactgtagctgtacagatggttgtgagccttcatgtggttgttgggaattgaatttaggacctctgcttgctctggtcaacccccgtcactcaggttgaccctgctcagtcctactagctctggcccaaagatttatttatcattataaaaaagtacactgtagctgtcttcagatgcaccagaagagggtgtcaggtctcattatgggtggttgtgagccaccatgtggttgctgggatttgaactcagaaagagcagtcagtgctcttacccactgaaccatcttgccagccccttctctgtttctttcttttttctttttcttttatttttttccgagacagggtttctctgtatagccctggctgtcctggaactcactttgtagaccaggctggccttgaactcagaaatctgcctgcctctgcctcccaagtgctaggattaaagacgtgcgccaccactgcccggccttctctgtgcttctttaacagatacatctatattgttttctcttgttttcatataagtaaagtcctgttgtcatacctaaaaaattttttttctttcctgagacagagtcttgttctctagcccaggctagcttggaacttggaataatccttcttcagcctcttttttttttttttttaaagatttgtttctttattatatgtaagtacacagtagctgtcttcagacacaccagaagagggagtcagatcttgttacggatggttgtgagccaccatgtggttgctgggatttgaactcaggacctttggaagaacagtcggtgctcttaacctctgagccatctcaccagcccctttttcagcctcttaagagctgaaattatagatgtaagtcggtatgtacaactaagaattggtaaattttttttgagactctggtcgtcctggctgttctggaactttctgtgtaaactaggttggccttaaattctcagaggtcacctgccttagcctctcaattgctggggttaaagtcatatgctactgtgccagcttagaattagtaatttcttgatattgtctgttaagcctgagctagatctttgaccaaacaaggagttttgaaatcccatactgacatgaagggatcctagattgtggcctgttctctcctcccacaccagtggttctgctatcttcgaaggaaaattgttccctgacatttttgaactgggaatcagaagatgtggctcttaggctggctgtctccccatcggtgaaatgggtgctccctgggctccatcagttctttctaggtctgctcttggtttctcggtgatccgcatgtttgttataagctgtttggtccttagcaagtgtctcttctttcttaatcctctttcattagttgaagagtgggttaaaggactcccctgtggtgatggttttgatatggtttgatttactttggtaaatctctttaatgcatacttggtcattatggaacagtagcactagtaaagtctggctactcttctcagttgtttcccagactcagagctagaaatatttgtggaatgggtgggacaaaggaccacaagcagaagctattcaggtaatgatttctgttgctttggagaaaaatcccaacccttctagccatctggctcagttatgttctccctgggaaatttactagagaaagacctgagtttggaaatatcttagggataaaaggaaagcagagaatgaacaggtgaggatctattagtttctgggttccatattaacctcgggatggatgttagaagaagcaagattgcttttggacatctgggctcagatgttctctgaggcagcttggagcccttgagcacctggtgtgaatagttatccacatcaagagcaggtttgtatgcgtatgtctgtttagttacccccccccccccatcagggccttccagtaaggggcccaagcatacaggaagagctgaccacagcagctttaaggcctttccttatcagcactatggctacacatttcccctgactgggctgccctcagcttttctctgtaaaacctcaagtcctatgggctctcccctgaagtacgtggcccctggtctctaggcctcctctagaggtttccctggtgcagagtacacaacatgtgctggacaaggggactttgtccccaggctttccgctgtccccctgtttctagcctagcttatacagggacagatggccatcacctcactctttctacaaaggcctgcaagcattaactttttaccatgtattgactaatggagggaacatgtaactgagagctggaattgagtgagttgcacacatacattacactttgctgtttctctaaccctgcttgctgtgtgctacacatccagctgggcgctttaggccttcctgagacttttggatcattatgccatgaaatagaagctctgaaaagaagggcagaaagtatagctcagtactagctcttgtctagcatttgggggaccctggatttgatgctcagcattgccaaggattgaaggagaagtgacaatggtagagtttgcacagaggatgaccctaggagcccctagctccgtggtttttaacctgtggcttgcaaccccctttggggtcatataaccatttttgcctaagaccattggaaaaacgatatttacaagtagtaaatgcaaaattacagttgtgtagtagcacacgtagtttgtttgtttgtttgtttttttggtttttcgggacagggtttctctgtgtagtcctggctgtcctggaactcactctgtagaccaggctggcctcaaactcagaaatccgcctgcctctgcctcccaagtgctgggattaaaggcgtgcaccactactgctcggctctttgtccattctttgacctctctagattttccttctacctagaagcatttattcttccattgttgagggtccagtgcaggtggttttctgtcctttgttttgcctctgacatccagagagcacttttgaatcagtatcaattgcttgtacccatttctccctagtacctcctcctagagatttatgagcatcagtgatctaccaggtggaggcaggtatcctgtgacccacccagtccctgctgtgctctgataaccttctagaaacatgagcctccctccctccctttccctccatttgactttgactaggcagaagtgtctagctctggccatggcaatggtgctggtctctggaccaagtagaagccacatagttgtgtctgcatggacttcagaagagagtagcgtagctagggctctgttatagcccagaagtattatccaggcccacttctggttgagatagggtctcactctaggaactttttaggttagaccaggtgcccttgtaccttgagcttgtgatagtcgtcatatcttgaccttctgtgtattggggttacagacatattgctaccatgctttcttgtttgacagattttctttgtgacagggtttctttagaactctctgtagaatgtggaccgtagaacttaatctgtagatgaggctagaatctgtagatgaggctagaatctgtagatgaggctagcctccaactcagagatattcctgcctctgcctcccgaatgctgggattagaggtgtgcatcactggccagccttagatttgcgagctttataaaatgagaaactgagaccttaagagaaagccaggaccttgtcttgtctaagtccaccagccaatgtaagaacaacagtgtttgaaattgtattaagacatagtggattcctatgttttatttcttgtacacctgccacctttgatatctctttgctcagaatcatttgtgttttcccatttttgccaggggaatcctcaaacagaaaaacttatatctcagattggtaggagggtggggcaggggatctcccagaggtctgaggtgatatatcttgcccatagtctgtacccagtgggacagttgggtgtgtataccctgtcataccatggctacttgataggtgggtagaaccttttcctggatgctgcttcctcaatgaggccagggtttccacgagagcatgagttcagtggagagcagactaggttgctgttgcccttgtagctctgtccatctaacccacatttgtgtggtttgggtttaggttctccacgaaagccaaacttcctttctttattaaacatgtatgtgcgtgcatgcataccatagtatgtgtatatggaggtcagagaaaaactcaaagagtctgttctctccttcctccttccaccctgtaggttctagggatggaactctggttgtcagtctcggcagcaggtgcctttacctcttgagccatctgcatagcccgaagtttgcctttctgtctttagcagaacttaatggtaggtagcaacctgaggagtagatggttctcaggtccctccaaagcaagagaagacttttcatttatagcactttagaaataatgtgggcttgagccggtaaagggaaataaatggttcagccagtaaaggtgcttgttgctgagcctggcaacctgagttcaatccttaggactcaagtgatgagaggaaaaaacagactctttcttacaggttctcttctgacctatacatgtgctgggacatacagatgcacaaaatagataaatgtaataataaaatggtagaaaagaaaagtggagctggagagagctcagtagttaagagtacttgctgctcttccttccagaggactctaagttgggttcccaggactcacagtggcgcacaactttccttaatgctagttccagagggtccactgccctctcctgtttgtgggcatcaggtatgcgcgcagcacacatgtacatgtgacaaaactagtatacatacagcaaaataatctttgtaggggggaaggaggaaaagtaatctctatcttacttcttgtaagtgtggacaaatgcaggttacattttagggagcctgaagaaggaggacttccccatacagcagaggagaaagatgaaacaaatttgctagaagtgttggtcattcctctcccttacaaaggctgggaaggaagtagtataagttcctaggtatgcacagcttcttgtctagtgttaagcctttcttgattggtgacaaaggcatgtactcactgtatgctgtggttctgtgttgtggaatgggtcatgtgggtatttagtctgtttcagtcttttgtagaccctgctgactgcatgtgggcacatatgtgcacttccttgtatctttgtatgttcacagaaagcaaagtagcgtggtccatggggaggaaggttgatgttgaatctagggaagtgtgcagccagatacttgttaattctatattcagtcccaggcctttttttgtttgtttttttttttttgtttttccgagacagggtttctctgtgtagccctgactgtcctggaactcactgtgtagaccaggctggcctcaaactcagaaatctgcctgcccctgcctcccaagtgctgggattaaaggcgtgcaccaccaccgcccggcctgtcccaagccttttccttgttccaaccaatttcttgtggattagcaaggaaactgaagtacagaggatcaggcccagccctaagagaaggctgtgagggatggggtagggaatgtcacttggggccacctattgactcctttcttcctttagagctaaatacgtgctaagtatgtgatcctgagccagccgtgatacttctgtatcaatgccacccccatccctagcacagataactttgtcctttttgattttgagtgaagatcaaatgagttgttttaaaagtctgtagtaaaactaatgatagtaatgtgctgagaatttgtgagccctacttagaaagagaacagaggtggactatagctgggggaatcccctcccagctggaccctggaaaaaagcaggtgcatatgggcaagtgcagtgttagcaagaggaggagtttcagtttctttcaaaacattttctctgaattccccctgtatttgtgggtccagtgggccactctttctcccaccttgtacccctccccaggaagtgcatcctggcccccacatgctaacctgggagggctaggaaaattagaaaacctagttgatattaagtaatgatatgcttggggctggtgagatggctcagcagttaagagcactgactgctcttccaaaggtcctgagttcaaataccagcaaccacatggtgactcacaaccatccgtaacgaaatctgacgccctcttctggagtgtctgaagacagctacagtgtacttacatataatagatagataaataaatatatatatatttttaaaagttataatatgctttacctattaaagggttttttttcctctcttggtggggaagtactgtttgtatttccttgatctagagatcatcatcatcatcatcattattattattattattattattattattgatttctctgtgagccctagatgtcttggaactcactctatagaccaccctggccctgaactcacagagatcacttttgccacccaagtgctgggattaaaggtgtataccaccaccaactggctgcgatccgtattttacttcgtgttaatgattaagctataagctgggtatggcacacctgtaaccccacacttgagagaggaaaggaggaggattgttgtgaggttgatgccagcttgggctacagatcgagttctattccagccaagtgtctcaaactaagaaaataaaagtaaaaaattaaggaacagcttataatgagtcaataggtggtcccaagtgacatttccccatccaaggtgttttctaatagaatctgggatgagcctataagtattataacttgcctgtacccgaggacccaacataaaaagtcagtattattactttgataggaatttggttgttagagttttgaacaaaggcgcaaaaggtcggcgtttggaccattgcattcttcaaaaagaactagtagggcagggcatggtggcactcgcctttaatcccagcactcgggaggcagaggcaggtggatttctgagttcgaggccagcctggtctacagagtgagttccaggacagccagggctacgcagagaaaccctgtctcgaaaaaaacaaaaacaaacaaacaaaaaagaactagtagtgcttgtaataggaggggtagacctcctttttgcttttggggcttttctctgggggaggaagtgcaacagaaatgaggaagggcttaagaagcaattctctcagcactctagctgactgctgggtcgctagcagtatgataggagttgctgtcctcatgacaaatggggtgtctggttttgtttgttttgttgttttgagacagggtctctatatagctctagctgttcctgtactggaactctatgtagactaggctagccttgaactcacagaaagcctctgccttctgagtgcagggaatatgtgccagcattcctggcctggagtgcctggttttgactactgtttaggctttaggtacttgacagatgtcttgtagtcccatccccatactgaagattgaacctagcatgccatattctcccatagaaatatatttctatctctcctctctagtctttaccattttaagtggagaagagttactgtccccacttatggatgagggcatttcaactcagatgaaaggccttgtccagtgccgcacagctaagaggtggcatggactttcaccagaccccaaggcaagataaaggattcccaaatctggcatctagctctgacaaatagaaatcccaggcctctaagttaccttctgtaggagatccatgtttcccattaatttggcccagctcactgagcctgatagcccaccccatttaaccctttcattcccatcttagttcctgtttatggcagctgcagactgcactgcctccaaactgagcctacaaaaatagctcctctagcaccctaggcagccacagcagcctctgtggtcctggcttctaagaaaggcagcagcagccccccaccccacccccagcttgtatgcaggacatgtgatttactggaagtacttaggggggagtgtggccacagaagccacatccttgtttacatcggtgaaggggctaccccttcctgccttcacagccccttctccacccctcaggtatcgtcacctctgggatgacttgaggctggagctacccactttctctctcagtgcagcctttgattcctgtattatacagaaccctcatggagggaatcactgggcagtgaagacccctggcaagtcttcagagaaatagactggcaggcttgcttggtgggcacgttcccattcctagcattccctgcccctgtgccctagggggatcccattagaactgtgtatctctggggaaacacagggaaattcccttttcaaggcagccagtgaaagtcaggtttgcttaatcttcaagcccacattaattaagaaactcttgcttcctgtgcctcagcatatatgactgctcagcaaactgtactcaatttcttttactatatcaggtcctgagctgccggtgggcttaggtgtgagctgccccttatcttcagtggaggctttgtgtaatcagtctgtgtacacctttgagttggatggtagaggagttctaccactttacacagactgtccacattgtccacaagaaacctgtcaggtcacacctgtttgttttccacttcacagaggaggcataggaaactcagagagtcatttgtctctggctgtttacctcactagttactatttggcagaacttaaagtgttttccttcccttcagtttttaaaattctaatcatagccatgtgtgttgacgcacctctttaatcccagcactaggaggcagagactggtaggtagatctctggagttcaatgtcagcctggtctacagaatgagcttcaggatagccagggctactctgggaaagaaagagtgggggccaggaaggagagaggaaaggaaaggaaagaaaagattctaatcatggtggtagcctttaatcccatcactaagaaggcagaggctggcagaactctgtgagcttgaggccatcctagtctatgtatcaagtagcagagcagtcagagctatagactgagaccctatctcaaaaaaaaaaaagattctaatcttttttgtggtggtggtaggtattgaatgtagcgtttggtttggcttgaaatggagttttactagatctcaggtgatctaggctttgaacttggcaattctcttgactcagccttgattataggtatatactgctctcctttgtttcccccactgagacagggtttctgtgtttatcgctggctgtcctggagctcactctgtagaccaggctggcctcgagtcctgggattaaaggcatacaccactgtgcccaacttaaaaactttttgttatttcatttttattagtgggtatggagattgggatggtcactacatgtagaggtcagaggacaagttaagggagcaatttggttctctccttcaactgtatgagtcttgaggattgtactctagtgcctttatccactgagcatcttgctggcccttgactgtactactctcacctgtctaccctatacgctttcattcttcaagagtgtttgactttgctacttttttttttttttagacaggtagcctagcctggccttgacataatcttctggccattccacttgcacatcctgagggctgggatggtagacatgtaccaggccacctggctgatctgtgcatgttcagcatgttttcagcccttgcttgttatttccaccactcctttacaacacaaatgaaggctcaggccttggtgtagaaaagggagtttccctagtccttcagtctgtcttctccctaatgattgttgtatgactctgtgactcagagctctggtggtgacagctctgaccccatcctctcctttgttttgtcctcacacccccagctgaccaggtgtatggagaccaggacatgcatgaggttgttcgaaagcattgcatggactatctggtgagatccaagggaggccttggggcagcaggagggtagggggacccccgttgcacacaaaccttaattttccaatctattccacagatgaagaacgctgattacttctccaactatgtcacagaagacttcaccacctatatcaaccggaagcggaaaaacaactgccatggcaaccacattgaaatgcaggctatggcagagatgtacaaccgtcctgtggaggtgtatcaatatagcacaggtacttctgtagtgggtaggtgagggactaatggttcctcatcagagccaaccataccgggcccccctgtggatgctccctccttctctttctctgcagaacctatcaacacattccatgggatccatcaaaatgaagatgaacccatccgtgtcagctaccaccggaatatccactataattcagtggtgaatcctaacaaggccactattggtgtggggctgggcctaccgtcatttaagccaggggtaagtgggtccctgtgccccaggtagatatggatcattgactctgcccttagaccataaaactgtctccccctaagtttcacctgtctataaaattagtgagtcaccattgatcagaactcattctgtagcttttgatttgcctgtccatgaagtggctcactaatgttattctggttgagccttttaggatgtagagctcaatttgaagcagtaaggcagaccttggactaggtatccaagcttccacacaggtagatcttctccaacttcagagcacttacagttggagtcacagacttggaatgtagcagcttactggaatgggccctgtggacagattgtattgtttgggcctatactgaaagtccttcccacaggcccaagacctaattggtgtcagaagatgggagttgatttgcccagcatccactggcagataatcatttccgtctcacagtctctctcctcatcttccctgctccatcctccccctttcatcatgtcctctgatcctccctcttgccttcctcctaggctctttccccttctcctcaccccacttcctctcctccccaccccctctcctccctggtctctatcttcccttcaccccctcctgggggttttgaagtcttctattcaggtttcacttcctacaaaccgaaggtggtcctgcctaatcttaaacaacatcaacataccctccaaccttggtgggggggtggggttattttttaactaaattttagaaaagttacagatttgcaaaatgattgggagaatattagcatttccatatgccccactatgattaacatgaacatagtacatttgttgtcattaacaaatcagtatggattcattaagaacaatttcctcagtttctacttggtgagccttttccaggattctgtctcacatttaattgttccctttgacttcttgtgactttaacaaattctaaagaatttgactgcttttgttttgatctggtgacccactccaccggtttagaatgtcatctaatgggaatttcgctgcgtgtatgtagctattccagaatgaattttttctacttaattaatatcatttaagattcatctgtaacttttactttatttccttttcctttaaacgtctgaatgtttaaatgtttctctaattaatagacttcattgttcaaaactattttacatttgttttggggaggggtttgtggaggtctctctgttcatcaagcttggtgcaaagcccccttcctccttgagaacagtgttctcagtgtacagtttccatctagtctcttcccaaggaacagagacttgggtaatctgttaccatgtgtgaaccagtattaatacatgcctactagcctgacgttactgcctcattcctcccacttgttttgatgatctcaaaaattttaaggagaaccattcaaaagtattgcagggaaattatttttttttccagcatttttctaatgattttaactttgatattgggttcgggcagaagagcacagatatcaagaatatgtgttaggaatatgatcatgactgttgatgttgtctggcagaagtcataggaattttcccaccttttgactgctgtagtgttaggaaggaagtcatacttaaggaaagggaattatgtctgtcttcctgaattgatgttaatgtgagcttagggttagtgctgctatatctagttaaaatcccttgaccatttgcctccttctagcctttttcttgagtaaatttcccttttcctgagtaaattttcactttaaagtttagaaaactttccccatcacccagcagtcatttacatgactgctatttacatatacgggtataagctggggcagactcattaactggaccccctggagtccggtgatatctgcagttctttttatgtttagtgttactgattctattcatttttaaagtgcccaaggccaccacctgcttgtctttgcatacatttgtaattcatttaggtggttttgtcactgggagccttacttcttaactaatctttaaaaggcgattagcatacattaaggattagtctttgttttgtaaagttccttgggttttgacagatgcataataataccatgcatctatcttaggcacctattcattcagctagtttcagcccctaaaggttccccacgctttctcctgcaaccactgatctttattgactgcttttgcctatttcagaaagtcacgtaattgcaatcataagtatgtaagcttttaaaaatgctgctttcaggtagcaatatgcattaaggttcttccctggtttttcatggtttgttagctattctcttatcactgttccatttgtggaggcacactgttggtttaatcattcacctatttgaaagatatccttgcttgcttccaggttttgatgattatgaacaaagcttctgtaaactgctgtgttcaggtttttgtaggaacttaaattttatgattagttgtattaatatctggaagcaagattgcagaattataaaatcatgctgtgatttgtaagcaactgctagactattgtatgaagtggcctgatttgttccagtcgccatcacaatgaatgaaagttccattcctcttctttcccagcaattcatctttctactttttttgaattttagccattctcagtgttttttttaaaggctccttgattgttaaatgtgttgaacattgttttaatgctctaccactgagcttggtccccagcctgagtattggttacatatgtccattggccatctctatatcttttacctgtgcgattagatcacttacctacttttcatttttgtcattttgtagtgctaggaattaaacccatgtttttgtgtatgcattcattatcactgagctggccctatttttaaattggcttgatctaacctttttatacatgtatttcccctggtgtgctccatgatagaaaattatgttgtttagcatacatgcatttatgtatgttatgtatgtgcatttgaaaatgatgttgctagggacatggtggtacatgcctgaaattctagtagtcttgaggcagaggaagagaattgtgagttcaaaaacctaatgactgggctgcataccaagtcattgtttttggaaaacaaaacattaaccaaaattttaggaagtagtatttgcatttaatccctgaaatatactttgatgttctctattatttcattagcatcatgcctgtaatcccagcacttgtgagcctcaagctggaaggcaaattgccatgaattccaggccagcctggccttcttagtgagttcaagatcagtccaggcaatggccctctctcagaaagcaactaatgttgtagtgtcttaaaacttgatgcgaacttgcatgagaatacagtgtcctagcacccacacgatgccaatactgaccctttaattcctcacatagccatacccagcctcatatacgcttgattcctgcctccactccatgtctgtacttctctgttcatctttttcctttgccttatctgggaatatatgagaaaggcttcagcattgtgaaattgaatcattgctagatgaggcttctttaaatgaaggcctagacagaagagcccctcttatctccagacttaatgcttcacttgaggtgtcttgggtttgggcccatatatctgaccatagcagttcagattgccaggtcttatatctaagcctgctttcttcagttatggatggttctatacacaatccgctgaggagtgctttgtaaaaataacttctatgttgtctttgctaaggcctgtaggcctgcctttctgagcccattcaggctcttacccacgttcagagcatcaccgcacatccctgttcctctccccccctggcagtttgcagagcagtccctgatgaagaatgccataaagacatcagaagagtcatggattgaacagcaaatgctggaagacaagaaacgagctacagactgggaggccacaaatgaggccatagaggagcaggtggctcgagaatcttaccttcagtggctgagggatcaagagaaacaggcccgccaggtccggggacccagccaggtgggtcatggactctgtcattggcctgaccaagacctgttacttcttatcttttgacc

SEQ ID NO: 5 - DNA, 34796 bp, mus musculus
ctgaagccgaatcccggaaccaggtagcagagagctcggccggccttggagggagacaaggctgcgaccaatccgtctccgtaccgtcccactggacttcacatccgggatctcctcctgggcgtgacccgcgtcccgtctgcggtcctcgaaccggtgtcctgatctctttatccaggccttgctgttcccgtcgtgcctcgcgcacgaccgtagccccctcatccgggttctctcccggcgttctccgcgtttgctttgctgtggggtacttggcggtgccgccatgactattctccccaaaaagaagccgccacctcccgacgccgacccggccaacgaaccgccgccgcccgggccgctgcccccggcgcctcggcgcggtgcgggtgtaggcgtgggtggcggcggcacgggtgtgggcggaggagagcgcgaccgtgactccggcgtcgtgggggcccgtccccgggcttcgccgccacctcagggcccgctcccggggccgcctggtgctcttcatcgttgggcactggccgtgccgcctggcgcagtcgcgggccctcggccacagcaggcttctccacctccttgtgggggccccggtggccccggcggcggtcctggtgacgctcttggtgcgacaactgcgggggtgggcgcggcaggggtggtggtgggcgtgggtggtaccgtgggcgtgggcggctgctgctcggggcccgggcacagcaagcggcggcgtcaagctcccggcgttggcgcagttggcggggccagtccggaacgtgaagaggtcggagcgggctacaacagtgaagacgagtatgaagctgccgcagcgcgaatcgaggccatggatcccgccactgtagaacaggtaagggctggaaggtgaggggctgttgggcagaaacagcgagtgagtctaccaggctgagaaggagcgcaagaaaatgtttgagattggtccaagaaacccaggtcttgatgctgggcttgacattctttcctggtggtggaggcatggcttcccccgaggacttgataggggctctaagttaagtaagttaaagtactcttttgcagtcctgagatcttctctaagtgactggcattgggaattccccaggagtcgcagatacgatggagcccttccttagaggaagctctcaggcctctctaagggactttggttcagtaactttttcctttaggacaagtgtgagattccctcccgcaaagaactcgaattaaggtggtgtcctcagagaaatagtctaagcatacccaagaaacttaaacccttgatgtaggaaggacctctctcttttgctgagtctgctcaccagccatgtggcctcctcaggagtcctaagcctgtatttggggacctagacttgcttgtagaattgaaggtttagagtatacccacacaccttttagatagtgatttccaaagtatccctccagtgttgtgaaacgtctttctggaagataaaattctcagtggcttagggacaaaggccaaaaccagtacctagaagcagaactgtggctcacagtcggtgttgacgtaaagacctctttgcttatggcccggggtttaattacagatgttccaggcaagaggacttcttcagaacacagtttcagtcatgggctggtgtctatgctcttgtgtgtgtgtgtgtgtgtgtgtgtgtgtgtgtgtgttcatatatttccctaaggatggatggatggatatatatatatatatatatatgtgtgtgtgtgtgtgtgtgtgtgtgtatatatatatatatatgtcgtacctattgaaatttacttcagggattcaacatctcagttctccctttctgtgcatctggaattctctgatacccaaggggctgagctgttaatctcataggaaaagagctctcaagtcactagacccagattaagttccttggaaaagaaaacttgagagtctctctcaggaagcgctccatctcatgtggagaactctcacctattgactttgcggatggggtctagagtctggcctggaaacattgcgtcctgtccaatccctgcctcagaaactccagcctcaggacatgggcagtttggagacccagaggccatgtcagatacctccctctaaatctgccttcaagggcctgagactctgttctgtgaaggacataataaggctttctttaggaacaggaaccccatccttgccactgaagactgtttgtagaggtaatgcctgaagttcttcctcctgtaccttgagatgctcctcacacccagtctgacatttcccaccaggactgggtggggcatggttataggtttcctgaggaatgaggaaattctcaacatcacatcagttgtgtgaggaattgttctacaccttaggatctgaggcctgaatcttttggggctgtcacctaagatgacctaagtatcctcttcataggaggcttttaggaacataagtctcttttggggtttatttgaacctgggaatgatacagttttgaggaaattagttttaggcctctttccatcttcctcaggaaaaagagattcctttgccttggggactgagacctgagtccttgcttaggcatgcagctctcctcccaccacaccaggtgattctttctcaccagggagaggacatgaagtcatcttcaatatggccagaggcttccttctttggacagagcacctgggtgttctggtttcttcttaccctcaggtcagagccaagaaggctgtcaggtcttgggaccagaagcctgaggcatcccttggactggtagaggttctgaccctattttcattgtttctcacttctggaaatttctcttacattccatttccttttggttgaaaaatttgttttacaggggtcagagtgtggtctcacatccactgttgttcttcttttcctgtcatttctggcggaacaatcatctagactcatctagagatgtcaggttcaggaggttttgttgttgttttgagacagggtttctctgtatagccctggctgtcctggaactcactctgtagaccaggctggcctcaaactcagaaattcgcttgcctctgcctccggagtgctgggattaaagtgtgtgccaccacttcctgacttccaggagttgtttgtttttcttcaaaacaagatttctctatgtagtatttttctggaacttgctctgtagaccaggctggcctttaacttggctatccaagtgctgggattacaggtgtgtgcacaaccactgcctgactgtgtgcaggagttacagatccctgctttttgtaaagtctctttacccttacagaggtatgtatcccttatccaggggaaagagaaggtatgttgttggagatgcaaaaggccacattcttataccccttgcagttccgcccttatatttatcttcataagaacttagaaataagaactgacggactcatgaaacctgctcttccctgtgatgggagaggctttctgttctatgggcacaaagggaagaaggagctactcctagtctccctgactcgcctggcccagctttgagcctcttgaggatgagaagaaggggtattggtcctgccactccaatcttggttcatagctgttgcagatgctcataacatagaggctgtttcagtactgacagaggggattagtctgaatggtaaatctggttccagttctgcgaatatgtactcctgtttcctttaggattctccgagtaccttgggttggagtcctggggaaatgatgtcatagggtgccttttgtcagagcctagccactgaaaacaatggcttataagcatcctaagccaggagaactcagagatcttggagtaaaggacaaacatgctgagatagtggaaaatgctaggtttagcagtacagtcagtgtgtctggttctacctctcagtcagccacattctgcagagtgaactagtacagcttctgttctctgcacctgatttactttcactaatgtgttggtgtgttgcagtcaactttggctttaagggatttcaaagccccctattcctgcactagatagtgaatagtgggtatcttttgaagaggagctgggttccttctctttccactttgcttcttttccagtcatagaagtttgctgggcaggtcaaagccttttttgtataagggttaaggatgatgtgtggcagtgttgtagccagctatcaagttccacagttacatgtggaaagaatttgggatttggagctggacaggctggagttcaaactccagtgttaactgttgaactgttttaagattgtagaactctcatttagggcaaaattcatgagggttactagagtgtaaacatctagccttgtccaccttggctagttcttttcactcaggatgagcaattggccccaggataatcttttctcctcaagaggctttgcctatccatggtactcatctcttggcatctagaagcctgcccatctggaattgggtggttggctgcatttgagtgcttgtttgtttgtttgtttgtttgtttttttgagacagggtttctctgtgtagccctggctgtggctgtcctggaactcactttatagaccaggctggcctcgaactcagaaattcgagttctgcctctgcctcctgagtgcttaaaggcgtgtgattaaaggcgtgcaccaacacgcctttgcgagtgctttttctatactaaacttttgtgtggtctttggatagttcccttttccaggtcttttgttttgggggtttgtttatttttcaagacagggtttcctctgtagctctggctgtcctggaacttactctgtagaccaactggcttcagaactcagaggtctgacctgcctctctctgactgttgagttccagggttaaagctgtgtgccaccatacctcacactacttgggtcttggtttttctacctattaaatgggtagttgtgaggacagtggttggactcattgcagtgaagaaaggtgtaatctcatctttaattctctgttttacactcttctcaacctttattggattttatgtgggaccccttggctctggggatggctcagaatttctctatgtaatggtcctggtggtccttgaatttactctgtagaccagactggcctttgaactcagagaactggctgcctcttcctcctgaatgctgtaattaaggcctgcgccaccactgaccacctagaatgttatcttttagaagatgtgatgtgatgtttgcacttcttgggagtgcttataagttcttcagtgtttttgcatttgtttactgtgctgaaactagggcgctcaattttctggcatgaaggctcatgagtatgatcccatcatttgggaggttgaggcaagaggattgccaagagtttgaggccagcctgagctatggtgttgagaccctgtctaaaataaccaaaataaaaagtgtacaattcagtggctttcaaaacagccatagaattgtacttctgtcaccagttttatttttttatttatttttatttattttttttggtttttcgagacagggtttctctgtgtagtcctggctgtcctggactcgctctgtagaccaggctggcctcgaactcagaaatccacctgcctctgcctcccaagtgctgggattaaaggcgtgcgccaccacgccctgtcaccagttttaaaatgtttttaatattatagacccttttatagcttttaatgccccccattccttcctccctttccagctcctggcaacctattaatttgtctggattgaactattttgaaacaagtagaatcatacactaacgtcatcctttgtaactttgtctcttttggatagcatgtgttcagagcacatcatggcatagcatttacctatactttgtttttattgcctagtaataaaatcttgggttttttaatcctctggtggcccagaaatagttttttttggggggtgggggtcttctctttcttctattctggtaggcttgtgtgggtccttagagaagcagtatgtctgtttctcattggatggattgcctgtgtttattatccctggagcagagccagtgttcctgggtgttttgggtgagggggtggtgttggctccaggtttgctgggacaaggctgtgaggcctagaatactaaacacctcttggccatgggctctgagaagacatctgtccaatgccgttgccatccttccctgtacccttccccctttattggcagttcttttacccacaggctgggtcagcaacttcccaggctgagagggaggattctgggcccctactgccttttaattctaaccctctctcgggaggtggatcactcagaatggaagccttgctgtgtatagtctcacagccacaaagccctagagctcacaccaaaggagtactacaaggggggatatattaatttcctgtggttgttgtgacaaataaccatggactgtttggcttagaataacagataaattctgtttcagttttggtggtcaaatgttcaaaatgggtttcacttggccaaaatcaaggtgttggtgtttactgaacatcctccagcaagtctgggaaagagtctagactttctccctttctgatggccgcatcacttcagtttccacctctttctctggatgcatgtgtatgttttccttttctgtatgaaatctcctgtaaatcttctccctcttctcactctgtacaggtgtagcactttgcttttgacaaacgcaacgtaaggaagagaagagtttactgttacttacagctggaggggatacagtccagcctcatatggggaaggctgctggcaggagtgtaaggcagccgctcatatgtctgcagccaggaagcagagagatggatgctggtggtacacggtctacttttctccttaagcacaggacccctcaagcccatggggtggtgtcatgtttagggtgggccttcactcctccgttaatgctcttgaaattccctatagaagcacaccaagatgtatgtttcttaggtgatttcaaatccatttgagttgataatgagggttaactatcacaaatctacccattctcaactcctaagccttactacctttaaatatcaatattttactcctgttcctccacatttgatagcaatctcaaggtagataacacatttagttcattgtaagagtagtcaaattcttagcagttctaacattgttcaaaaatcttaagttcaaggcctggtgaggtgtggtgtataccattaataatagcacctgggaggtagaggcaggtagatctaagtagttctaggccagccaaagttgcatagtgagacttaattgtgagtctctgtaaaattaacaaacaagttacattatctaatatacaagggcactgagcaaacattcccattccagaagagaggagtgaagatattagcaaagagattagatgaaagcaagactgaaacctatcagggaatctagttcatgcccaacacctgggctttttatggcatcacctgtgttccaacaagcttgggtagttgtgctctcatcagctctgatgctttgagcatatgtagcctctgtcttgagtcagcttcactaagttcctaaaacagaggctctcaacctgggcactgaaccctttcataggatcacattggaaaacacagatatttacatgatgattcattagagtagcaaaactacacttaagaaataacactgaaaatagttttttctttccattttttattaggtatttagctcatttacatttccaatgctataccaaaagtcccccatacccacccacccccactcccctacccacccactccccctttttggccctggcgttcccctgtactggggcatataaagtttgcgtgtccaatgggcctctttccagtgatggttatggttggggtcaccacaacgtgaggagctgtattaaagggtcgtagcattaggaagattaagaaccgctgccctaaagcttttcttgacagatctttctggcatctctggtacccttgaggtcacctttgcaaaaagcattacctttatagcttcataaaatggtctcttagggtcttagtgcaggcaatctggccctgctaccttggtgcaagactgtgtgatcaccttgttgaattctggatgtctgaaaacgcacatgatgtggatgatgtcaagttatgctaccagctcaagatggaacctagttgtattagagcacaggcgctgtggcctttctctgccttctagagcatttcctgcagtttactctagagtctctgctttttaggcattatgttcttcatgtttccggttttatagcctggagcctttactgggtaggtaggctcttatccccaaggcagtatatataccatatagagtttagggtttttcttaattgcacagatttcattatacttctagacactttgtccaaaccaaactttttaaggcagtcaagctcctttcctcaccaaactgcacatttctagccctttatttatttatttatttatttatttatttattgagttaggggctcatgtaggtcattgtggcctcaaatttggtaatgtaactcaggctgactttcctttcctcttgtctctacctgccaaatgttacgactataaacataagcacaatatccagttaaaccttgtttatgcttttttttcctccccaaactgtacattttccacatctagtatggtttgcatgtcctcagtggattaatgcagtgagtagtaaccacaagtagaacgaaagcctagaggttatgctgactaacaatttgacaagcaatttagtccattacttttgcatttagccttgctcaaatgatcaggtgggcataatgattgccagaattaaaaaaaaaaaaatggccagccgggcgtgatggcgcatgcctttaatcccagcacttgggaggcagagagaggcaggaggatttctgagttcgaggccagcctggtctacaaagtgagttccaggacagccagggctatacagagaaaccctgtcttgaaaaaaaaaaaaaaagaggaagaaaaacaaaaacaaatggcctctagtcctttgacatatctgagatctctttaaccaggacttaattgttcgcatttctgtattctgttagtcatcattcctactagaatagactgttaagctctactttggcactctaggtcttctgtagcccacagaactaaaccttttaagattcttcctgcaaccacctctaaatgcctacaaattgtatggtcatgtatacacagcagtgaccccacttctgggtactaactttatctcttttctcttgttgctgtaacagaatacctgacaaaagcaacttaagagatttatttgaggggtacagccccatcacagtgggcaaggcatggcagtgggaacgtaagatagcctttcatgttgcatcagggaagaagtgaagaatactgatgctcaacttcctctttccttttcccgttttttattcagcccgagaccccagcctatacgatggtgtcatgtacattcaggtaatgagttagacttacctggcaactccctgaagaaattcccatctagagttgtcttttaagtgattccaagtctagtcaagttaaaaataaacttgctgggcatggtggcgcacgcctttaatcccagcacttgggaggcagaggcaggctgatctctgacttcgaggccagcctggtctacagagtgagttccaggacagccagggctacacagagaaaccctgtctcgtaacacacccgcccccaaaaattaacatccacacctgagattgtgcctagactccagtgttccagtcacttctgcaaaacccttttaaaaacacatacaggttttaggcattaggtctgatattttcaggtggacattattcagtctaatccagatcgggagggaatgggaactcattaagagatgtcctgctgctgggttaggtatatgcactggtcttaccatgttttccaccagccggaagtagttggcttgatagcactttggaaagatgtagttacaaactgataaggtactcctttaatcccagcactctcggcaggcagatctctagtagtttgaggccagcctggtctatatagtgagttcaaagacagccagggctacatagaccttgtctcatctcctccccttcactctactggacaaagtactgcctagtatcccacgtactaggaagtgtatattcccatttcacagattggaacactatggctcaaagcagttcatcacttggcttttatttggtagaactgcattgaaacctaaatcagtggttccatagcctattctaacttctcttaggcttttaggtgtttttgtttgtttgtttgtttttggtttttcaagatagggtttctctgtatagccctggctgtcctggaactcactctgtagaccaggctggcctcgaactcagaaattcaagttttgcctctgcctccggagtgttgggattaaaggcgtgcaccaccaccgcctggtggcttttacgttgttaaaccagcttttaaacagggtcctgtcttaactcctgggatactatggtatcagagagctttgtctagtccttttgctaaggcttagagatggggagagagactctgctccaggattggtcttgaacatgtaaagttcaggattgagacttgatcttctcgggtcaggacaccaatacagaatacatctacagattgttggactgttctccagccttctagcacttcctaaacatcttcttcccaaagtgagagaggaagaaagctagagctctaggttttcaaactgtgatacgaaggccagtggatgcttagtgatacatcctctagatgcaggcctagatgccatagttatcgtaggacccacactctatttgtgcaaaaggtctgtctagtcagacttcctttatttttaggcacatcagaactcctccaggacttgctaccaggcatgtgtcaccgctcatggtacatcatgtgctgtgtctctactactaggctttgctactaccctgactgcagctcctttctgcctttgtaaagtgtgggtaatgctgcttcctgccacttgggttgcagtgaggacaatgaaatgaggtcacttttgtatctggcacctggcataggacaaagcactcagctaatatgagttcatcctttctggcttttccctgcttagctgcctagttttgcttgcgtctttgctctcctatacacattgccaggctttgagcatctctggtgcttggtgacagaaatgactttatttcttatccacttatcaagcaagttttgatcctttgctcaagtgccagctttaatgtcagggtaaggtctcttcctgcttcacaaaagcaagggagcattcatttgttttgcagccccactcaaactgtacgtcatcactgcgtatttctgtacccttcccttcaaagtttaccagggtagagacggaagtctgattcatttttctgtcttcattgtccatcccagaatgactcctattttgtgagatgagaactaggccccctctttttctctttgtatcccttctatcttcctcatctaccttggagaatgctgttctcccccctttaactctccctattttaaggtatggggctatggttaaaagtttcttttctgaggcagaggcaggcggatttctgagttggaggccagcctggtctacaaagtaagttccaggacagccagggctatacagagaaaccctgtctcggaaaaccaaaaaaaaaaaaaaaaaaaaaagtttcttttctgggcaccccttgacaggctaggccttgtgagtcttggagatggctaaaaatgtgggcaaacgatgaacttctatgacagtgcacagcctccagggcaggatgagcacccgtgctgctggaaggttgtgcacagatgggtttgtgctacccagggaagcacattaaaggcttacaggtatatttgtcatctctgcaaatgacgcgacaccttcctgatgtagtggccccagagggtggggctggctaggttttcctttgtctatgttcatcctctttctagacactcacctaggacttcttgagtggacatcatctctttttttgggggggggagctggcctcatctctgccccccaccagtgctggaattaaaagcatgccctaccatgccaggtttgtatctctctctctctctctctctctctctctctctctctcacacacacacacacacacacacacaaagatttatttattcatttaatgtatatgagtacactgttgctgtcttcagacacaccagcagagagcatcagatcccattacagatggttgtgagccaccatgttgttgctgggagttgaactcgggacctctggaagagcagtcagcagtctcaaccactgagccatctctccagcccttgtacatcgctttttgttggtcttttcctcttttatgtttagtgaccacctcaccagtataggctattacagagccaacctcctgctctcttggcagatgtgttgagaagaccaaatgcttctcagtttgtaactggtatgagtttaggcagcttccctacaaccagaaaacactgcagtgatggagctggctgggtttagacctccggacactatgcctactctggtttttctacccatttcctgtagtggggtacaaaaatggccctttgtgatcaactttagcagggagcctataagttcctaggaacagggcttcctattttgtagtgcagctgtgttgctaggtcaagctgtctgcttctggcagccagcagatggcgtgagaggcctgagaaagatctgcttctgcctccttttgaaatggaaatgttttaagttgtcaaggtcattattattattattttaatctagaagtatgagtttgtatatgttgattaaccaaacactttggaatcaaatgtgatttgaattttaggaactactcagaatttcaatttcctggtgtttatactttatattatataatactttaacaggctgaagaagcacctcatgatcaagtgcctaaatgtttctgtgggaaaatgtttgagccttcaccctcaagtagggtatttggtatattctgtttaggttatgatgggacatgaattagatgaagactttgagttttctgtatttctttctttctttctttttttctttattctttttttttggggggggttgtttgtttgttttttgagacagggtttctctttatagccctggctgtcctggaactcactttgtaaaccaggctggcctcgaactcagaaatcctcctgcctctgcctcccaagtgctgggattaaaggcgtgcgccaccacgtcgggctttgtattttttcaggtcttttgatgttcaaagcatttagagatttggaatttcagataattgtatatctttatcttctgtatgtgagtataccattgctgtcttcagacgcatcagaagagggcatctgatcccattacagatggttgtgagccaccatgaggttgctgggaattgaactcaggacctctggaagagcagtcagggcttttgactgctgagccatctctgtagcccctagggattatatatatatttgtttgttttttgagacagggtttatctgtatagctgtagctgtcctggaactcactctgtagaccaggctagcctcgaactcagaaatccacctgcctctgcctctcaagtgctgggattaaaggtgtgtgccaccattgcccggctagggattatattttattgtctacttttttttcaattttgtgatatatatatatatatatatatatatatcatacatatacacacatatatacatatacacatacatatttatgtttatatttatttatttaatttatatatgtgagtacattgttgaactcaggacctttggaagaacagtcagtgctctgaagcactgaaccatctctccagcccgggaaactttttactagaacaccacattctccatctaggaacttatgaggtctaggtccctggctgcctgggccaggtcttgcaagattgagagcagggctctgaaagtagatgaagtttctgttttcagggaatctggggcctccctgggattgtcttgtccttgtccatagacttaagtctcctgctttgtagtcacagagtagtcaagaagggctgtgaactttccagtatccttttggccaatcacctggtcttctcaggaacttgaaggcagcacctggagaagggtatgggcttccctgttgctgatcttcctactttttcctccagcaggaacactggtttgaaaaggccttgcgggacaagaaaggcttcatcatcaagcagatgaaggaggacggtgcctgtctatttcgggctgtaggtgagtctctatcttggttttgagggctgaggggcttaaggcttctgagctgtgtcctagtagtcagtagcagtccttgagacaggattgtggcagaggtaactgcttgatattttaggataaacaggcgcggagctcttgttaacgtttggcctctggtgttggattgtgttaaatgagtaatgataacagcaattgtagtgataaagggacaccactgttgacatactgctctgccaagattccaggaaacccacttattctgtcagttaggtaggtggtcggttggttggttagttttcaagtcagtgttttctctgtgtagccctccctgtcctggaatttgctctgtagaccaggctggcctggaactctgagatctgcctgcctgtgccttctgagtgctgggattaaaggtgtgcaccaccacctggtgtggaaacccttttattaaccccaagtccaggtgaacgtgagactgaaaaatgtctcagaagtggggagtgactagtctaaggttatacaaaagtatgtagagtcaggattttgtgtgtggattaactgtatcatattgtcactttggtgtttctctggtatcgtatattgcggatggtgcatatttagtgcctgtgtttatgcttgtgtatataataaaattgggcatggtgaagcagtttttctcccagcattcaggaggcaaaagcagggtggatctctttgagttcaaggacagtctggtctacattgcaagttctatgacagccaaagcttatatttgtcttgtctaaaaaagaaaaatctagatctttacaaatttctatattagagttttttgtcttttaacttgcacaaaagtagagaaaacagtgaaccctttcagatttagtgacgtagcttcacaaagtgattaacacatggatagccttactttatgaactatatcgtattatcatttcattcataaatatttctctatgcttctttttaaagatttatttatttattttatgtatatgagtacactgtagctgtacagatggttgtgagccttcatgtggttgttgggaattgaatttaggacctctgcttgctctggtcaacccccgtcactcaggttgaccctgctcagtcctactagctctggcccaaagatttatttatcattataaaaaagtacactgtagctgtcttcagatgcaccagaagagggtgtcaggtctcattatgggtggttgtgagccaccatgtggttgctgggatttgaactcagaaagagcagtcagtgctcttacccactgaaccatcttgccagccccttctctgtttctttcttttttctttttcttttatttttttccgagacagggtttctctgtatagccctggctgtcctggaactcactttgtagaccaggctggccttgaactcagaaatctgcctgcctctgcctcccaagtgctaggattaaagacgtgcgccaccactgcccggccttctctgtgcttctttaacagatacatctatattgttttctcttgttttcatataagtaaagtcctgttgtcatacctaaaaaattttttttctttcctgagacagagtcttgttctctagcccaggctagcttggaacttggaataatccttcttcagcctcttttttttttttttttaaagatttgtttctttattatatgtaagtacacagtagctgtcttcagacacaccagaagagggagtcagatcttgttacggatggttgtgagccaccatgtggttgctgggatttgaactcaggacctttggaagaacagtcggtgctcttaacctctgagccatctcaccagcccctttttcagcctcttaagagctgaaattatagatgtaagtcggtatgtacaactaagaattggtaaattttttttgagactctggtcgtcctggctgttctggaactttctgtgtaaactaggttggccttaaattctcagaggtcacctgccttagcctctcaattgctggggttaaagtcatatgctactgtgccagcttagaattagtaatttcttgatattgtctgttaagcctgagctagatctttgaccaaacaaggagttttgaaatcccatactgacatgaagggatcctagattgtggcctgttctctcctcccacaccagtggttctgctatcttcgaaggaaaattgttccctgacatttttgaactgggaatcagaagatgtggctcttaggctggctgtctccccatcggtgaaatgggtgctccctgggctccatcagttctttctaggtctgctcttggtttctcggtgatccgcatgtttgttataagctgtttggtccttagcaagtgtctcttctttcttaatcctctttcattagttgaagagtgggttaaaggactcccctgtggtgatggttttgatatggtttgatttactttggtaaatctctttaatgcatacttggtcattatggaacagtagcactagtaaagtctggctactcttctcagttgtttcccagactcagagctagaaatatttgtggaatgggtgggacaaaggaccacaagcagaagctattcaggtaatgatttctgttgctttggagaaaaatcccaacccttctagccatctggctcagttatgttctccctgggaaatttactagagaaagacctgagtttggaaatatcttagggataaaaggaaagcagagaatgaacaggtgaggatctattagtttctgggttccatattaacctcgggatggatgttagaagaagcaagattgcttttggacatctgggctcagatgttctctgaggcagcttggagcccttgagcacctggtgtgaatagttatccacatcaagagcaggtttgtatgcgtatgtctgtttagttacccccccccccccatcagggccttccagtaaggggcccaagcatacaggaagagctgaccacagcagctttaaggcctttccttatcagcactatggctacacatttcccctgactgggctgccctcagcttttctctgtaaaacctcaagtcctatgggctctcccctgaagtacgtggcccctggtctctaggcctcctctagaggtttccctggtgcagagtacacaacatgtgctggacaaggggactttgtccccaggctttccgctgtccccctgtttctagcctagcttatacagggacagatggccatcacctcactctttctacaaaggcctgcaagcattaactttttaccatgtattgactaatggagggaacatgtaactgagagctggaattgagtgagttgcacacatacattacactttgctgtttctctaaccctgcttgctgtgtgctacacatccagctgggcgctttaggccttcctgagacttttggatcattatgccatgaaatagaagctctgaaaagaagggcagaaagtatagctcagtactagctcttgtctagcatttgggggaccctggatttgatgctcagcattgccaaggattgaaggagaagtgacaatggtagagtttgcacagaggatgaccctaggagcccctagctccgtggtttttaacctgtggcttgcaaccccctttggggtcatataaccatttttgcctaagaccattggaaaaacgatatttacaagtagtaaatgcaaaattacagttgtgtagtagcacacgtagtttgtttgtttgtttgtttttttggtttttcgggacagggtttctctgtgtagtcctggctgtcctggaactcactctgtagaccaggctggcctcaaactcagaaatccgcctgcctctgcctcccaagtgctgggattaaaggcgtgcaccactactgctcggctctttgtccattctttgacctctctagattttccttctacctagaagcatttattcttccattgttgagggtccagtgcaggtggttttctgtcctttgttttgcctctgacatccagagagcacttttgaatcagtatcaattgcttgtacccatttctccctagtacctcctcctagagatttatgagcatcagtgatctaccaggtggaggcaggtatcctgtgacccacccagtccctgctgtgctctgataaccttctagaaacatgagcctccctccctccctttccctccatttgactttgactaggcagaagtgtctagctctggccatggcaatggtgctggtctctggaccaagtagaagccacatagttgtgtctgcatggacttcagaagagagtagcgtagctagggctctgttatagcccagaagtattatccaggcccacttctggttgagatagggtctcactctaggaactttttaggttagaccaggtgcccttgtaccttgagcttgtgatagtcgtcatatcttgaccttctgtgtattggggttacagacatattgctaccatgctttcttgtttgacagattttctttgtgacagggtttctttagaactctctgtagaatgtggaccgtagaacttaatctgtagatgaggctagaatctgtagatgaggctagaatctgtagatgaggctagcctccaactcagagatattcctgcctctgcctcccgaatgctgggattagaggtgtgcatcactggccagccttagatttgcgagctttataaaatgagaaactgagaccttaagagaaagccaggaccttgtcttgtctaagtccaccagccaatgtaagaacaacagtgtttgaaattgtattaagacatagtggattcctatgttttatttcttgtacacctgccacctttgatatctctttgctcagaatcatttgtgttttcccatttttgccaggggaatcctcaaacagaaaaacttatatctcagattggtaggagggtggggcaggggatctcccagaggtctgaggtgatatatcttgcccatagtctgtacccagtgggacagttgggtgtgtataccctgtcataccatggctacttgataggtgggtagaaccttttcctggatgctgcttcctcaatgaggccagggtttccacgagagcatgagttcagtggagagcagactaggttgctgttgcccttgtagctctgtccatctaacccacatttgtgtggtttgggtttaggttctccacgaaagccaaacttcctttctttattaaacatgtatgtgcgtgcatgcataccatagtatgtgtatatggaggtcagagaaaaactcaaagagtctgttctctccttcctccttccaccctgtaggttctagggatggaactctggttgtcagtctcggcagcaggtgcctttacctcttgagccatctgcatagcccgaagtttgcctttctgtctttagcagaacttaatggtaggtagcaacctgaggagtagatggttctcaggtccctccaaagcaagagaagacttttcatttatagcactttagaaataatgtgggcttgagccggtaaagggaaataaatggttcagccagtaaaggtgcttgttgctgagcctggcaacctgagttcaatccttaggactcaagtgatgagaggaaaaaacagactctttcttacaggttctcttctgacctatacatgtgctgggacatacagatgcacaaaatagataaatgtaataataaaatggtagaaaagaaaagtggagctggagagagctcagtagttaagagtacttgctgctcttccttccagaggactctaagttgggttcccaggactcacagtggcgcacaactttccttaatgctagttccagagggtccactgccctctcctgtttgtgggcatcaggtatgcgcgcagcacacatgtacatgtgacaaaactagtatacatacagcaaaataatctttgtaggggggaaggaggaaaagtaatctctatcttacttcttgtaagtgtggacaaatgcaggttacattttagggagcctgaagaaggaggacttccccatacagcagaggagaaagatgaaacaaatttgctagaagtgttggtcattcctctcccttacaaaggctgggaaggaagtagtataagttcctaggtatgcacagcttcttgtctagtgttaagcctttcttgattggtgacaaaggcatgtactcactgtatgctgtggttctgtgttgtggaatgggtcatgtgggtatttagtctgtttcagtcttttgtagaccctgctgactgcatgtgggcacatatgtgcacttccttgtatctttgtatgttcacagaaagcaaagtagcgtggtccatggggaggaaggttgatgttgaatctagggaagtgtgcagccagatacttgttaattctatattcagtcccaggcctttttttgtttgtttttttttttttgtttttccgagacagggtttctctgtgtagccctgactgtcctggaactcactgtgtagaccaggctggcctcaaactcagaaatctgcctgcccctgcctcccaagtgctgggattaaaggcgtgcaccaccaccgcccggcctgtcccaagccttttccttgttccaaccaatttcttgtggattagcaaggaaactgaagtacagaggatcaggcccagccctaagagaaggctgtgagggatggggtagggaatgtcacttggggccacctattgactcctttcttcctttagagctaaatacgtgctaagtatgtgatcctgagccagccgtgatacttctgtatcaatgccacccccatccctagcacagataactttgtcctttttgattttgagtgaagatcaaatgagttgttttaaaagtctgtagtaaaactaatgatagtaatgtgctgagaatttgtgagccctacttagaaagagaacagaggtggactatagctgggggaatcccctcccagctggaccctggaaaaaagcaggtgcatatgggcaagtgcagtgttagcaagaggaggagtttcagtttctttcaaaacattttctctgaattccccctgtatttgtgggtccagtgggccactctttctcccaccttgtacccctccccaggaagtgcatcctggcccccacatgctaacctgggagggctaggaaaattagaaaacctagttgatattaagtaatgatatgcttggggctggtgagatggctcagcagttaagagcactgactgctcttccaaaggtcctgagttcaaataccagcaaccacatggtgactcacaaccatccgtaacgaaatctgacgccctcttctggagtgtctgaagacagctacagtgtacttacatataatagatagataaataaatatatatatatttttaaaagttataatatgctttacctattaaagggttttttttcctctcttggtggggaagtactgtttgtatttccttgatctagagatcatcatcatcatcatcattattattattattattattattattattgatttctctgtgagccctagatgtcttggaactcactctatagaccaccctggccctgaactcacagagatcacttttgccacccaagtgctgggattaaaggtgtataccaccaccaactggctgcgatccgtattttacttcgtgttaatgattaagctataagctgggtatggcacacctgtaaccccacacttgagagaggaaaggaggaggattgttgtgaggttgatgccagcttgggctacagatcgagttctattccagccaagtgtctcaaactaagaaaataaaagtaaaaaattaaggaacagcttataatgagtcaataggtggtcccaagtgacatttccccatccaaggtgttttctaatagaatctgggatgagcctataagtattataacttgcctgtacccgaggacccaacataaaaagtcagtattattactttgataggaatttggttgttagagttttgaacaaaggcgcaaaaggtcggcgtttggaccattgcattcttcaaaaagaactagtagggcagggcatggtggcactcgcctttaatcccagcactcgggaggcagaggcaggtggatttctgagttcgaggccagcctggtctacagagtgagttccaggacagccagggctacgcagagaaaccctgtctcgaaaaaaacaaaaacaaacaaacaaaaaagaactagtagtgcttgtaataggaggggtagacctcctttttgcttttggggcttttctctgggggaggaagtgcaacagaaatgaggaagggcttaagaagcaattctctcagcactctagctgactgctgggtcgctagcagtatgataggagttgctgtcctcatgacaaatggggtgtctggttttgtttgttttgttgttttgagacagggtctctatatagctctagctgttcctgtactggaactctatgtagactaggctagccttgaactcacagaaagcctctgccttctgagtgcagggaatatgtgccagcattcctggcctggagtgcctggttttgactactgtttaggctttaggtacttgacagatgtcttgtagtcccatccccatactgaagattgaacctagcatgccatattctcccatagaaatatatttctatctctcctctctagtctttaccattttaagtggagaagagttactgtccccacttatggatgagggcatttcaactcagatgaaaggccttgtccagtgccgcacagctaagaggtggcatggactttcaccagaccccaaggcaagataaaggattcccaaatctggcatctagctctgacaaatagaaatcccaggcctctaagttaccttctgtaggagatccatgtttcccattaatttggcccagctcactgagcctgatagcccaccccatttaaccctttcattcccatcttagttcctgtttatggcagctgcagactgcactgcctccaaactgagcctacaaaaatagctcctctagcaccctaggcagccacagcagcctctgtggtcctggcttctaagaaaggcagcagcagccccccaccccacccccagcttgtatgcaggacatgtgatttactggaagtacttaggggggagtgtggccacagaagccacatccttgtttacatcggtgaaggggctaccccttcctgccttcacagccccttctccacccctcaggtatcgtcacctctgggatgacttgaggctggagctacccactttctctctcagtgcagcctttgattcctgtattatacagaaccctcatggagggaatcactgggcagtgaagacccctggcaagtcttcagagaaatagactggcaggcttgcttggtgggcacgttcccattcctagcattccctgcccctgtgccctagggggatcccattagaactgtgtatctctggggaaacacagggaaattcccttttcaaggcagccagtgaaagtcaggtttgcttaatcttcaagcccacattaattaagaaactcttgcttcctgtgcctcagcatatatgactgctcagcaaactgtactcaatttcttttactatatcaggtcctgagctgccggtgggcttaggtgtgagctgccccttatcttcagtggaggctttgtgtaatcagtctgtgtacacctttgagttggatggtagaggagttctaccactttacacagactgtccacattgtccacaagaaacctgtcaggtcacacctgtttgttttccacttcacagaggaggcataggaaactcagagagtcatttgtctctggctgtttacctcactagttactatttggcagaacttaaagtgttttccttcccttcagtttttaaaattctaatcatagccatgtgtgttgacgcacctctttaatcccagcactaggaggcagagactggtaggtagatctctggagttcaatgtcagcctggtctacagaatgagcttcaggatagccagggctactctgggaaagaaagagtgggggccaggaaggagagaggaaaggaaaggaaagaaaagattctaatcatggtggtagcctttaatcccatcactaagaaggcagaggctggcagaactctgtgagcttgaggccatcctagtctatgtatcaagtagcagagcagtcagagctatagactgagaccctatctcaaaaaaaaaaaagattctaatcttttttgtggtggtggtaggtattgaatgtagcgtttggtttggcttgaaatggagttttactagatctcaggtgatctaggctttgaacttggcaattctcttgactcagccttgattataggtatatactgctctcctttgtttcccccactgagacagggtttctgtgtttatcgctggctgtcctggagctcactctgtagaccaggctggcctcgagtcctgggattaaaggcatacaccactgtgcccaacttaaaaactttttgttatttcatttttattagtgggtatggagattgggatggtcactacatgtagaggtcagaggacaagttaagggagcaatttggttctctccttcaactgtatgagtcttgaggattgtactctagtgcctttatccactgagcatcttgctggcccttgactgtactactctcacctgtctaccctatacgctttcattcttcaagagtgtttgactttgctacttttttttttttttagacaggtagcctagcctggccttgacataatcttctggccattccacttgcacatcctgagggctgggatggtagacatgtaccaggccacctggctgatctgtgcatgttcagcatgttttcagcccttgcttgttatttccaccactcctttacaacacaaatgaaggctcaggccttggtgtagaaaagggagtttccctagtccttcagtctgtcttctccctaatgattgttgtatgactctgtgactcagagctctggtggtgacagctctgaccccatcctctcctttgttttgtcctcacacccccagctgaccaggtgtatggagaccaggacatgcatgaggttgttcgaaagcattgcatggactatctggtgagatccaagggaggccttggggcagcaggagggtagggggacccccgttgcacacaaaccttaattttccaatctattccacagatgaagaacgctgattacttctccaactatgtcacagaagacttcaccacctatatcaaccggaagcggaaaaacaactgccatggcaaccacattgaaatgcaggctatggcagagatgtacaaccgtcctgtggaggtgtatcaatatagcacaggtacttctgtagtgggtaggtgagggactaatggttcctcatcagagccaaccataccgggcccccctgtggatgctccctccttctctttctctgcagaacctatcaacacattccatgggatccatcaaaatgaagatgaacccatccgtgtcagctaccaccggaatatccactataattcagtggtgaatcctaacaaggccactattggtgtggggctgggcctaccgtcatttaagccaggggtaagtgggtccctgtgccccaggtagatatggatcattgactctgcccttagaccataaaactgtctccccctaagtttcacctgtctataaaattagtgagtcaccattgatcagaactcattctgtagcttttgatttgcctgtccatgaagtggctcactaatgttattctggttgagccttttaggatgtagagctcaatttgaagcagtaaggcagaccttggactaggtatccaagcttccacacaggtagatcttctccaacttcagagcacttacagttggagtcacagacttggaatgtagcagcttactggaatgggccctgtggacagattgtattgtttgggcctatactgaaagtccttcccacaggcccaagacctaattggtgtcagaagatgggagttgatttgcccagcatccactggcagataatcatttccgtctcacagtctctctcctcatcttccctgctccatcctccccctttcatcatgtcctctgatcctccctcttgccttcctcctaggctctttccccttctcctcaccccacttcctctcctccccaccccctctcctccctggtctctatcttcccttcaccccctcctgggggttttgaagtcttctattcaggtttcacttcctacaaaccgaaggtggtcctgcctaatcttaaacaacatcaacataccctccaaccttggtgggggggtggggttattttttaactaaattttagaaaagttacagatttgcaaaatgattgggagaatattagcatttccatatgccccactatgattaacatgaacatagtacatttgttgtcattaacaaatcagtatggattcattaagaacaatttcctcagtttctacttggtgagccttttccaggattctgtctcacatttaattgttccctttgacttcttgtgactttaacaaattctaaagaatttgactgcttttgttttgatctggtgacccactccaccggtttagaatgtcatctaatgggaatttcgctgcgtgtatgtagctattccagaatgaattttttctacttaattaatatcatttaagattcatctgtaacttttactttatttccttttcctttaaacgtctgaatgtttaaatgtttctctaattaatagacttcattgttcaaaactattttacatttgttttggggaggggtttgtggaggtctctctgttcatcaagcttggtgcaaagcccccttcctccttgagaacagtgttctcagtgtacagtttccatctagtctcttcccaaggaacagagacttgggtaatctgttaccatgtgtgaaccagtattaatacatgcctactagcctgacgttactgcctcattcctcccacttgttttgatgatctcaaaaattttaaggagaaccattcaaaagtattgcagggaaattatttttttttccagcatttttctaatgattttaactttgatattgggttcgggcagaagagcacagatatcaagaatatgtgttaggaatatgatcatgactgttgatgttgtctggcagaagtcataggaattttcccaccttttgactgctgtagtgttaggaaggaagtcatacttaaggaaagggaattatgtctgtcttcctgaattgatgttaatgtgagcttagggttagtgctgctatatctagttaaaatcccttgaccatttgcctccttctagcctttttcttgagtaaatttcccttttcctgagtaaattttcactttaaagtttagaaaactttccccatcacccagcagtcatttacatgactgctatttacatatacgggtataagctggggcagactcattaactggaccccctggagtccggtgatatctgcagttctttttatgtttagtgttactgattctattcatttttaaagtgcccaaggccaccacctgcttgtctttgcatacatttgtaattcatttaggtggttttgtcactgggagccttacttcttaactaatctttaaaaggcgattagcatacattaaggattagtctttgttttgtaaagttccttgggttttgacagatgcataataataccatgcatctatcttaggcacctattcattcagctagtttcagcccctaaaggttccccacgctttctcctgcaaccactgatctttattgactgcttttgcctatttcagaaagtcacgtaattgcaatcataagtatgtaagcttttaaaaatgctgctttcaggtagcaatatgcattaaggttcttccctggtttttcatggtttgttagctattctcttatcactgttccatttgtggaggcacactgttggtttaatcattcacctatttgaaagatatccttgcttgcttccaggttttgatgattatgaacaaagcttctgtaaactgctgtgttcaggtttttgtaggaacttaaattttatgattagttgtattaatatctggaagcaagattgcagaattataaaatcatgctgtgatttgtaagcaactgctagactattgtatgaagtggcctgatttgttccagtcgccatcacaatgaatgaaagttccattcctcttctttcccagcaattcatctttctactttttttgaattttagccattctcagtgttttttttaaaggctccttgattgttaaatgtgttgaacattgttttaatgctctaccactgagcttggtccccagcctgagtattggttacatatgtccattggccatctctatatcttttacctgtgcgattagatcacttacctacttttcatttttgtcattttgtagtgctaggaattaaacccatgtttttgtgtatgcattcattatcactgagctggccctatttttaaattggcttgatctaacctttttatacatgtatttcccctggtgtgctccatgatagaaaattatgttgtttagcatacatgcatttatgtatgttatgtatgtgcatttgaaaatgatgttgctagggacatggtggtacatgcctgaaattctagtagtcttgaggcagaggaagagaattgtgagttcaaaaacctaatgactgggctgcataccaagtcattgtttttggaaaacaaaacattaaccaaaattttaggaagtagtatttgcatttaatccctgaaatatactttgatgttctctattatttcattagcatcatgcctgtaatcccagcacttgtgagcctcaagctggaaggcaaattgccatgaattccaggccagcctggccttcttagtgagttcaagatcagtccaggcaatggccctctctcagaaagcaactaatgttgtagtgtcttaaaacttgatgcgaacttgcatgagaatacagtgtcctagcacccacacgatgccaatactgaccctttaattcctcacatagccatacccagcctcatatacgcttgattcctgcctccactccatgtctgtacttctctgttcatctttttcctttgccttatctgggaatatatgagaaaggcttcagcattgtgaaattgaatcattgctagatgaggcttctttaaatgaaggcctagacagaagagcccctcttatctccagacttaatgcttcacttgaggtgtcttgggtttgggcccatatatctgaccatagcagttcagattgccaggtcttatatctaagcctgctttcttcagttatggatggttctatacacaatccgctgaggagtgctttgtaaaaataacttctatgttgtctttgctaaggcctgtaggcctgcctttctgagcccattcaggctcttacccacgttcagagcatcaccgcacatccctgttcctctccccccctggcagtttgcagagcagtccctgatgaagaatgccataaagacatcagaagagtcatggattgaacagcaaatgctggaagacaagaaacgagctacagactgggaggccacaaatgaggccatagaggagcaggtggctcgagaatcttaccttcagtggctgagggatcaagagaaacaggcccgccaggtccggggacccagccaggtgggtcatggactctgtcattggcctgaccaagacctgttacttcttatcttttgacccctaattgacagggataaaataagagattttgacatctgggagaaagggaagctcccagccccatctctaactcatctcatctttagtcttggcatcgtaccttggaactctcaacacttgattttaagaagtgaaggagagccagctcttaagaaacgaagagagcagctaccactgctggtagcacaaaggaacaatggatagctacaaagagagcagctttttttggaatccctttgcatgctgcattctgtcctgaggatatagtctttccttcactatcttcagtgatcctgtctgtctgttgaggcagatacggcattggtcaggcctgtgactctggttgtacaagaccaggagaggtggaggatccagtcggttgtatttctaggatagcaagcagggaggcaggcgcctggggaatcacagagggctttagaatgactaaatggttccagaagctgaataatctgatcagcgagtatttactatacgcctgtgacaggaagcaggaggtcctattcctagtgtagcgggctacattgtgaacctagcaggccaaagtacctatccttaggctactcacagttttactaagtgaaataaaatgctcataatgaataaattagttggaggtatggtggatgaaaaatggacacttggtacaggggacaattgagactgagtggagatggtctgagttcacggtattaaacagtcgtcggggtaggcctcagcagatgaggtgggggcagcctataaaaaggggatttggtagctgggggtgagggcagtggagttggtataactcagagtctgtagctgaacagaacgagggtgagatcagggtagtggggctaggttggatggtgacttgtgaattctggagaggactttgattttgctctcaatgagacagaaaccatggggggtgggctgtaaacacaaaaaggattcgagttaggacttgacaggatcaccctgaccgattatagagcaaatctgagggagaaagcagggttgaagtatgagatcagtgaggaggaggctcccaagggagtcccagtgacaggtgagggtactacaggcgtgctatggaatcacaatctcttaaaagaataggactttgtcagatgcctgcaaggatatgaggctagttaagaatctcccagtagtccaccgtgatacattaaagctgtgctatagccaggattctggaaagggtataatcactctggcacaggagggtcatagctggtgtaggtccttatcactttttccttccctactgcagccccggaaagccagtgccacatgcagttcagccacagcagcagcctccagtggcctggaggaatggactagtcggtccccacggcaacgaagttcagcctcgtcacctgagcaccctgaactgcatgccgagctaggcattaagcccccttccccaggcactgtgttagctcttgccaaacctccttcaccctgtgcaccaggtcagtggcttgctttcagggtgcctgcttgggctaagaggctctgcttgctgggccctacctctgattgtccatctgcctcaggtacaagcagtcagttctcagcagggggtgatcgggccacctctcctcttgtgtccctctaccctgctctggagtgccgggccctcatccagcagatgtccccctctgcctttggtaagcctccttaggggatgggccagctggaagttgggagagcccggaggattttttgaagcccctggccatctctcccaaatcagaggcatgagggaaaatttcaggccccaaagattttctccacagtgggtctagtggggcttcacagagttgagggagtcaatgagtgattgggacctgaacggacttttccagagccagggatcagacagaaatcagggaaagtgacctgaggccccccatcatcgttgtcctcttctctctcctgcccagcaggtctgaatgattgggacgatgatgagatcctagcatcggtgctggcagtgtcccaacaggaatacctagacagtatgaagaaaaacaaagtgcacagagagccacccccagacaagagttgatggacacccagggactggacatcattcccgatcccccactcctgccctttgatgccacccaaacttctttggctttcttccctcttggcttccttcttttgtttcctcttttccttttttttttccacttccctctggccggcccacccatgcgctccatccatctcatccctgccaccaccattggtctctgccagctgaagtgccctattgcccccgcacagcaccatctcagcattccacaggggactctggaaagggtgcggaaggtaggcaagaggcccacagagacagaccatctggcagccaggcagccccagaagagagacattcagacaaaggaagtcttctgctcacccttccttaaagatcagataaacttgtcatcccttcccagcaatgatgacaggaaaatggaagtggcaagttttccttctagtatccgaagaatctgagccttcaatgttaaaatttttcttaattaaaatgtgctttatttcacaaaatcaacaaatcaaaaagaatattcatggcaacgttggtcctttgagggtggcatctctggtttggagctaggcaggctggccatgggacagaaagggcagaaaaaagatggatttctgctgtcttttggcccctagttccttggaagggcaaaggctatgaggtagagggaggtgacaggcattgcaggtggcagactgactttggacagtgagaccctgaccttgctgcattgctttgccttcaccaccgctagtctgtttggaaggcttgaggtggggtgtcttgggaaattagggccactacccaagatttgaatttagggagtgggagcagcctcagcagatggggcacccgtgcactgcaggtgttgacaagatccaccatctgtaatgtccttggcacaataaaaccaaatgtcagtttccctgagcaactctattctgtgtgggacacgggtggatgggcctctgggaagcacaggatttgctttgaccagaggtctgcttgttctccagtaggtgctctctgtaagctggggttcatatttgatcttctgtttattaaattaacttcttgtcttgagactgatggcagagaatctctagagcccaggtgggttaagactaacctaacccacataaccaagattgtttcttaaaagaacaaaaccaacaacaactctacaactggtcgtggtcatgcctttgatcccagcactgaggagggcagaggcagaggtggatcttttgagttgcaggccagctgggctatacagcaagacgcttttattaaaaatcataaacttcagaaccaaatcgactgaaactgaagtccctactcccacctaccatatttgcattagggagcctagggctaatttaaaggactgtatgagccagaggccaagactggtgtctgaatttctactctcaaccttaatgctcattcattcttgtgataatctgatgaaataagcaatcactaatgagttcagtgaccagaggtggcccttgcccaactgggttttaaacgttggaggatgaaatggctaaatcctttttttgttgtttgttcctcaggtctgttgacacctctgtccatacccctgctagggtttgtaaagcccagctagagaaggctggctggccctcaggtttcctcagagcagtcttctcccactccccaatgcctcagtgaggtcctttcagaagaaggctgtgtagggtggccctacggtgagggtatggcttgcccagtgggtggctacaggatatctgaaatacgtggtcaagcatgagcacgccaagagggttgattcatttcaaatctacctgccttgtctcactgtgtggctttgggctctctttgactttaaagtgtcccatctgcaactacaggggtcattaatgtctgctacctcatgctctctgatttgtgagtattgacagagaatgtgtatggtcaataatgtactactgggaacagtacctggtacactcttagagcacaaatgttggggttcttaccagactttaggggtgggggtattaccgtattttgtaagtttgtaccatttggcctcagcctgactcttgctactcttggcttttacttgcaatttgccctaaccctatcttcagcaagacaaagggatcacctgaaaaaaccctgtgtgatcccattggcactctcccttctgtctacgactattccgaagaactgtactataaataaacttctgggctggggctgtgatgcttactta

SEQ ID NO: 6 - DNA, 32680 bp, mus musculus
ggccagtccggaacgtgaagaggtcggagcgggctacaacagtgaagacgagtatgaagctgccgcagcgcgaatcgaggccatggatcccgccactgtagaacaggtaagggctggaaggtgaggggctgttgggcagaaacagcgagtgagtctaccaggctgagaaggagcgcaagaaaatgtttgagattggtccaagaaacccaggtcttgatgctgggcttgacattctttcctggtggtggaggcatggcttcccccgaggacttgataggggctctaagttaagtaagttaaagtactcttttgcagtcctgagatcttctctaagtgactggcattgggaattccccaggagtcgcagatacgatggagcccttccttagaggaagctctcaggcctctctaagggactttggttcagtaactttttcctttaggacaagtgtgagattccctcccgcaaagaactcgaattaaggtggtgtcctcagagaaatagtctaagcatacccaagaaacttaaacccttgatgtaggaaggacctctctcttttgctgagtctgctcaccagccatgtggcctcctcaggagtcctaagcctgtatttggggacctagacttgcttgtagaattgaaggtttagagtatacccacacaccttttagatagtgatttccaaagtatccctccagtgttgtgaaacgtctttctggaagataaaattctcagtggcttagggacaaaggccaaaaccagtacctagaagcagaactgtggctcacagtcggtgttgacgtaaagacctctttgcttatggcccggggtttaattacagatgttccaggcaagaggacttcttcagaacacagtttcagtcatgggctggtgtctatgctcttgtgtgtgtgtgtgtgtgtgtgtgtgtgtgtgtgtgttcatatatttccctaaggatggatggatggatatatatatatatatatatatgtgtgtgtgtgtgtgtgtgtgtgtgtatatatatatatatatgtcgtacctattgaaatttacttcagggattcaacatctcagttctccctttctgtgcatctggaattctctgatacccaaggggctgagctgttaatctcataggaaaagagctctcaagtcactagacccagattaagttccttggaaaagaaaacttgagagtctctctcaggaagcgctccatctcatgtggagaactctcacctattgactttgcggatggggtctagagtctggcctggaaacattgcgtcctgtccaatccctgcctcagaaactccagcctcaggacatgggcagtttggagacccagaggccatgtcagatacctccctctaaatctgccttcaagggcctgagactctgttctgtgaaggacataataaggctttctttaggaacaggaaccccatccttgccactgaagactgtttgtagaggtaatgcctgaagttcttcctcctgtaccttgagatgctcctcacacccagtctgacatttcccaccaggactgggtggggcatggttataggtttcctgaggaatgaggaaattctcaacatcacatcagttgtgtgaggaattgttctacaccttaggatctgaggcctgaatcttttggggctgtcacctaagatgacctaagtatcctcttcataggaggcttttaggaacataagtctcttttggggtttatttgaacctgggaatgatacagttttgaggaaattagttttaggcctctttccatcttcctcaggaaaaagagattcctttgccttggggactgagacctgagtccttgcttaggcatgcagctctcctcccaccacaccaggtgattctttctcaccagggagaggacatgaagtcatcttcaatatggccagaggcttccttctttggacagagcacctgggtgttctggtttcttcttaccctcaggtcagagccaagaaggctgtcaggtcttgggaccagaagcctgaggcatcccttggactggtagaggttctgaccctattttcattgtttctcacttctggaaatttctcttacattccatttccttttggttgaaaaatttgttttacaggggtcagagtgtggtctcacatccactgttgttcttcttttcctgtcatttctggcggaacaatcatctagactcatctagagatgtcaggttcaggaggttttgttgttgttttgagacagggtttctctgtatagccctggctgtcctggaactcactctgtagaccaggctggcctcaaactcagaaattcgcttgcctctgcctccggagtgctgggattaaagtgtgtgccaccacttcctgacttccaggagttgtttgtttttcttcaaaacaagatttctctatgtagtatttttctggaacttgctctgtagaccaggctggcctttaacttggctatccaagtgctgggattacaggtgtgtgcacaaccactgcctgactgtgtgcaggagttacagatccctgctttttgtaaagtctctttacccttacagaggtatgtatcccttatccaggggaaagagaaggtatgttgttggagatgcaaaaggccacattcttataccccttgcagttccgcccttatatttatcttcataagaacttagaaataagaactgacggactcatgaaacctgctcttccctgtgatgggagaggctttctgttctatgggcacaaagggaagaaggagctactcctagtctccctgactcgcctggcccagctttgagcctcttgaggatgagaagaaggggtattggtcctgccactccaatcttggttcatagctgttgcagatgctcataacatagaggctgtttcagtactgacagaggggattagtctgaatggtaaatctggttccagttctgcgaatatgtactcctgtttcctttaggattctccgagtaccttgggttggagtcctggggaaatgatgtcatagggtgccttttgtcagagcctagccactgaaaacaatggcttataagcatcctaagccaggagaactcagagatcttggagtaaaggacaaacatgctgagatagtggaaaatgctaggtttagcagtacagtcagtgtgtctggttctacctctcagtcagccacattctgcagagtgaactagtacagcttctgttctctgcacctgatttactttcactaatgtgttggtgtgttgcagtcaactttggctttaagggatttcaaagccccctattcctgcactagatagtgaatagtgggtatcttttgaagaggagctgggttccttctctttccactttgcttcttttccagtcatagaagtttgctgggcaggtcaaagccttttttgtataagggttaaggatgatgtgtggcagtgttgtagccagctatcaagttccacagttacatgtggaaagaatttgggatttggagctggacaggctggagttcaaactccagtgttaactgttgaactgttttaagattgtagaactctcatttagggcaaaattcatgagggttactagagtgtaaacatctagccttgtccaccttggctagttcttttcactcaggatgagcaattggccccaggataatcttttctcctcaagaggctttgcctatccatggtactcatctcttggcatctagaagcctgcccatctggaattgggtggttggctgcatttgagtgcttgtttgtttgtttgtttgtttgtttttttgagacagggtttctctgtgtagccctggctgtggctgtcctggaactcactttatagaccaggctggcctcgaactcagaaattcgagttctgcctctgcctcctgagtgcttaaaggcgtgtgattaaaggcgtgcaccaacacgcctttgcgagtgctttttctatactaaacttttgtgtggtctttggatagttcccttttccaggtcttttgttttgggggtttgtttatttttcaagacagggtttcctctgtagctctggctgtcctggaacttactctgtagaccaactggcttcagaactcagaggtctgacctgcctctctctgactgttgagttccagggttaaagctgtgtgccaccatacctcacactacttgggtcttggtttttctacctattaaatgggtagttgtgaggacagtggttggactcattgcagtgaagaaaggtgtaatctcatctttaattctctgttttacactcttctcaacctttattggattttatgtgggaccccttggctctggggatggctcagaatttctctatgtaatggtcctggtggtccttgaatttactctgtagaccagactggcctttgaactcagagaactggctgcctcttcctcctgaatgctgtaattaaggcctgcgccaccactgaccacctagaatgttatcttttagaagatgtgatgtgatgtttgcacttcttgggagtgcttataagttcttcagtgtttttgcatttgtttactgtgctgaaactagggcgctcaattttctggcatgaaggctcatgagtatgatcccatcatttgggaggttgaggcaagaggattgccaagagtttgaggccagcctgagctatggtgttgagaccctgtctaaaataaccaaaataaaaagtgtacaattcagtggctttcaaaacagccatagaattgtacttctgtcaccagttttatttttttatttatttttatttattttttttggtttttcgagacagggtttctctgtgtagtcctggctgtcctggactcgctctgtagaccaggctggcctcgaactcagaaatccacctgcctctgcctcccaagtgctgggattaaaggcgtgcgccaccacgccctgtcaccagttttaaaatgtttttaatattatagacccttttatagcttttaatgccccccattccttcctccctttccagctcctggcaacctattaatttgtctggattgaactattttgaaacaagtagaatcatacactaacgtcatcctttgtaactttgtctcttttggatagcatgtgttcagagcacatcatggcatagcatttacctatactttgtttttattgcctagtaataaaatcttgggttttttaatcctctggtggcccagaaatagttttttttggggggtgggggtcttctctttcttctattctggtaggcttgtgtgggtccttagagaagcagtatgtctgtttctcattggatggattgcctgtgtttattatccctggagcagagccagtgttcctgggtgttttgggtgagggggtggtgttggctccaggtttgctgggacaaggctgtgaggcctagaatactaaacacctcttggccatgggctctgagaagacatctgtccaatgccgttgccatccttccctgtacccttccccctttattggcagttcttttacccacaggctgggtcagcaacttcccaggctgagagggaggattctgggcccctactgccttttaattctaaccctctctcgggaggtggatcactcagaatggaagccttgctgtgtatagtctcacagccacaaagccctagagctcacaccaaaggagtactacaaggggggatatattaatttcctgtggttgttgtgacaaataaccatggactgtttggcttagaataacagataaattctgtttcagttttggtggtcaaatgttcaaaatgggtttcacttggccaaaatcaaggtgttggtgtttactgaacatcctccagcaagtctgggaaagagtctagactttctccctttctgatggccgcatcacttcagtttccacctctttctctggatgcatgtgtatgttttccttttctgtatgaaatctcctgtaaatcttctccctcttctcactctgtacaggtgtagcactttgcttttgacaaacgcaacgtaaggaagagaagagtttactgttacttacagctggaggggatacagtccagcctcatatggggaaggctgctggcaggagtgtaaggcagccgctcatatgtctgcagccaggaagcagagagatggatgctggtggtacacggtctacttttctccttaagcacaggacccctcaagcccatggggtggtgtcatgtttagggtgggccttcactcctccgttaatgctcttgaaattccctatagaagcacaccaagatgtatgtttcttaggtgatttcaaatccatttgagttgataatgagggttaactatcacaaatctacccattctcaactcctaagccttactacctttaaatatcaatattttactcctgttcctccacatttgatagcaatctcaaggtagataacacatttagttcattgtaagagtagtcaaattcttagcagttctaacattgttcaaaaatcttaagttcaaggcctggtgaggtgtggtgtataccattaataatagcacctgggaggtagaggcaggtagatctaagtagttctaggccagccaaagttgcatagtgagacttaattgtgagtctctgtaaaattaacaaacaagttacattatctaatatacaagggcactgagcaaacattcccattccagaagagaggagtgaagatattagcaaagagattagatgaaagcaagactgaaacctatcagggaatctagttcatgcccaacacctgggctttttatggcatcacctgtgttccaacaagcttgggtagttgtgctctcatcagctctgatgctttgagcatatgtagcctctgtcttgagtcagcttcactaagttcctaaaacagaggctctcaacctgggcactgaaccctttcataggatcacattggaaaacacagatatttacatgatgattcattagagtagcaaaactacacttaagaaataacactgaaaatagttttttctttccattttttattaggtatttagctcatttacatttccaatgctataccaaaagtcccccatacccacccacccccactcccctacccacccactccccctttttggccctggcgttcccctgtactggggcatataaagtttgcgtgtccaatgggcctctttccagtgatggttatggttggggtcaccacaacgtgaggagctgtattaaagggtcgtagcattaggaagattaagaaccgctgccctaaagcttttcttgacagatctttctggcatctctggtacccttgaggtcacctttgcaaaaagcattacctttatagcttcataaaatggtctcttagggtcttagtgcaggcaatctggccctgctaccttggtgcaagactgtgtgatcaccttgttgaattctggatgtctgaaaacgcacatgatgtggatgatgtcaagttatgctaccagctcaagatggaacctagttgtattagagcacaggcgctgtggcctttctctgccttctagagcatttcctgcagtttactctagagtctctgctttttaggcattatgttcttcatgtttccggttttatagcctggagcctttactgggtaggtaggctcttatccccaaggcagtatatataccatatagagtttagggtttttcttaattgcacagatttcattatacttctagacactttgtccaaaccaaactttttaaggcagtcaagctcctttcctcaccaaactgcacatttctagccctttatttatttatttatttatttatttatttattgagttaggggctcatgtaggtcattgtggcctcaaatttggtaatgtaactcaggctgactttcctttcctcttgtctctacctgccaaatgttacgactataaacataagcacaatatccagttaaaccttgtttatgcttttttttcctccccaaactgtacattttccacatctagtatggtttgcatgtcctcagtggattaatgcagtgagtagtaaccacaagtagaacgaaagcctagaggttatgctgactaacaatttgacaagcaatttagtccattacttttgcatttagccttgctcaaatgatcaggtgggcataatgattgccagaattaaaaaaaaaaaaatggccagccgggcgtgatggcgcatgcctttaatcccagcacttgggaggcagagagaggcaggaggatttctgagttcgaggccagcctggtctacaaagtgagttccaggacagccagggctatacagagaaaccctgtcttgaaaaaaaaaaaaaaagaggaagaaaaacaaaaacaaatggcctctagtcctttgacatatctgagatctctttaaccaggacttaattgttcgcatttctgtattctgttagtcatcattcctactagaatagactgttaagctctactttggcactctaggtcttctgtagcccacagaactaaaccttttaagattcttcctgcaaccacctctaaatgcctacaaattgtatggtcatgtatacacagcagtgaccccacttctgggtactaactttatctcttttctcttgttgctgtaacagaatacctgacaaaagcaacttaagagatttatttgaggggtacagccccatcacagtgggcaaggcatggcagtgggaacgtaagatagcctttcatgttgcatcagggaagaagtgaagaatactgatgctcaacttcctctttccttttcccgttttttattcagcccgagaccccagcctatacgatggtgtcatgtacattcaggtaatgagttagacttacctggcaactccctgaagaaattcccatctagagttgtcttttaagtgattccaagtctagtcaagttaaaaataaacttgctgggcatggtggcgcacgcctttaatcccagcacttgggaggcagaggcaggctgatctctgacttcgaggccagcctggtctacagagtgagttccaggacagccagggctacacagagaaaccctgtctcgtaacacacccgcccccaaaaattaacatccacacctgagattgtgcctagactccagtgttccagtcacttctgcaaaacccttttaaaaacacatacaggttttaggcattaggtctgatattttcaggtggacattattcagtctaatccagatcgggagggaatgggaactcattaagagatgtcctgctgctgggttaggtatatgcactggtcttaccatgttttccaccagccggaagtagttggcttgatagcactttggaaagatgtagttacaaactgataaggtactcctttaatcccagcactctcggcaggcagatctctagtagtttgaggccagcctggtctatatagtgagttcaaagacagccagggctacatagaccttgtctcatctcctccccttcactctactggacaaagtactgcctagtatcccacgtactaggaagtgtatattcccatttcacagattggaacactatggctcaaagcagttcatcacttggcttttatttggtagaactgcattgaaacctaaatcagtggttccatagcctattctaacttctcttaggcttttaggtgtttttgtttgtttgtttgtttttggtttttcaagatagggtttctctgtatagccctggctgtcctggaactcactctgtagaccaggctggcctcgaactcagaaattcaagttttgcctctgcctccggagtgttgggattaaaggcgtgcaccaccaccgcctggtggcttttacgttgttaaaccagcttttaaacagggtcctgtcttaactcctgggatactatggtatcagagagctttgtctagtccttttgctaaggcttagagatggggagagagactctgctccaggattggtcttgaacatgtaaagttcaggattgagacttgatcttctcgggtcaggacaccaatacagaatacatctacagattgttggactgttctccagccttctagcacttcctaaacatcttcttcccaaagtgagagaggaagaaagctagagctctaggttttcaaactgtgatacgaaggccagtggatgcttagtgatacatcctctagatgcaggcctagatgccatagttatcgtaggacccacactctatttgtgcaaaaggtctgtctagtcagacttcctttatttttaggcacatcagaactcctccaggacttgctaccaggcatgtgtcaccgctcatggtacatcatgtgctgtgtctctactactaggctttgctactaccctgactgcagctcctttctgcctttgtaaagtgtgggtaatgctgcttcctgccacttgggttgcagtgaggacaatgaaatgaggtcacttttgtatctggcacctggcataggacaaagcactcagctaatatgagttcatcctttctggcttttccctgcttagctgcctagttttgcttgcgtctttgctctcctatacacattgccaggctttgagcatctctggtgcttggtgacagaaatgactttatttcttatccacttatcaagcaagttttgatcctttgctcaagtgccagctttaatgtcagggtaaggtctcttcctgcttcacaaaagcaagggagcattcatttgttttgcagccccactcaaactgtacgtcatcactgcgtatttctgtacccttcccttcaaagtttaccagggtagagacggaagtctgattcatttttctgtcttcattgtccatcccagaatgactcctattttgtgagatgagaactaggccccctctttttctctttgtatcccttctatcttcctcatctaccttggagaatgctgttctcccccctttaactctccctattttaaggtatggggctatggttaaaagtttcttttctgaggcagaggcaggcggatttctgagttggaggccagcctggtctacaaagtaagttccaggacagccagggctatacagagaaaccctgtctcggaaaaccaaaaaaaaaaaaaaaaaaaaaagtttcttttctgggcaccccttgacaggctaggccttgtgagtcttggagatggctaaaaatgtgggcaaacgatgaacttctatgacagtgcacagcctccagggcaggatgagcacccgtgctgctggaaggttgtgcacagatgggtttgtgctacccagggaagcacattaaaggcttacaggtatatttgtcatctctgcaaatgacgcgacaccttcctgatgtagtggccccagagggtggggctggctaggttttcctttgtctatgttcatcctctttctagacactcacctaggacttcttgagtggacatcatctctttttttgggggggggagctggcctcatctctgccccccaccagtgctggaattaaaagcatgccctaccatgccaggtttgtatctctctctctctctctctctctctctctctctctctcacacacacacacacacacacacacaaagatttatttattcatttaatgtatatgagtacactgttgctgtcttcagacacaccagcagagagcatcagatcccattacagatggttgtgagccaccatgttgttgctgggagttgaactcgggacctctggaagagcagtcagcagtctcaaccactgagccatctctccagcccttgtacatcgctttttgttggtcttttcctcttttatgtttagtgaccacctcaccagtataggctattacagagccaacctcctgctctcttggcagatgtgttgagaagaccaaatgcttctcagtttgtaactggtatgagtttaggcagcttccctacaaccagaaaacactgcagtgatggagctggctgggtttagacctccggacactatgcctactctggtttttctacccatttcctgtagtggggtacaaaaatggccctttgtgatcaactttagcagggagcctataagttcctaggaacagggcttcctattttgtagtgcagctgtgttgctaggtcaagctgtctgcttctggcagccagcagatggcgtgagaggcctgagaaagatctgcttctgcctccttttgaaatggaaatgttttaagttgtcaaggtcattattattattattttaatctagaagtatgagtttgtatatgttgattaaccaaacactttggaatcaaatgtgatttgaattttaggaactactcagaatttcaatttcctggtgtttatactttatattatataatactttaacaggctgaagaagcacctcatgatcaagtgcctaaatgtttctgtgggaaaatgtttgagccttcaccctcaagtagggtatttggtatattctgtttaggttatgatgggacatgaattagatgaagactttgagttttctgtatttctttctttctttctttttttctttattctttttttttggggggggttgtttgtttgttttttgagacagggtttctctttatagccctggctgtcctggaactcactttgtaaaccaggctggcctcgaactcagaaatcctcctgcctctgcctcccaagtgctgggattaaaggcgtgcgccaccacgtcgggctttgtattttttcaggtcttttgatgttcaaagcatttagagatttggaatttcagataattgtatatctttatcttctgtatgtgagtataccattgctgtcttcagacgcatcagaagagggcatctgatcccattacagatggttgtgagccaccatgaggttgctgggaattgaactcaggacctctggaagagcagtcagggcttttgactgctgagccatctctgtagcccctagggattatatatatatttgtttgttttttgagacagggtttatctgtatagctgtagctgtcctggaactcactctgtagaccaggctagcctcgaactcagaaatccacctgcctctgcctctcaagtgctgggattaaaggtgtgtgccaccattgcccggctagggattatattttattgtctacttttttttcaattttgtgatatatatatatatatatatatatatatcatacatatacacacatatatacatatacacatacatatttatgtttatatttatttatttaatttatatatgtgagtacattgttgaactcaggacctttggaagaacagtcagtgctctgaagcactgaaccatctctccagcccgggaaactttttactagaacaccacattctccatctaggaacttatgaggtctaggtccctggctgcctgggccaggtcttgcaagattgagagcagggctctgaaagtagatgaagtttctgttttcagggaatctggggcctccctgggattgtcttgtccttgtccatagacttaagtctcctgctttgtagtcacagagtagtcaagaagggctgtgaactttccagtatccttttggccaatcacctggtcttctcaggaacttgaaggcagcacctggagaagggtatgggcttccctgttgctgatcttcctactttttcctccagcaggaacactggtttgaaaaggccttgcgggacaagaaaggcttcatcatcaagcagatgaaggaggacggtgcctgtctatttcgggctgtaggtgagtctctatcttggttttgagggctgaggggcttaaggcttctgagctgtgtcctagtagtcagtagcagtccttgagacaggattgtggcagaggtaactgcttgatattttaggataaacaggcgcggagctcttgttaacgtttggcctctggtgttggattgtgttaaatgagtaatgataacagcaattgtagtgataaagggacaccactgttgacatactgctctgccaagattccaggaaacccacttattctgtcagttaggtaggtggtcggttggttggttagttttcaagtcagtgttttctctgtgtagccctccctgtcctggaatttgctctgtagaccaggctggcctggaactctgagatctgcctgcctgtgccttctgagtgctgggattaaaggtgtgcaccaccacctggtgtggaaacccttttattaaccccaagtccaggtgaacgtgagactgaaaaatgtctcagaagtggggagtgactagtctaaggttatacaaaagtatgtagagtcaggattttgtgtgtggattaactgtatcatattgtcactttggtgtttctctggtatcgtatattgcggatggtgcatatttagtgcctgtgtttatgcttgtgtatataataaaattgggcatggtgaagcagtttttctcccagcattcaggaggcaaaagcagggtggatctctttgagttcaaggacagtctggtctacattgcaagttctatgacagccaaagcttatatttgtcttgtctaaaaaagaaaaatctagatctttacaaatttctatattagagttttttgtcttttaacttgcacaaaagtagagaaaacagtgaaccctttcagatttagtgacgtagcttcacaaagtgattaacacatggatagccttactttatgaactatatcgtattatcatttcattcataaatatttctctatgcttctttttaaagatttatttatttattttatgtatatgagtacactgtagctgtacagatggttgtgagccttcatgtggttgttgggaattgaatttaggacctctgcttgctctggtcaacccccgtcactcaggttgaccctgctcagtcctactagctctggcccaaagatttatttatcattataaaaaagtacactgtagctgtcttcagatgcaccagaagagggtgtcaggtctcattatgggtggttgtgagccaccatgtggttgctgggatttgaactcagaaagagcagtcagtgctcttacccactgaaccatcttgccagccccttctctgtttctttcttttttctttttcttttatttttttccgagacagggtttctctgtatagccctggctgtcctggaactcactttgtagaccaggctggccttgaactcagaaatctgcctgcctctgcctcccaagtgctaggattaaagacgtgcgccaccactgcccggccttctctgtgcttctttaacagatacatctatattgttttctcttgttttcatataagtaaagtcctgttgtcatacctaaaaaattttttttctttcctgagacagagtcttgttctctagcccaggctagcttggaacttggaataatccttcttcagcctcttttttttttttttttaaagatttgtttctttattatatgtaagtacacagtagctgtcttcagacacaccagaagagggagtcagatcttgttacggatggttgtgagccaccatgtggttgctgggatttgaactcaggacctttggaagaacagtcggtgctcttaacctctgagccatctcaccagcccctttttcagcctcttaagagctgaaattatagatgtaagtcggtatgtacaactaagaattggtaaattttttttgagactctggtcgtcctggctgttctggaactttctgtgtaaactaggttggccttaaattctcagaggtcacctgccttagcctctcaattgctggggttaaagtcatatgctactgtgccagcttagaattagtaatttcttgatattgtctgttaagcctgagctagatctttgaccaaacaaggagttttgaaatcccatactgacatgaagggatcctagattgtggcctgttctctcctcccacaccagtggttctgctatcttcgaaggaaaattgttccctgacatttttgaactgggaatcagaagatgtggctcttaggctggctgtctccccatcggtgaaatgggtgctccctgggctccatcagttctttctaggtctgctcttggtttctcggtgatccgcatgtttgttataagctgtttggtccttagcaagtgtctcttctttcttaatcctctttcattagttgaagagtgggttaaaggactcccctgtggtgatggttttgatatggtttgatttactttggtaaatctctttaatgcatacttggtcattatggaacagtagcactagtaaagtctggctactcttctcagttgtttcccagactcagagctagaaatatttgtggaatgggtgggacaaaggaccacaagcagaagctattcaggtaatgatttctgttgctttggagaaaaatcccaacccttctagccatctggctcagttatgttctccctgggaaatttactagagaaagacctgagtttggaaatatcttagggataaaaggaaagcagagaatgaacaggtgaggatctattagtttctgggttccatattaacctcgggatggatgttagaagaagcaagattgcttttggacatctgggctcagatgttctctgaggcagcttggagcccttgagcacctggtgtgaatagttatccacatcaagagcaggtttgtatgcgtatgtctgtttagttacccccccccccccatcagggccttccagtaaggggcccaagcatacaggaagagctgaccacagcagctttaaggcctttccttatcagcactatggctacacatttcccctgactgggctgccctcagcttttctctgtaaaacctcaagtcctatgggctctcccctgaagtacgtggcccctggtctctaggcctcctctagaggtttccctggtgcagagtacacaacatgtgctggacaaggggactttgtccccaggctttccgctgtccccctgtttctagcctagcttatacagggacagatggccatcacctcactctttctacaaaggcctgcaagcattaactttttaccatgtattgactaatggagggaacatgtaactgagagctggaattgagtgagttgcacacatacattacactttgctgtttctctaaccctgcttgctgtgtgctacacatccagctgggcgctttaggccttcctgagacttttggatcattatgccatgaaatagaagctctgaaaagaagggcagaaagtatagctcagtactagctcttgtctagcatttgggggaccctggatttgatgctcagcattgccaaggattgaaggagaagtgacaatggtagagtttgcacagaggatgaccctaggagcccctagctccgtggtttttaacctgtggcttgcaaccccctttggggtcatataaccatttttgcctaagaccattggaaaaacgatatttacaagtagtaaatgcaaaattacagttgtgtagtagcacacgtagtttgtttgtttgtttgtttttttggtttttcgggacagggtttctctgtgtagtcctggctgtcctggaactcactctgtagaccaggctggcctcaaactcagaaatccgcctgcctctgcctcccaagtgctgggattaaaggcgtgcaccactactgctcggctctttgtccattctttgacctctctagattttccttctacctagaagcatttattcttccattgttgagggtccagtgcaggtggttttctgtcctttgttttgcctctgacatccagagagcacttttgaatcagtatcaattgcttgtacccatttctccctagtacctcctcctagagatttatgagcatcagtgatctaccaggtggaggcaggtatcctgtgacccacccagtccctgctgtgctctgataaccttctagaaacatgagcctccctccctccctttccctccatttgactttgactaggcagaagtgtctagctctggccatggcaatggtgctggtctctggaccaagtagaagccacatagttgtgtctgcatggacttcagaagagagtagcgtagctagggctctgttatagcccagaagtattatccaggcccacttctggttgagatagggtctcactctaggaactttttaggttagaccaggtgcccttgtaccttgagcttgtgatagtcgtcatatcttgaccttctgtgtattggggttacagacatattgctaccatgctttcttgtttgacagattttctttgtgacagggtttctttagaactctctgtagaatgtggaccgtagaacttaatctgtagatgaggctagaatctgtagatgaggctagaatctgtagatgaggctagcctccaactcagagatattcctgcctctgcctcccgaatgctgggattagaggtgtgcatcactggccagccttagatttgcgagctttataaaatgagaaactgagaccttaagagaaagccaggaccttgtcttgtctaagtccaccagccaatgtaagaacaacagtgtttgaaattgtattaagacatagtggattcctatgttttatttcttgtacacctgccacctttgatatctctttgctcagaatcatttgtgttttcccatttttgccaggggaatcctcaaacagaaaaacttatatctcagattggtaggagggtggggcaggggatctcccagaggtctgaggtgatatatcttgcccatagtctgtacccagtgggacagttgggtgtgtataccctgtcataccatggctacttgataggtgggtagaaccttttcctggatgctgcttcctcaatgaggccagggtttccacgagagcatgagttcagtggagagcagactaggttgctgttgcccttgtagctctgtccatctaacccacatttgtgtggtttgggtttaggttctccacgaaagccaaacttcctttctttattaaacatgtatgtgcgtgcatgcataccatagtatgtgtatatggaggtcagagaaaaactcaaagagtctgttctctccttcctccttccaccctgtaggttctagggatggaactctggttgtcagtctcggcagcaggtgcctttacctcttgagccatctgcatagcccgaagtttgcctttctgtctttagcagaacttaatggtaggtagcaacctgaggagtagatggttctcaggtccctccaaagcaagagaagacttttcatttatagcactttagaaataatgtgggcttgagccggtaaagggaaataaatggttcagccagtaaaggtgcttgttgctgagcctggcaacctgagttcaatccttaggactcaagtgatgagaggaaaaaacagactctttcttacaggttctcttctgacctatacatgtgctgggacatacagatgcacaaaatagataaatgtaataataaaatggtagaaaagaaaagtggagctggagagagctcagtagttaagagtacttgctgctcttccttccagaggactctaagttgggttcccaggactcacagtggcgcacaactttccttaatgctagttccagagggtccactgccctctcctgtttgtgggcatcaggtatgcgcgcagcacacatgtacatgtgacaaaactagtatacatacagcaaaataatctttgtaggggggaaggaggaaaagtaatctctatcttacttcttgtaagtgtggacaaatgcaggttacattttagggagcctgaagaaggaggacttccccatacagcagaggagaaagatgaaacaaatttgctagaagtgttggtcattcctctcccttacaaaggctgggaaggaagtagtataagttcctaggtatgcacagcttcttgtctagtgttaagcctttcttgattggtgacaaaggcatgtactcactgtatgctgtggttctgtgttgtggaatgggtcatgtgggtatttagtctgtttcagtcttttgtagaccctgctgactgcatgtgggcacatatgtgcacttccttgtatctttgtatgttcacagaaagcaaagtagcgtggtccatggggaggaaggttgatgttgaatctagggaagtgtgcagccagatacttgttaattctatattcagtcccaggcctttttttgtttgtttttttttttttgtttttccgagacagggtttctctgtgtagccctgactgtcctggaactcactgtgtagaccaggctggcctcaaactcagaaatctgcctgcccctgcctcccaagtgctgggattaaaggcgtgcaccaccaccgcccggcctgtcccaagccttttccttgttccaaccaatttcttgtggattagcaaggaaactgaagtacagaggatcaggcccagccctaagagaaggctgtgagggatggggtagggaatgtcacttggggccacctattgactcctttcttcctttagagctaaatacgtgctaagtatgtgatcctgagccagccgtgatacttctgtatcaatgccacccccatccctagcacagataactttgtcctttttgattttgagtgaagatcaaatgagttgttttaaaagtctgtagtaaaactaatgatagtaatgtgctgagaatttgtgagccctacttagaaagagaacagaggtggactatagctgggggaatcccctcccagctggaccctggaaaaaagcaggtgcatatgggcaagtgcagtgttagcaagaggaggagtttcagtttctttcaaaacattttctctgaattccccctgtatttgtgggtccagtgggccactctttctcccaccttgtacccctccccaggaagtgcatcctggcccccacatgctaacctgggagggctaggaaaattagaaaacctagttgatattaagtaatgatatgcttggggctggtgagatggctcagcagttaagagcactgactgctcttccaaaggtcctgagttcaaataccagcaaccacatggtgactcacaaccatccgtaacgaaatctgacgccctcttctggagtgtctgaagacagctacagtgtacttacatataatagatagataaataaatatatatatatttttaaaagttataatatgctttacctattaaagggttttttttcctctcttggtggggaagtactgtttgtatttccttgatctagagatcatcatcatcatcatcattattattattattattattattattattgatttctctgtgagccctagatgtcttggaactcactctatagaccaccctggccctgaactcacagagatcacttttgccacccaagtgctgggattaaaggtgtataccaccaccaactggctgcgatccgtattttacttcgtgttaatgattaagctataagctgggtatggcacacctgtaaccccacacttgagagaggaaaggaggaggattgttgtgaggttgatgccagcttgggctacagatcgagttctattccagccaagtgtctcaaactaagaaaataaaagtaaaaaattaaggaacagcttataatgagtcaataggtggtcccaagtgacatttccccatccaaggtgttttctaatagaatctgggatgagcctataagtattataacttgcctgtacccgaggacccaacataaaaagtcagtattattactttgataggaatttggttgttagagttttgaacaaaggcgcaaaaggtcggcgtttggaccattgcattcttcaaaaagaactagtagggcagggcatggtggcactcgcctttaatcccagcactcgggaggcagaggcaggtggatttctgagttcgaggccagcctggtctacagagtgagttccaggacagccagggctacgcagagaaaccctgtctcgaaaaaaacaaaaacaaacaaacaaaaaagaactagtagtgcttgtaataggaggggtagacctcctttttgcttttggggcttttctctgggggaggaagtgcaacagaaatgaggaagggcttaagaagcaattctctcagcactctagctgactgctgggtcgctagcagtatgataggagttgctgtcctcatgacaaatggggtgtctggttttgtttgttttgttgttttgagacagggtctctatatagctctagctgttcctgtactggaactctatgtagactaggctagccttgaactcacagaaagcctctgccttctgagtgcagggaatatgtgccagcattcctggcctggagtgcctggttttgactactgtttaggctttaggtacttgacagatgtcttgtagtcccatccccatactgaagattgaacctagcatgccatattctcccatagaaatatatttctatctctcctctctagtctttaccattttaagtggagaagagttactgtccccacttatggatgagggcatttcaactcagatgaaaggccttgtccagtgccgcacagctaagaggtggcatggactttcaccagaccccaaggcaagataaaggattcccaaatctggcatctagctctgacaaatagaaatcccaggcctctaagttaccttctgtaggagatccatgtttcccattaatttggcccagctcactgagcctgatagcccaccccatttaaccctttcattcccatcttagttcctgtttatggcagctgcagactgcactgcctccaaactgagcctacaaaaatagctcctctagcaccctaggcagccacagcagcctctgtggtcctggcttctaagaaaggcagcagcagccccccaccccacccccagcttgtatgcaggacatgtgatttactggaagtacttaggggggagtgtggccacagaagccacatccttgtttacatcggtgaaggggctaccccttcctgccttcacagccccttctccacccctcaggtatcgtcacctctgggatgacttgaggctggagctacccactttctctctcagtgcagcctttgattcctgtattatacagaaccctcatggagggaatcactgggcagtgaagacccctggcaagtcttcagagaaatagactggcaggcttgcttggtgggcacgttcccattcctagcattccctgcccctgtgccctagggggatcccattagaactgtgtatctctggggaaacacagggaaattcccttttcaaggcagccagtgaaagtcaggtttgcttaatcttcaagcccacattaattaagaaactcttgcttcctgtgcctcagcatatatgactgctcagcaaactgtactcaatttcttttactatatcaggtcctgagctgccggtgggcttaggtgtgagctgccccttatcttcagtggaggctttgtgtaatcagtctgtgtacacctttgagttggatggtagaggagttctaccactttacacagactgtccacattgtccacaagaaacctgtcaggtcacacctgtttgttttccacttcacagaggaggcataggaaactcagagagtcatttgtctctggctgtttacctcactagttactatttggcagaacttaaagtgttttccttcccttcagtttttaaaattctaatcatagccatgtgtgttgacgcacctctttaatcccagcactaggaggcagagactggtaggtagatctctggagttcaatgtcagcctggtctacagaatgagcttcaggatagccagggctactctgggaaagaaagagtgggggccaggaaggagagaggaaaggaaaggaaagaaaagattctaatcatggtggtagcctttaatcccatcactaagaaggcagaggctggcagaactctgtgagcttgaggccatcctagtctatgtatcaagtagcagagcagtcagagctatagactgagaccctatctcaaaaaaaaaaaagattctaatcttttttgtggtggtggtaggtattgaatgtagcgtttggtttggcttgaaatggagttttactagatctcaggtgatctaggctttgaacttggcaattctcttgactcagccttgattataggtatatactgctctcctttgtttcccccactgagacagggtttctgtgtttatcgctggctgtcctggagctcactctgtagaccaggctggcctcgagtcctgggattaaaggcatacaccactgtgcccaacttaaaaactttttgttatttcatttttattagtgggtatggagattgggatggtcactacatgtagaggtcagaggacaagttaagggagcaatttggttctctccttcaactgtatgagtcttgaggattgtactctagtgcctttatccactgagcatcttgctggcccttgactgtactactctcacctgtctaccctatacgctttcattcttcaagagtgtttgactttgctacttttttttttttttagacaggtagcctagcctggccttgacataatcttctggccattccacttgcacatcctgagggctgggatggtagacatgtaccaggccacctggctgatctgtgcatgttcagcatgttttcagcccttgcttgttatttccaccactcctttacaacacaaatgaaggctcaggccttggtgtagaaaagggagtttccctagtccttcagtctgtcttctccctaatgattgttgtatgactctgtgactcagagctctggtggtgacagctctgaccccatcctctcctttgttttgtcctcacacccccagctgaccaggtgtatggagaccaggacatgcatgaggttgttcgaaagcattgcatggactatctggtgagatccaagggaggccttggggcagcaggagggtagggggacccccgttgcacacaaaccttaattttccaatctattccacagatgaagaacgctgattacttctccaactatgtcacagaagacttcaccacctatatcaaccggaagcggaaaaacaactgccatggcaaccacattgaaatgcaggctatggcagagatgtacaaccgtcctgtggaggtgtatcaatatagcacaggtacttctgtagtgggtaggtgagggactaatggttcctcatcagagccaaccataccgggcccccctgtggatgctccctccttctctttctctgcagaacctatcaacacattccatgggatccatcaaaatgaagatgaacccatccgtgtcagctaccaccggaatatccactataattcagtggtgaatcctaacaaggccactattggtgtggggctgggcctaccgtcatttaagccaggggtaagtgggtccctgtgccccaggtagatatggatcattgactctgcccttagaccataaaactgtctccccctaagtttcacctgtctataaaattagtgagtcaccattgatcagaactcattctgtagcttttgatttgcctgtccatgaagtggctcactaatgttattctggttgagccttttaggatgtagagctcaatttgaagcagtaaggcagaccttggactaggtatccaagcttccacacaggtagatcttctccaacttcagagcacttacagttggagtcacagacttggaatgtagcagcttactggaatgggccctgtggacagattgtattgtttgggcctatactgaaagtccttcccacaggcccaagacctaattggtgtcagaagatgggagttgatttgcccagcatccactggcagataatcatttccgtctcacagtctctctcctcatcttccctgctccatcctccccctttcatcatgtcctctgatcctccctcttgccttcctcctaggctctttccccttctcctcaccccacttcctctcctccccaccccctctcctccctggtctctatcttcccttcaccccctcctgggggttttgaagtcttctattcaggtttcacttcctacaaaccgaaggtggtcctgcctaatcttaaacaacatcaacataccctccaaccttggtgggggggtggggttattttttaactaaattttagaaaagttacagatttgcaaaatgattgggagaatattagcatttccatatgccccactatgattaacatgaacatagtacatttgttgtcattaacaaatcagtatggattcattaagaacaatttcctcagtttctacttggtgagccttttccaggattctgtctcacatttaattgttccctttgacttcttgtgactttaacaaattctaaagaatttgactgcttttgttttgatctggtgacccactccaccggtttagaatgtcatctaatgggaatttcgctgcgtgtatgtagctattccagaatgaattttttctacttaattaatatcatttaagattcatctgtaacttttactttatttccttttcctttaaacgtctgaatgtttaaatgtttctctaattaatagacttcattgttcaaaactattttacatttgttttggggaggggtttgtggaggtctctctgttcatcaagcttggtgcaaagcccccttcctccttgagaacagtgttctcagtgtacagtttccatctagtctcttcccaaggaacagagacttgggtaatctgttaccatgtgtgaaccagtattaatacatgcctactagcctgacgttactgcctcattcctcccacttgttttgatgatctcaaaaattttaaggagaaccattcaaaagtattgcagggaaattatttttttttccagcatttttctaatgattttaactttgatattgggttcgggcagaagagcacagatatcaagaatatgtgttaggaatatgatcatgactgttgatgttgtctggcagaagtcataggaattttcccaccttttgactgctgtagtgttaggaaggaagtcatacttaaggaaagggaattatgtctgtcttcctgaattgatgttaatgtgagcttagggttagtgctgctatatctagttaaaatcccttgaccatttgcctccttctagcctttttcttgagtaaatttcccttttcctgagtaaattttcactttaaagtttagaaaactttccccatcacccagcagtcatttacatgactgctatttacatatacgggtataagctggggcagactcattaactggaccccctggagtccggtgatatctgcagttctttttatgtttagtgttactgattctattcatttttaaagtgcccaaggccaccacctgcttgtctttgcatacatttgtaattcatttaggtggttttgtcactgggagccttacttcttaactaatctttaaaaggcgattagcatacattaaggattagtctttgttttgtaaagttccttgggttttgacagatgcataataataccatgcatctatcttaggcacctattcattcagctagtttcagcccctaaaggttccccacgctttctcctgcaaccactgatctttattgactgcttttgcctatttcagaaagtcacgtaattgcaatcataagtatgtaagcttttaaaaatgctgctttcaggtagcaatatgcattaaggttcttccctggtttttcatggtttgttagctattctcttatcactgttccatttgtggaggcacactgttggtttaatcattcacctatttgaaagatatccttgcttgcttccaggttttgatgattatgaacaaagcttctgtaaactgctgtgttcaggtttttgtaggaacttaaattttatgattagttgtattaatatctggaagcaagattgcagaattataaaatcatgctgtgatttgtaagcaactgctagactattgtatgaagtggcctgatttgttccagtcgccatcacaatgaatgaaagttccattcctcttctttcccagcaattcatctttctactttttttgaattttagccattctcagtgttttttttaaaggctccttgattgttaaatgtgttgaacattgttttaatgctctaccactgagcttggtccccagcctgagtattggttacatatgtccattggccatctctatatcttttacctgtgcgattagatcacttacctacttttcatttttgtcattttgtagtgctaggaattaaacccatgtttttgtgtatgcattcattatcactgagctggccctatttttaaattggcttgatctaacctttttatacatgtatttcccctggtgtgctccatgatagaaaattatgttgtttagcatacatgcatttatgtatgttatgtatgtgcatttgaaaatgatgttgctagggacatggtggtacatgcctgaaattctagtagtcttgaggcagaggaagagaattgtgagttcaaaaacctaatgactgggctgcataccaagtcattgtttttggaaaacaaaacattaaccaaaattttaggaagtagtatttgcatttaatccctgaaatatactttgatgttctctattatttcattagcatcatgcctgtaatcccagcacttgtgagcctcaagctggaaggcaaattgccatgaattccaggccagcctggccttcttagtgagttcaagatcagtccaggcaatggccctctctcagaaagcaactaatgttgtagtgtcttaaaacttgatgcgaacttgcatgagaatacagtgtcctagcacccacacgatgccaatactgaccctttaattcctcacatagccatacccagcctcatatacgcttgattcctgcctccactccatgtctgtacttctctgttcatctttttcctttgccttatctgggaatatatgagaaaggcttcagcattgtgaaattgaatcattgctagatgaggcttctttaaatgaaggcctagacagaagagcccctcttatctccagacttaatgcttcacttgaggtgtcttgggtttgggcccatatatctgaccatagcagttcagattgccaggtcttatatctaagcctgctttcttcagttatggatggttctatacacaatccgctgaggagtgctttgtaaaaataacttctatgttgtctttgctaaggcctgtaggcctgcctttctgagcccattcaggctcttacccacgttcagagcatcaccgcacatccctgttcctctccccccctggcagtttgcagagcagtccctgatgaagaatgccataaagacatcagaagagtcatggattgaacagcaaatgctggaagacaagaaacgagctacagactgggaggccacaaatgaggccatagaggagcaggtggctcgagaatcttaccttcagtggctgagggatcaagagaaacaggcccgccaggtccggggacccagccaggtgggtcatggactctgtcattggcctgaccaagacctgttacttcttatcttttgacccctaattgacagggataaaataagagattttgacatctgggagaaagggaagctcccagccccatctctaactcatctcatctttagtcttggcatcgtaccttggaactctcaacacttgattttaagaagtgaaggagagccagctcttaagaaacgaagagagcagctaccactgctggtagcacaaaggaacaatggatagctacaaagagagcagctttttttggaatccctttgcatgctgcattctgtcctgaggatatagtctttccttcactatcttcagtgatcctgtctgtctgttgaggcagatacggcattggtcaggcctgtgactctggttgtacaagaccaggagaggtggaggatccagtcggttgtatttctaggatagcaagcagggaggcaggcgcctggggaatcacagagggctttagaatgactaaatggttccagaagctgaataatctgatcagcgagtatttactatacgcctgtgacaggaagcaggaggtcctattcctagtgtagcgggctacattgtgaacctagcaggccaaagtacctatccttaggctactcacagttttactaagtgaaataaaatgctcataatgaataaattagttggaggtatggtggatgaaaaatggacacttggtacaggggacaattgagactgagtggagatggtctgagttcacggtattaaacagtcgtcggggtaggcctcagcagatgaggtgggggcagcctataaaaaggggatttggtagctgggggtgagggcagtggagttggtataactcagagtctgtagctgaacagaacgagggtgagatcagggtagtggggctaggttggatggtgacttgtgaattctggagaggactttgattttgctctcaatgagacagaaaccatggggggtgggctgtaaacacaaaaaggattcgagttaggacttgacaggatcaccctgaccgattatagagcaaatctgagggagaaagcagggttgaagtatgagatcagtgaggaggaggctcccaagggagtcccagtgacaggtgagggtactacaggcgtgctatggaatcacaatctcttaaaagaataggactttgtcagatgcctgcaaggatatgaggctagttaagaatctcccagtagtccaccgtgatacattaaagctgtgctatagccaggattctggaaagggtataatcactctggcacaggagggtcatagctggtgtaggtccttatcactttttccttccctactgcagccccggaaagccagtgccacatgcagttcagccacagcagcagcctccagtggcctggaggaatggactagtcggtccccacggcaacgaagttcagcctcgtcacctgagcaccctgaactgcatgccgagctaggcattaagcccccttccccaggcactgtgttagctcttgccaaacctccttcaccctgtgcaccaggtcagtggcttgctttcagggtgcctgcttgggctaagaggctctgcttgctgggccctacctctgattgtccatctgcctcaggtacaagcagtcagttctcagcagggggtgatcgggccacctctcctcttgtgtccctctaccctgctctggagtgccgggccctcatccagcagatgtccccctctgcctttggtaagcctccttaggggatgggccagctggaagttgggagagcccggaggattttttgaagcccctggccatctctcccaaatcagaggcatgagggaaaatttcaggccccaaagattttctccacagtgggtctagtggggcttcacagagttgagggagtcaatgagtgattgggacctgaacggacttttccagagccagggatcagacagaaatcagggaaagtgacctgaggccccccatcatcgttgtcctcttctctctcctgcccagcaggtctgaatgattgggacgatgatgagatcctagcatcggtgctggcagtgtcccaacaggaatacctagacagtatgaagaaaaacaaagtgcacagagagccacccccagacaagagttgatggacacccagggactggacatcattcccgatcccccactcctgccctttgatgccacccaaacttctttggctttcttccctcttggcttccttcttttgtttcctcttttccttttttttttccacttccctctggccggcccacccatgcgctccatccatctcatccctgccaccaccattggtctctgccagctgaagtgccctattgcccccgcacagcaccatctcagcattccacaggggactctggaaagggtgcggaaggtaggcaagaggcccacagagacagaccatctggcagccaggcagccccagaagagagacattcagacaaaggaagtcttctgctcacccttccttaaagatcagataaacttgtcatcccttcccagcaatgatgacaggaaaatggaagtggcaagttttccttctagtatccgaagaatctgagccttcaatgttaaaatttttcttaattaaaatgtgctttatttcacaaaatcaacaaatcaaaaagaatattcatggcaacgttggtcctttgagggtggcatctctggtttggagctaggcaggctggccatgggacagaaagggcagaaaaaagatggatttctgctgtcttttggcccctagttccttggaagggcaaaggctatgaggtagagggaggtgacaggcattgcaggtggcagactgactttggacagtgagaccctgaccttgctgcattgctttgccttcaccaccgctagtctgtttggaaggcttgaggtggggtgtcttgggaaattagggccactacccaagatttgaatttagggagtgggagcagcctcagcagatggggcacccgtgcactgcaggtgttgacaagatccaccatctgtaatgtccttggcacaataaaaccaaatgtcagttt

SEQ ID NO: 7 - DNA, 32680 bp, mus musculus; identical to SEQ ID NO: 6

SEQ ID NO: 8 - DNA, 7451 bp, mus musculus
cagagaagaaccaattgttcccttggtctacgtacagcgcctcagagcttgtgggcgtttcggagcgggagggggacggggggagtgtctcgcccgcgccaccgactgcgccaggccggactctggcgccatggaggagtacgctcgcgaaccttggtacggcgatgggcacaggcttcgggacagtccgcgcgacgctcaggcggacaacgggaggcgggcggggaaggcaggggctgcagtgtcaagtccctgacccgggaggctcggaaacttcactgcctctgcgcatccggcatggcccctcccactcggacttcgtcaaaaaaccgccaccgtggagtgtcccagtatgtgcggtgtgggacaaactatcgcactgttgccctggctcttctcctagaccccctttgtgagccaaaagagaaacgctgggcagatccattccggcggtgagggaggagaggcgtggagccaatatccacagggtttcttcgtgtcgcttttctcaggctggcttttgacataggatagggcatgtgtgaactcactgtgggctaagccagatggcacctggcttttccgcacggtcttttgatttgtccgatttaggttttaaaaggacacaagggtttctctggacgtgctttttgtgtcgaaccgagtgtcagtcaccctgtttatattttacttaaataacgtttgctagttaacactattgaagcctgacacgacaactcccccccccccctcccagacacggttactctgtggtgtagccctggctgtcctggaactcactctgtagtcttgaactaagaaatcctcctgcctctgccccccaagttctgggattaaaggcgtgaaccacccctgccaggcacatgacaactcttactgatttttgatagtaacaaaaaccattttgtttttggctcctggttctaggatttgagggactctgttcttcaaatctagtttcacgtagaactctctgagaatactgtattgtcagaaacagtcataggggctcagtggtagagtagttgatttaagcaagagacagattgtgggggacaggggacctagattccaaagccatttgatttttgataatgacaaaaacagttgtattgacgcttgcttgtaatcaagagcactgctctgccagtagtaaacccatcgttgcaaggctatgtggtgagacacctcccccatcccaaattgttttctcacttttgtaccacagatagatttacaaaccttttcttttggggtttgtttgttttgagacagtatctcactatagaaccctggctggcctcgaactgactagactaggctgacctctgacctcagagtgctggtattaaaaggcacaaactttctttgtgggacagggtctccatttagagcccaagttggactgccaacttgtgatcctcctgtctcagccttccaagtgttgatcacaggtgtgcagaaacacatctggttttcctttctggctttctggggaatataaaaagtgtcagaactaatttgttgtcatctaaggtgttctgcatcagtcctgagcttccctgtttggttctccaagcagggcagggtctcacattaacccaatcttttccttcctgcttgcagcccatggcgaattgtggatgattgcggtggagctttcaccatgggtgtcattggtggtggagtcttccaggctatcaagggcttccgcaatgcccctgttgtgagttgggccttcctccagtggtgtgggaatctgcggtcttgctgacataggagtactgctctgagcatactgaacattctgttgattgttcacctactgtgtgttgggcctggcttctggatttagggtttgagggattctgttcttcaactatccagctagaactctggaaatactgtactgtcagaaacagtcttaggggctagaagtatttagctcagtggtagaacagttgatttaagcaagtgggtgggtgtgtatgtgtgtgtggggtgcccacagttccatccttagaattagaataaaaagaaaagggttagcatcaaattttcaatgtgtatacaccgtagattttaccacaagacagtctttgggataaaattctatatggatggtggtgccacacacctttaatcccagcccttgggaggtaaaggcagtcagatctgtgagttgaggccagatctggtctacagagtgaattttgggacaaccagggctacacagaaaaaccctgtctcccccaccccccctcaaaaaatcctctatacaggaaaatgacaggagttgggcagaaagaaccttttttttttctttttctttttcttttttttttttttttttttttttttggattttttgagacagggtttctctgtatagccctggttgtcctggaactcaccctgtagaccaggctgccggcctcaaactcagaaatctgccagcctctacctcccaagtgctgggattaaaggcgtacgtcaccactgcctggcagaaagaacctttaagttgaaggagagagtaatataatacctttcctttgagccccaccccttgaagatagaaggctcattggatttggtagcaagcatgaggcatgcttactatgcctctaacagtggtggaggtgatggaacacaagacaggcatatatatccctagagcttgctggccagtcagcctagctagaagttggttcagtgagatactctgacttccacatgttcacacacctgcacggtcatgtgtatattccacacagacacacacaaaccgttttccgcagcacaggttggcacacaacttcaaatcctcctgtcccggctttccaagtactagcattccaggcatctggcagcatacctggttctgtagcctttctgtcttgctcggagtcgtcctcagctcctagaactctccttcctgcacctttgtccatagttctcatttttgggaatcttcgcacgtattgcgccctcttctttttttcttctgcactaaggaatggagtctggtacctccatcttcccatcctgcatgctaagaatattgccgagctgcagcctcagcctccttcacaggttcctctaatgcaggttcactttgctccttgctcactgtcactcttcctagggcggttgttctttttttggtatttcgagacagggtttctctgtatagccctggctgtcctggaactcactttgtagaccaggctggccttgaactcagaaatccatctgcctctgcctcccgagtgctgggattaaaggcgttgccaccacgtccagcagggcggtggttcttaaccttcattttttctttcatttatttatttaactatttatttgtgttttcctattcactttacatcctgctcactgcactaccgatatccccccaccaccaccaacctccgcagttctggcacatcaaatgtctatgaggctaggtacttctctcccactaaggccagagaaggcagcccagctagtagaacatatcccacagacaggcaacagcttttgggatagccccagccctattttttgaagcatgatttctctgtgtatccctggctgtcgtggaactgcctctgtagaccaggctggcctcaaattcacagaggtccacctgcttctgcctcctgagtgctgggattgaaggcatgcgccaccccaggtctcaacctaattaaagggtccaagttttgtgaccctttaatacagttagatcctcatgtagtggtgaccctcaaccataaaatttcattgctactacataaaagttcatgtaattttgctactgttatgaatcacaatgtaaatatctgtgtttacaatgtcatggtcttgggtgacccccgtggaagggggtccaccaaaagggagtcagaacccgtgagtagaaaagcgctgctctagattgcattttgctgcctgaagctatcttacttgccactactgtgtacacactctgagacccctgcatataggatgtaacctggcatgtgtgcctgctcattgtatattgagtgagtgaatgagtgaagaaatgaaactgagcaacctcactctgagaatatctctgttggattttctctccatcctcctggttctttggctgctgctctgcatctagtagctttcccatgccttctttgttgcagtgctgggcatagacgaaccctgagccttgctcattatggacacatgctctaccactgaggaccccagcaccccttcctttttataaagcctgcaaccctgcctgccagtgagtgctcttacccctcctctaacacctctccttgctttctccagggaattcgacaccggttcagaggtagtgtcaatgctgtgaggatccgggcaccccagattggaggtgagatcgtggaaccataaagatgtgttaggaactttaagggtaattgatcctttgaaactagactgtaagttataggtccagattctaactcaaagtctgactgcaacttccccacagtctaatatgaaagggcacgaatacgtattgcggttgatttgtttttgagacagggtctctctgtatagccttggctgtcctggaactcactctgtagaccaggctaccctcacagagattctcctacccctttctctacttcttccttctaagtcctgggattaaaggggtgcactcccaagcctgggggcttctgcagtttaagtccagatcctggctcttctctgttaggggacctgatgctagtagcagtcctcctccaaacctcatctgataattgaccacccaattggcaggggtttgttggtttgttttttggtttttggtttttcgagacagggtttctctgtatagccttggctgtcctggaactcactttgtagaccaggctggcctcgaactcagaaatccgcctgcctctacctcccgagtgctgggattaaaggcatgcaccaccacgcccggctccaaagtggtttttttaaacactataaacatatgcaattgtttcctgtattatagtagagatggattgagcatgctagacaagtactctgtcactatgacagattcctaacactgaatatttcattttttattaagagatggaatcttgagactgggaatgtagtttagtttgtagagtacttacctagcagcacaaagccctgggttcactgcataaagtctgggtatgatggtgcccacatgtaatcttggcattttagcaatggaggccgatgaatcagaacttcaaggttatccttgactacatagccagtttgagtgcagccttgacttaatcagatagtgtctcaaaaaagagggagagatgggggtgtcgggacgtggtaaagcagttaactaacctgtgaaaccctgaggtccaacgctaccaccaagaaaacaaagctacctgctgtagctcctccacctcccatgtagctggggctaccggtgcctaccaccacaccagctagttttatagcaacatgtttggttctcttgcatttttttactgtttcatgttatatgaggtcagctatggaactgtttctggtatcgtgacatgctcaaagagttgtatgtagcttttgaagccttttggatttctagattatgactgtttaataatatatattgtgttctggctttctgccctcttttccttctccctgaaatcaaaaccagaattccaactccacatggtatttacagggtgaaagttgctgcattgaaagctgtgtgaacacgcctttaatcccagtacttgagaggcagagacaggtggatttctcagtttgagtccagcctagtctatagagtgagttccaggacagccatggctacacagagaaactatgttttgaactgccccctcccaaagaaagctgtatgagaggttaatgtgcatgtgtccatttcccaaataaaagtgaaaggattaaccgggcgtggtggcgcacgcctttaatcccagcacttgggaagtagaggcaggtggatttctgagttcgaggccagcctggtctacagagtgagttccaggacagccagggctacacagagaaaccctgactcgaaaaaccaaaaaaaaaaaaaaaagggaaaggattgctgggtggtggtgtggtggcggatgcctttaatcccagcactcaggaagcagaggcaggcggatttctgagttcgaggccagcctggtctacagagtgagttccaggacagccagggctatacagagaaaccctgtctcaaaaaaccaaaaaaaaaaaaaaaaaaagagagagagagaaaaaaaaaagtgaaaggattttgatgataataactacagccccaatcagatgtggaacctttcacagtgagaaagatggactatacctagttctatagctggactttcttccttcttgtatttggtgctaaggttgtgccccatggcctcctgtttttgagacagcctccactgtataggtgtctaagcctttgcggtcctcctacctgagcttcccaggtgctggcatcatactatatcctggtcatatttatttgtttagtggggggaggggatcaccctatgcaagcatctaccacagagccacatctccggtcccagcactctttcttggccagtcttcaggccttggaagtttccagatgttgagctacgtggagtctcagattgtgtgattcagactcttatttcccctacaggaagctttgcagtgtggggaggtctgttctccaccatcgactgtggcctggtccggctacggggcaaagaagacccctggaattccatcagcagtggagcgttgactggagctgtgctggctgcgcgcagtgagtgccgccagcctctcaccccagtccttgccctgtcctgcctgcccttcctcagctgtgtgtctttccgcctcccaggtggtccgctggccatggtgggctctgcgatgatgggaggcatcctgttggccctcattgagggtgttggcatccttctcacccgctatactgcccagcagttccgaaatggtgagaacttggtgggcggtgggcagggagagtcaggaagcactgtcaaccctctccatgcttcctcgcctcattacctcattctcccttctccagcacccccattcttggaggaccccagccagctaaccccgaaagagggatctccggccccaggttatcccaactaccagcagtaccactgaggaagccgctgcctgacccccgccaccgtgggagccactcctcagttccctcccggatgatctacctccaagggaggactggctcctacatagccctgagaggccttcacagagggcctcaattctactctctggttttgtggtaggggtggggacaccccagcagccttgtcatatgggttcccttt

SEQ ID NO: 9 - DNA, 20896 bp, mus musculus
tggtctacgtacagcgcctcagagcttgtgggcgtttcggagcgggagggggacggggggagtgtctcgcccgcgccaccgactgcgccaggccggactctggcgccatggaggagtacgctcgcgaaccttggtacggcgatgggcacaggcttcgggacagtccgcgcgacgctcaggcggacaacgggaggcgggcggggaaggcaggggctgcagtgtcaagtccctgacccgggaggctcggaaacttcactgcctctgcgcatccggcatggcccctcccactcggacttcgtcaaaaaaccgccaccgtggagtgtcccagtatgtgcggtgtgggacaaactatcgcactgttgccctggctcttctcctagaccccctttgtgagccaaaagagaaacgctgggcagatccattccggcggtgagggaggagaggcgtggagccaatatccacagggtttcttcgtgtcgcttttctcaggctggcttttgacataggatagggcatgtgtgaactcactgtgggctaagccagatggcacctggcttttccgcacggtcttttgatttgtccgatttaggttttaaaaggacacaagggtttctctggacgtgctttttgtgtcgaaccgagtgtcagtcaccctgtttatattttacttaaataacgtttgctagttaacactattgaagcctgacacgacaactcccccccccccctcccagacacggttactctgtggtgtagccctggctgtcctggaactcactctgtagtcttgaactaagaaatcctcctgcctctgccccccaagttctgggattaaaggcgtgaaccacccctgccaggcacatgacaactcttactgatttttgatagtaacaaaaaccattttgtttttggctcctggttctaggatttgagggactctgttcttcaaatctagtttcacgtagaactctctgagaatactgtattgtcagaaacagtcataggggctcagtggtagagtagttgatttaagcaagagacagattgtgggggacaggggacctagattccaaagccatttgatttttgataatgacaaaaacagttgtattgacgcttgcttgtaatcaagagcactgctctgccagtagtaaacccatcgttgcaaggctatgtggtgagacacctcccccatcccaaattgttttctcacttttgtaccacagatagatttacaaaccttttcttttggggtttgtttgttttgagacagtatctcactatagaaccctggctggcctcgaactgactagactaggctgacctctgacctcagagtgctggtattaaaaggcacaaactttctttgtgggacagggtctccatttagagcccaagttggactgccaacttgtgatcctcctgtctcagccttccaagtgttgatcacaggtgtgcagaaacacatctggttttcctttctggctttctggggaatataaaaagtgtcagaactaatttgttgtcatctaaggtgttctgcatcagtcctgagcttccctgtttggttctccaagcagggcagggtctcacattaacccaatcttttccttcctgcttgcagcccatggcgaattgtggatgattgcggtggagctttcaccatgggtgtcattggtggtggagtcttccaggctatcaagggcttccgcaatgcccctgttgtgagttgggccttcctccagtggtgtgggaatctgcggtcttgctgacataggagtactgctctgagcatactgaacattctgttgattgttcacctactgtgtgttgggcctggcttctggatttagggtttgagggattctgttcttcaactatccagctagaactctggaaatactgtactgtcagaaacagtcttaggggctagaagtatttagctcagtggtagaacagttgatttaagcaagtgggtgggtgtgtatgtgtgtgtggggtgcccacagttccatccttagaattagaataaaaagaaaagggttagcatcaaattttcaatgtgtatacaccgtagattttaccacaagacagtctttgggataaaattctatatggatggtggtgccacacacctttaatcccagcccttgggaggtaaaggcagtcagatctgtgagttgaggccagatctggtctacagagtgaattttgggacaaccagggctacacagaaaaaccctgtctcccccaccccccctcaaaaaatcctctatacaggaaaatgacaggagttgggcagaaagaaccttttttttttctttttctttttcttttttttttttttttttttttttttggattttttgagacagggtttctctgtatagccctggttgtcctggaactcaccctgtagaccaggctgccggcctcaaactcagaaatctgccagcctctacctcccaagtgctgggattaaaggcgtacgtcaccactgcctggcagaaagaacctttaagttgaaggagagagtaatataatacctttcctttgagccccaccccttgaagatagaaggctcattggatttggtagcaagcatgaggcatgcttactatgcctctaacagtggtggaggtgatggaacacaagacaggcatatatatccctagagcttgctggccagtcagcctagctagaagttggttcagtgagatactctgacttccacatgttcacacacctgcacggtcatgtgtatattccacacagacacacacaaaccgttttccgcagcacaggttggcacacaacttcaaatcctcctgtcccggctttccaagtactagcattccaggcatctggcagcatacctggttctgtagcctttctgtcttgctcggagtcgtcctcagctcctagaactctccttcctgcacctttgtccatagttctcatttttgggaatcttcgcacgtattgcgccctcttctttttttcttctgcactaaggaatggagtctggtacctccatcttcccatcctgcatgctaagaatattgccgagctgcagcctcagcctccttcacaggttcctctaatgcaggttcactttgctccttgctcactgtcactcttcctagggcggttgttctttttttggtatttcgagacagggtttctctgtatagccctggctgtcctggaactcactttgtagaccaggctggccttgaactcagaaatccatctgcctctgcctcccgagtgctgggattaaaggcgttgccaccacgtccagcagggcggtggttcttaaccttcattttttctttcatttatttatttaactatttatttgtgttttcctattcactttacatcctgctcactgcactaccgatatccccccaccaccaccaacctccgcagttctggcacatcaaatgtctatgaggctaggtacttctctcccactaaggccagagaaggcagcccagctagtagaacatatcccacagacaggcaacagcttttgggatagccccagccctattttttgaagcatgatttctctgtgtatccctggctgtcgtggaactgcctctgtagaccaggctggcctcaaattcacagaggtccacctgcttctgcctcctgagtgctgggattgaaggcatgcgccaccccaggtctcaacctaattaaagggtccaagttttgtgaccctttaatacagttagatcctcatgtagtggtgaccctcaaccataaaatttcattgctactacataaaagttcatgtaattttgctactgttatgaatcacaatgtaaatatctgtgtttacaatgtcatggtcttgggtgacccccgtggaagggggtccaccaaaagggagtcagaacccgtgagtagaaaagcgctgctctagattgcattttgctgcctgaagctatcttacttgccactactgtgtacacactctgagacccctgcatataggatgtaacctggcatgtgtgcctgctcattgtatattgagtgagtgaatgagtgaagaaatgaaactgagcaacctcactctgagaatatctctgttggattttctctccatcctcctggttctttggctgctgctctgcatctagtagctttcccatgccttctttgttgcagtgctgggcatagacgaaccctgagccttgctcattatggacacatgctctaccactgaggaccccagcaccccttcctttttataaagcctgcaaccctgcctgccagtgagtgctcttacccctcctctaacacctctccttgctttctccagggaattcgacaccggttcagaggtagtgtcaatgctgtgaggatccgggcaccccagattggaggtgagatcgtggaaccataaagatgtgttaggaactttaagggtaattgatcctttgaaactagactgtaagttataggtccagattctaactcaaagtctgactgcaacttccccacagtctaatatgaaagggcacgaatacgtattgcggttgatttgtttttgagacagggtctctctgtatagccttggctgtcctggaactcactctgtagaccaggctaccctcacagagattctcctacccctttctctacttcttccttctaagtcctgggattaaaggggtgcactcccaagcctgggggcttctgcagtttaagtccagatcctggctcttctctgttaggggacctgatgctagtagcagtcctcctccaaacctcatctgataattgaccacccaattggcaggggtttgttggtttgttttttggtttttggtttttcgagacagggtttctctgtatagccttggctgtcctggaactcactttgtagaccaggctggcctcgaactcagaaatccgcctgcctctacctcccgagtgctgggattaaaggcatgcaccaccacgcccggctccaaagtggtttttttaaacactataaacatatgcaattgtttcctgtattatagtagagatggattgagcatgctagacaagtactctgtcactatgacagattcctaacactgaatatttcattttttattaagagatggaatcttgagactgggaatgtagtttagtttgtagagtacttacctagcagcacaaagccctgggttcactgcataaagtctgggtatgatggtgcccacatgtaatcttggcattttagcaatggaggccgatgaatcagaacttcaaggttatccttgactacatagccagtttgagtgcagccttgacttaatcagatagtgtctcaaaaaagagggagagatgggggtgtcgggacgtggtaaagcagttaactaacctgtgaaaccctgaggtccaacgctaccaccaagaaaacaaagctacctgctgtagctcctccacctcccatgtagctggggctaccggtgcctaccaccacaccagctagttttatagcaacatgtttggttctcttgcatttttttactgtttcatgttatatgaggtcagctatggaactgtttctggtatcgtgacatgctcaaagagttgtatgtagcttttgaagccttttggatttctagattatgactgtttaataatatatattgtgttctggctttctgccctcttttccttctccctgaaatcaaaaccagaattccaactccacatggtatttacagggtgaaagttgctgcattgaaagctgtgtgaacacgcctttaatcccagtacttgagaggcagagacaggtggatttctcagtttgagtccagcctagtctatagagtgagttccaggacagccatggctacacagagaaactatgttttgaactgccccctcccaaagaaagctgtatgagaggttaatgtgcatgtgtccatttcccaaataaaagtgaaaggattaaccgggcgtggtggcgcacgcctttaatcccagcacttgggaagtagaggcaggtggatttctgagttcgaggccagcctggtctacagagtgagttccaggacagccagggctacacagagaaaccctgactcgaaaaaccaaaaaaaaaaaaaaaagggaaaggattgctgggtggtggtgtggtggcggatgcctttaatcccagcactcaggaagcagaggcaggcggatttctgagttcgaggccagcctggtctacagagtgagttccaggacagccagggctatacagagaaaccctgtctcaaaaaaccaaaaaaaaaaaaaaaaaaagagagagagagaaaaaaaaaagtgaaaggattttgatgataataactacagccccaatcagatgtggaacctttcacagtgagaaagatggactatacctagttctatagctggactttcttccttcttgtatttggtgctaaggttgtgccccatggcctcctgtttttgagacagcctccactgtataggtgtctaagcctttgcggtcctcctacctgagcttcccaggtgctggcatcatactatatcctggtcatatttatttgtttagtggggggaggggatcaccctatgcaagcatctaccacagagccacatctccggtcccagcactctttcttggccagtcttcaggccttggaagtttccagatgttgagctacgtggagtctcagattgtgtgattcagactcttatttcccctacaggaagctttgcagtgtggggaggtctgttctccaccatcgactgtggcctggtccggctacggggcaaagaagacccctggaattccatcagcagtggagcgttgactggagctgtgctggctgcgcgcagtgagtgccgccagcctctcaccccagtccttgccctgtcctgcctgcccttcctcagctgtgtgtctttccgcctcccaggtggtccgctggccatggtgggctctgcgatgatgggaggcatcctgttggccctcattgagggtgttggcatccttctcacccgctatactgcccagcagttccgaaatggtgagaacttggtgggcggtgggcagggagagtcaggaagcactgtcaaccctctccatgcttcctcgcctcattacctcattctcccttctccagcacccccattcttggaggaccccagccagctaaccccgaaagagggatctccggccccaggttatcccaactaccagcagtaccactgaggaagccgctgcctgacccccgccaccgtgggagccactcctcagttccctcccggatgatctacctccaagggaggactggctcctacatagccctgagaggccttcacagagggcctcaattctactctctggttttgtggtaggggtggggacaccccagcagccttgtcatatgggttccctttttgtgtcttagggcatcccagcttcatacgtgtaacaattctctcacccccagagccctcgtgtggcaccctgatgaatgtttaaagccagttttgaaatgtctgtgtatgtctgccttcagtcacccagatggccctctctctcctcagaaggggcttggaaagtctagggcttgagatttcatggtgaatgggtttgaagggttttgatggtttttgttttgttttgttttttgtattgggaagtgggagaaagaagcagggtctcagctgggcatggtggcacacacctgtaatcccagcacttgggaggcagagacaggcagatttctgagttcaaggccagcctggtctacagagtgagctccaggacagccagggctacacagagaaaccctgtctcaaaaacaaaaaacaaaaaaaaagaagaagcagggtgtcactgtgttgtctaaactgaacttgaacttgtatgatactaccacacccaacctctagtaaaggtttacaaaatgaatgagcaagggagggaatagtcaaaaagatgaattagacacatgcataaacgtggttaggtgcctagacatgcttcgtgcacgcaggaaagaaggacaaggattgctgggagcatgtgtatgctgtgcaaacatactgcagaccctcctggtacaggctccccgtggagagcatgggaaaccaggcgcgtgagaaaagcctttgccctgggcgtggtagtgcacactttaatccagcccagagcagcacagaggccgaagcggagacacacagatctctgtgagctgaaggacagcctagtctacagagcttatcccaggacagccacggctgttactcagagaaccctgtcttgaaaaacaaaagcaaaccaaaaagaaaaaaaaaaagaagaaagagcaaaagctgggcagtgctggtgcacgcctttaatcccagcacttgggaggcagaggcaggcagatttctgagttcgaggccagcctggtctacaaagtgagttccaggacagccagggctacacagagaaaccctgtctcgaaaacaaaagtccatgtggccgtattacagctctggggtggaggcccaggcgtcaaaagaagactccgtccctgtcactttctcctttgctgatgtctagatctttttacatttgctgttttttgttactgtcactaattacattttaaattatttttatttcatattttcatatatattttgatagtatctttcccttctctacctccactcagatcttctcttcatccctatccacttcattttatcttctgctgtttctttcttgagacaggctctcactttttagccctgcctgtcctggaattcactctgtaggccagggtggcctcgaactcagaggtctgcctgccttctctgttatccagatggactgctcccaggttctgacatgtgtaaacccttaagtggatgggataactcttgtctcttggggtccagttgcatatagaggcatagaaatttccactgtgactgttgcggtgcgaatgggctgtggataagtgctgggattaaaggggtatgcttccacaccttgcttgctgtttgtctttcaagacagggtctcacttgtatcaagtagcccaggctggcctccaacttgctatataacagtggcttgtcctgtgaactgatcttcctgccttagattcctaactgctatggggaaccagtggttttctttttatttgtttgtttgtttttaaaaataaggtctcgggctggagagatggctcagcgggtaagaacactgactgctcttccaaaggtcctgagttcaaatcccagcgaccacatggtggctcacaaccacccataatgagatctgacgcactcctctggtgtgtctaaagacagctacagtgtacttacatataataataaatctttaaaacaaaaaaaaaaaaacaaaaacaaaataaaaataaggtctcagtattattgtctagactgacttcaaaatcctcatccttttgtctcccaagtgccagaattgaagatttgttttgtttttggagacttggtttctctgtgtagctctgaccatcctggaacttgctctattgcctgagcttgaactcaagagatccacttggccacctctctcagcctccggagtgccatgcatcaccactgccccgcccagacctttttttcttttttttttttttcttttttttttttaaaaaggacttatctatctttattttatgggcacttgtgttttccctgcattcatctatggaacagcagttacagacagttgtgagccaccatgtggatgctgggaattgaacccaggtcctctggaagagcagcaagggctcttaaccactgagccatctctccagcccttttttggtttttcaagacagggtttctctgtatagccctggctgtcctagaactcactttgtagaccaggctggcctcgaactcagagatccacctgcctctgcctcccaagtgctgggattaaaggcatgtgccaccatgcccggctccacccagactttttaaatagactcatttattgggagtgcgggtagacatgtcacaatgaacatgtgcagggttagccctcctcctgctctgttggtttccaggatcagattcaggtagtaaggttcaatggcaagtgcccttaccaaccgagccactggcaacccagttgttttggagagggtttggtttggtttggtttggttgtttgtttttgagacagggtttctctgtgtagtcctggctgtcctggaactcactctgtagaccaggctggcctagaactcagaaatcctcctgcctctgccttccaagtgctgggattaaaggcgtgagccaccaccgcctggctccaatttgttttttaagggtgaccacagtatgttcagaaatgagttttcatttgaggagagggaaagtatgggaaagatcccaggttctgacattctgtgtaaacccttccatggatgggataagcattgtctctaccgggggtcatatgccatatagaggcacaaaaatttccagagactggattggttttgtcactgtgactgctgcactaccagtgagctcatggataatatatacattttgcaaggcctacataatgagatcctgtctgaagaaaacaaaatgcggggcaaagttgaatatcttccactctcagggaaaagcaaatcaaaattacagcaggattccgtctttctgaagtgtaaattgctgtcatcaaatgatgagggactcctacagtactggtgagaatgtatcagtagaaaggttactcaaaacaaatctaccatatgacccagctctactactgggcatacacctaaaggagccaacataccacagagagagctcacacatccatagttattgcaccgtcattcacagctttggtgatcttcctaggtggccatgagctgaagagaagataaaatatacacgcacacacacatgaatacgactagaattatagtcatctgtaaaggaaattactttgtaggaaatttgatggaactgaaatattgttatgcaaaacaagccaggacaggtatttaatcgtttttctcttgtgtagactgcagaacagaaagacaacatataattaggggacagactggtagggaagaagataaggatgaggaagaggagagacgggttagccggggacgtttgcaaagtccacagtaattcctatgaggttttcttttgtacacttaatatccgctggggggaaaggccatgtgacaagcaggatggaagatgcagggaggcagctgtgtggaactccattagatgtacacaactgaagggaaggagcaagttgagaggagtgaacagcaggtggcatggaagcgcttgcttgccctttgtgttcagagactggactcagtgcctctggcctcctcgagctgcagctgcctagttattttgcagcagacatgactcacctgcatctttctggttccttcaaattttcttttagttttaagaggtccctaacccaggctggcctcaagctgccttctcaagtctacatgtgtgttgtgtatgcagaaacacacacccacatagacacaaatagcagacaatgaccttgaactttcaggcctgtcctctgcttcctgaatgctggaattaacaaggtttgtatgatcaggctctgcttatttacatggtgcaaaaatcaaacccaggtcctcctgtgtgttaggtaagcattctcccaattgagctatgtccccagctctcagatcagctgcacagatttctcctgtgaaatgctggtgacagctgtggaaaaataccagtatatgtatacaactaaagggaaacagcaaatagtggaggggtcacaggtagtgacatagaggcacttgcttgccctttgggttcaggggctggactcacagggcatcaggcctctatcacgtgctggccagaaatggtggcacacaccttttattccagcatgtactaggtagaggtagacagatctctgaggccagtgatctccatagccagtttcagagcagtcagagctatagactctccagagttaagtaaacctagacccttacaccagacaagtacttccccaccgagctatgccctagcccctcacctctaattcctccagctcctttatgccatctcttctgtctaggatttctgaggcgttctttcagtttactccttccggaagcttccatggctttccttccttaacctctggtctcggttccgtccctcgcgtcccatttgttctccctggctctctgcgtggcctagatctgctatcttacaagaaggcctgtaaaggggctggccagatggagcagcaagtaatgggacttgctaccaagtctgaagacttaagttcaaggcctcagaacccatgtagtgaaaaacagaaccagctcccacaagctgtcttctaatgtctacatgtgtgttgtgtatgcactaatatttagaaaaagtttgtttccagacagggtttttctctgtgtagccctggctgtcctggaactcactctgtagaccaggctggcctcgaactcagaaatccacctgcctctgcctcccaagtgctgggattaaaggtgtgcgccaccaccgcccagctggaaaaagtttgttatggttgttaaaaagagaggtgtgaggatcccgaaggagcaatgcggtctatcacttgtctctggagtgagaatcactccacacacatgctcaaggaaaaggctctggagggctgcacacaggaaaacccaacagaaaccaggagaggagggagggaggagaggaacggagaaaagaatagtaacatgaccagacaaggtcatgagcctactgatcccgagactaaggcaggtcccaaggttctagctggtgtcaccccagatctgagtgattgacatagactgaaagttaacattttaatcatcctgagactgtaagagggaaagcccagttcagcttttttgagacagccctttttctgtatagccctggctgtcctggaactcactttgtagaccaggctggcctggaactcagaaatccgcctgcctctgcctcccaagtgctgggactaaaggcgtgtgccaccacgcccggccagttcggatccttatactccttcctccttatcaatcagaacagaacacttagggccagatgccttttgccagttcccaggtaggtgtcttctaatcagttctatcctgagtacagggtactcagccctagactccacccccaccacacacacacacacacacacacacacacacacttcccttgttaattacaaagccctgggggggtttccttgggtttgattgccccacacacacacaatggcagggggttccgtgggggaagggtagcgtcagacagcactctcttgtgagctctcagaagtccttacctttacatttggttagcatgctagaagcaggctccccaagccctcctcagtttgaatacagtgctagggcaatactttacctatgcttgcctacgtattatactagatgctacaaaagatactgattaaaacccaaatgaagagatggataggatgagggtggggacaaagagatctcatgccctctccaggagtgccagactcaaggaattactgtgtccagctaagcataaccccttggaatccagtcttttttgggcctcagtttatgaatacaattcattataaccatggatcataaacataacctttagctagtctctagagaagttggaggtaagccccaagttccagttctccagttccatctggtgtctagtcacccagcccccaccctaaaggtggtcagtcaacagcttactcattagcatataacaagataatcattgttttgaatattccaaggattttaggagttgcattccaagaaacaaaagaccacaaccaaaaaaaatgtattttacaaaaatcacaaccataggggctggtgagatggctcagcgggtaagagcacccgactgctcttctgaaggtcctgagttcaagtcccagcaaccacatggtggctcacaaccatccgtaaggagatctgactggtgtgtctgaagacagcttcagtgtacttacatataataaataaataaatatttttttaaaaaaagaaatatctcttggagctggagagatggctcagcggttaagagcactgactgctcttctgaaggtcgtgagttcaattcccagcaaccacatggtggctcacaaccatccctaacaagatctggtgccctcttctggagtgtctgaagacagctacagtgtacttacatataataaataaataaatcttaaaaaaaatcacaaccatagagtgtggcttttcatagagttgagctaaaagcatgaaacaagttcccattgtgaaaaacaactgccattgcccatctctggaactctggagctcctgtgcgtgtgtgtgtgtgcgtgtgcgtgtgcgtgtgcgtgtgcgtgtgcgtgtgtgtgtgtgtgtgtgtgtgtgtgtgttttgaaacagacctcctgtagggcaggcagacctctagcgacctgtgcagccatggatggccttgtggtgctgatcctcctgccgctacctcctgggtatcacagtgcatctggggatcagaacacaccaccctggagaaccatttgtgtggtgctagggagagaagagttcagagttcggggggtggtaggcaagcgctccatcaactgcgctatatcccaagcccctgaaacatttgacatcgttttttattgcactgttggagatggagtccagggcctcaagagtactaaacaagtgctctatgtcaagttaagttccctaacttttcctagatctactttaagtttgaaccttacttatctacccatgaacacgtgaggtgcctccttttgtgagctatttataatgctaatttgaatagtcaactataatttttacaagaattcatacattaattatatatttattgttttttttttcttaaaatattcagctagaggtttagaggtgtaactcagtggcagggtgcttatcttactgacttgagaccccaggtttggatccccacaatacaaaaaaaacaaaaacaaaacaaaactggatttggcgattgtattataattgtctatcagtgctgagggcttgcctaccaagtgggactcctaggttggattctctagcaccacaaaataatgtgtatcagtttggaaaggaagcagcattttgctctagccctagttagccgggaactatgtagccctggctggtcttcttctaaagaaaggccttcttctgcctctgcttctcaggttgtggaattacaggtgtgagccatgatttcaggctgagaatataaaactgaagacccagctcagtgatagagtgcttgtttcgtatcctcgaaaatctgagtgtgatctccagggtgcttgctcgtgcatacagaaacacagtaacttaatattgtgacctggtatggtgtgctaacttgtacgtccaactatttaggccagaaacaagcactacttgagtttggtaatttagggcaaacctggagagaatagcaagaacacgtttcattgtttaagggatataagaaaggttttatttggggaagtagctggacagagggagcagtgtttgtttgtttgtttgtttgtttgtttgtttgtttgtttgacagccctggctgtcctggaactcactttgtagagcaggctggctttgaactcagaaatctgcctgcctctgcctcccaagtgctgggattaaaggcatgcgccccacgcccggctgtacactattttttaaattgggttttttgagttgttctagcttattgagttgtttataaattttggacattattttttaaaaatgatttattgagccaggcgtggtggcacacgcctttaatcccaatactcgggaggcagaggcaggcggatttctgagttcgaggccagcctggtctacaaagtgagttctaggacagccagggctactcagagaaaccctgtcttgaaaaaaacaaaaaacaaaaaagaacactttcaaaacaatttgtttttgtttttgtttttttgtgcaccaccacgcccggcacaatttttataatatataattgtttcatcaaagttttatgaaatgtctgtgttcaaatcatttttaaatatttcaataaaattttttaaaaaattagactaccacaaatcaactgtctatagatttcctttatcctagacatttttcatgtcttcccccccccccctttggttttctgagacagggtttctctgtgtagccctgtctgtctgtcttggaactcactctgtagaccaggatggcctcaaactaaaaaaatctgcctgcctctgcctcccaaatgctggcttatatgtcacttttattttaggtatatgagtgttttgcctgcatgtatgtatctatgtgtacaacatgcattcagcgcctgcgggggccagaagagggcagcagcttccctagaattggagatacaaagggctctgagccacgggagtgctctagaagagcagcaagtgctcctaaatgtggagtcttctctctagctccagtatgtagatggggggggggttgttttactttgttttttgagacagggtttctctgtgtagtcatgactgtcctggaattcattttgtagaccaggctggcctcgaactcaagatctgcctgcctctgcctcctgagtgcttggattgaaggtgtgcgccaccacccatcttacactagttttctattactacaaatctcaacttgtagtcaggacagagaagaaaccttaggttgcatccccaggactacgaagcaacaaacaatagtaaataggcagggtcttttggggggggcggggaagggaggtcagaagtaagggtttagggctgggatgggaaattggggctcaataggaaagcatttgcttaatatgttcaaagccttggaccccattcccacccctcccgagatggatggggggcgggagggaggaagggaggaagagaagtcagggctgacttagttgtgtttcctactaagattctctcaaagtggagtcacagtattggttgggactacagtatcatctgaggcacaaccaggaaagtagtcacttccaaggtctttagaattataaaacatatagaaaggagagcttcagtttcctactggatgcccaaggaatccttagcccattatgccttagctcctatagtccagccagagagcttgtaacctttgctatttaagatgccataagtcctaaagagcaagttccagggcagccagggctacaacagagaagctctgtctcaaaaaacagacaaacaacaaaaacaaaaaacaagataccccagtggctgcttgccttatcaagttaggagtctccttagcaaagggttatttcatcttatcgttaatatatacgtttgttacatataacctgctacttgtagtcacatatacactcgatgggactagattatataagtaaaagacatggacaccaagaggtgggggaaatggaagccatctcaagtgtgtgtctgttatattggtgtttaatcctcaggtccataaagaaatacacttttttttttgtatgtgatttgaggcagagtctcctatgcagttctggctggccttgctcttatgtaaatctaactagccatagacttgcaacagcaccagtccttctgccttggccttccaagggctggtattacagctgtgtatgaccaagccagactttcataaaagtagccaggaaaggatttgcattgtgttgtcatctgtgatcctgggaacatacagacaaatcaacagatcagctatctatgccttagaccacagaggtgcatctttcttttgcccatttttttcttttagatagggtcttgtatacattctaggctgtgctggaactcactatccgccagcctcagctccccaagtgctggaattacaggagtgcaccagtggactggctctttgcttcacttttattatttattttacttgtttttagtttttagtttttgagacagggtctctctgcgtagcactggctgacctgaaactctctacgtagaccaggctggccttgaattaacagaacttcctgcttctacctcctgagtgctgggataaaaggggtatgccactatgcctggctctccttcacatttaatctatgccatgtcatcatatgttgttttaatttcactttattttttttagttttaattctcaatgaaaatatatagatttttgcagcagcgtgttctaatcataactttattttccagtaaaggaagatatagcaaccactggttctgtatccagaacgacgcactgtcagcattgccctctccagggtttccccctttgggatacacacactgattttatcagaatcctctgggtttggtgctgatgttcaaatccagctatagaaatgcttcactagtgagctacattcccagtctttgatggatcattccagtgttttgggttcttgtggttgttgtttggctgttctttaagaacatggtttctctttgcagcccagattgctttggaacgaactttctttctttctttctttctttctttctttctttctttctttctttctttctttctttctttctttctttcttttaacatacatttatttatttgtttgtttatatgtgagtacactgtagctgtctccagatgcaccagtagagggcatcagatctcattacgggtggttgtgagccaccatgcggttgctggaaattgaactcacgaccgtgctcttacccactgtgccatctctccagcccagctttggaactttctatgtagaccaggttgaccaggaactcagcagagatctgcctgcttctgccttctgagtgctgggattaaaggccagtgatagcacgcccagctgatggtttatttatttgttttatttctatttttcttggtgaactccaagcatgaacgtgctctacgaataatctctatcccgctctacctctcctgattgagacattatctagctgctagatatccttgaacgccctgtgtggcccaaactgaccttaaacttatgaccctcctgcctctgcctcctggtaccaaggaaggttacaggaatgtgccaaccattcctgggttggggacgttttgtctcttcctatggtggtggcatggaactcgtgtttatgctttaccgcagagcttgggcttctctctccagcccccttccctcttgccccactggggattcgtgctgggcaagacccctttgatggagctacccactcaaatcccccttttcacttttgattttgcgataggatctcattacattgtacaggctggccttaaactatttgtgtgtttttgctggtctagagcctgctttgtgtggggcacagcattttatgactttaatcccagccctcaggaggcagatctgcacatctctgtcaattcaaggctagcctagattacatagtaagttcttggacagccacggggctatgtagagaactgttcaaaggaaaaaagaaggctacatcatagatgagggctgcactgccacacccagtttatggggtgcccagaatcaaacctagggctttgtatatgctaggcaaaaactgtaccagatgaactacatccctagactgttgaactagatgtagtccagacaggccttgaagtggagaaccttcttctttagcctcccaagtggttggggatggcaagcctgtgccactaggcctggctctttcaaccttttgttgtatcatttaaaaaacatttacatatttgttgtgtgtgagtaggggtgcacaattgccacagaatacctgtggaaacgagagcacagtgagagaaatgaaatgaagggagcatttagtaagctcctacttaatatcacgcctgtagatctttaagtgtcattctgaggttgcagttgttagtaatagctttattctggcatgaggctaatccatagcaatatgaactgagctgccagtggccatgtcatctgggttcatttctctgtgaacatcgtggtccacagcatgcagccagtaattgtttatccatcaaacaagagtatagtctgttgtctccccaaggacagagaccagagcctgatttcagcccactgagtcaatttcccttgtctgtctggtaattcaacagcaaggtctattgccctagcaactgcccttatactgccatggcaaccgccagtgcagacttctgttctccactttgccccttggacatctccatggcgatgcgcaggatgaagagaaggccagagccctaattctgcgcctgcgtacagtaggagacagtggggcgggagtgggggggacggggacgcggggagggggcaggctcctggatgtgcgcagccgcagagcgctgctgctgtgcctaatacccatcgctgcgcacttgacagccagtccgcccgtccggagcccggctcgttggggcagcatggcggggtcgccgctgctctgcgggccgcgggccgggggcgtcggcattttggtgctgctgctcttgggccttctgaggctgccccccaccctgtcagcgaggcccgtgaaggtgcgacctcagtcagcagggggtgggggtggggtggggaggaagatgggggaaagtgttaatgaggtattttcacaggtatgcgcatagggcttggctagggtgacctggcctgcagctgacagccccgcgcaggccaggggcagtttcaggatgtgaggatgatgttgttcagggcgccctgccca

SEQ ID NO: 10 - DNA, 20896 bp, mus musculus; identical to SEQ ID NO: 9

SEQ ID NO: 11 - DNA, 31 bp, mus musculus
cgagacactccccccgtccccctcccgctcc

SEQ ID NO: 12 - DNA, 7094 bp, mus musculus
cggtgtgggacaaactatcgcactgttgccctggctcttctcctagaccccctttgtgagccaaaagagaaacgctgggcagatccattccggcggtgagggaggagaggcgtggagccaatatccacagggtttcttcgtgtcgcttttctcaggctggcttttgacataggatagggcatgtgtgaactcactgtgggctaagccagatggcacctggcttttccgcacggtcttttgatttgtccgatttaggttttaaaaggacacaagggtttctctggacgtgctttttgtgtcgaaccgagtgtcagtcaccctgtttatattttacttaaataacgtttgctagttaacactattgaagcctgacacgacaactcccccccccccctcccagacacggttactctgtggtgtagccctggctgtcctggaactcactctgtagtcttgaactaagaaatcctcctgcctctgccccccaagttctgggattaaaggcgtgaaccacccctgccaggcacatgacaactcttactgatttttgatagtaacaaaaaccattttgtttttggctcctggttctaggatttgagggactctgttcttcaaatctagtttcacgtagaactctctgagaatactgtattgtcagaaacagtcataggggctcagtggtagagtagttgatttaagcaagagacagattgtgggggacaggggacctagattccaaagccatttgatttttgataatgacaaaaacagttgtattgacgcttgcttgtaatcaagagcactgctctgccagtagtaaacccatcgttgcaaggctatgtggtgagacacctcccccatcccaaattgttttctcacttttgtaccacagatagatttacaaaccttttcttttggggtttgtttgttttgagacagtatctcactatagaaccctggctggcctcgaactgactagactaggctgacctctgacctcagagtgctggtattaaaaggcacaaactttctttgtgggacagggtctccatttagagcccaagttggactgccaacttgtgatcctcctgtctcagccttccaagtgttgatcacaggtgtgcagaaacacatctggttttcctttctggctttctggggaatataaaaagtgtcagaactaatttgttgtcatctaaggtgttctgcatcagtcctgagcttccctgtttggttctccaagcagggcagggtctcacattaacccaatcttttccttcctgcttgcagcccatggcgaattgtggatgattgcggtggagctttcaccatgggtgtcattggtggtggagtcttccaggctatcaagggcttccgcaatgcccctgttgtgagttgggccttcctccagtggtgtgggaatctgcggtcttgctgacataggagtactgctctgagcatactgaacattctgttgattgttcacctactgtgtgttgggcctggcttctggatttagggtttgagggattctgttcttcaactatccagctagaactctggaaatactgtactgtcagaaacagtcttaggggctagaagtatttagctcagtggtagaacagttgatttaagcaagtgggtgggtgtgtatgtgtgtgtggggtgcccacagttccatccttagaattagaataaaaagaaaagggttagcatcaaattttcaatgtgtatacaccgtagattttaccacaagacagtctttgggataaaattctatatggatggtggtgccacacacctttaatcccagcccttgggaggtaaaggcagtcagatctgtgagttgaggccagatctggtctacagagtgaattttgggacaaccagggctacacagaaaaaccctgtctcccccaccccccctcaaaaaatcctctatacaggaaaatgacaggagttgggcagaaagaaccttttttttttctttttctttttcttttttttttttttttttttttttttggattttttgagacagggtttctctgtatagccctggttgtcctggaactcaccctgtagaccaggctgccggcctcaaactcagaaatctgccagcctctacctcccaagtgctgggattaaaggcgtacgtcaccactgcctggcagaaagaacctttaagttgaaggagagagtaatataatacctttcctttgagccccaccccttgaagatagaaggctcattggatttggtagcaagcatgaggcatgcttactatgcctctaacagtggtggaggtgatggaacacaagacaggcatatatatccctagagcttgctggccagtcagcctagctagaagttggttcagtgagatactctgacttccacatgttcacacacctgcacggtcatgtgtatattccacacagacacacacaaaccgttttccgcagcacaggttggcacacaacttcaaatcctcctgtcccggctttccaagtactagcattccaggcatctggcagcatacctggttctgtagcctttctgtcttgctcggagtcgtcctcagctcctagaactctccttcctgcacctttgtccatagttctcatttttgggaatcttcgcacgtattgcgccctcttctttttttcttctgcactaaggaatggagtctggtacctccatcttcccatcctgcatgctaagaatattgccgagctgcagcctcagcctccttcacaggttcctctaatgcaggttcactttgctccttgctcactgtcactcttcctagggcggttgttctttttttggtatttcgagacagggtttctctgtatagccctggctgtcctggaactcactttgtagaccaggctggccttgaactcagaaatccatctgcctctgcctcccgagtgctgggattaaaggcgttgccaccacgtccagcagggcggtggttcttaaccttcattttttctttcatttatttatttaactatttatttgtgttttcctattcactttacatcctgctcactgcactaccgatatccccccaccaccaccaacctccgcagttctggcacatcaaatgtctatgaggctaggtacttctctcccactaaggccagagaaggcagcccagctagtagaacatatcccacagacaggcaacagcttttgggatagccccagccctattttttgaagcatgatttctctgtgtatccctggctgtcgtggaactgcctctgtagaccaggctggcctcaaattcacagaggtccacctgcttctgcctcctgagtgctgggattgaaggcatgcgccaccccaggtctcaacctaattaaagggtccaagttttgtgaccctttaatacagttagatcctcatgtagtggtgaccctcaaccataaaatttcattgctactacataaaagttcatgtaattttgctactgttatgaatcacaatgtaaatatctgtgtttacaatgtcatggtcttgggtgacccccgtggaagggggtccaccaaaagggagtcagaacccgtgagtagaaaagcgctgctctagattgcattttgctgcctgaagctatcttacttgccactactgtgtacacactctgagacccctgcatataggatgtaacctggcatgtgtgcctgctcattgtatattgagtgagtgaatgagtgaagaaatgaaactgagcaacctcactctgagaatatctctgttggattttctctccatcctcctggttctttggctgctgctctgcatctagtagctttcccatgccttctttgttgcagtgctgggcatagacgaaccctgagccttgctcattatggacacatgctctaccactgaggaccccagcaccccttcctttttataaagcctgcaaccctgcctgccagtgagtgctcttacccctcctctaacacctctccttgctttctccagggaattcgacaccggttcagaggtagtgtcaatgctgtgaggatccgggcaccccagattggaggtgagatcgtggaaccataaagatgtgttaggaactttaagggtaattgatcctttgaaactagactgtaagttataggtccagattctaactcaaagtctgactgcaacttccccacagtctaatatgaaagggcacgaatacgtattgcggttgatttgtttttgagacagggtctctctgtatagccttggctgtcctggaactcactctgtagaccaggctaccctcacagagattctcctacccctttctctacttcttccttctaagtcctgggattaaaggggtgcactcccaagcctgggggcttctgcagtttaagtccagatcctggctcttctctgttaggggacctgatgctagtagcagtcctcctccaaacctcatctgataattgaccacccaattggcaggggtttgttggtttgttttttggtttttggtttttcgagacagggtttctctgtatagccttggctgtcctggaactcactttgtagaccaggctggcctcgaactcagaaatccgcctgcctctacctcccgagtgctgggattaaaggcatgcaccaccacgcccggctccaaagtggtttttttaaacactataaacatatgcaattgtttcctgtattatagtagagatggattgagcatgctagacaagtactctgtcactatgacagattcctaacactgaatatttcattttttattaagagatggaatcttgagactgggaatgtagtttagtttgtagagtacttacctagcagcacaaagccctgggttcactgcataaagtctgggtatgatggtgcccacatgtaatcttggcattttagcaatggaggccgatgaatcagaacttcaaggttatccttgactacatagccagtttgagtgcagccttgacttaatcagatagtgtctcaaaaaagagggagagatgggggtgtcgggacgtggtaaagcagttaactaacctgtgaaaccctgaggtccaacgctaccaccaagaaaacaaagctacctgctgtagctcctccacctcccatgtagctggggctaccggtgcctaccaccacaccagctagttttatagcaacatgtttggttctcttgcatttttttactgtttcatgttatatgaggtcagctatggaactgtttctggtatcgtgacatgctcaaagagttgtatgtagcttttgaagccttttggatttctagattatgactgtttaataatatatattgtgttctggctttctgccctcttttccttctccctgaaatcaaaaccagaattccaactccacatggtatttacagggtgaaagttgctgcattgaaagctgtgtgaacacgcctttaatcccagtacttgagaggcagagacaggtggatttctcagtttgagtccagcctagtctatagagtgagttccaggacagccatggctacacagagaaactatgttttgaactgccccctcccaaagaaagctgtatgagaggttaatgtgcatgtgtccatttcccaaataaaagtgaaaggattaaccgggcgtggtggcgcacgcctttaatcccagcacttgggaagtagaggcaggtggatttctgagttcgaggccagcctggtctacagagtgagttccaggacagccagggctacacagagaaaccctgactcgaaaaaccaaaaaaaaaaaaaaaagggaaaggattgctgggtggtggtgtggtggcggatgcctttaatcccagcactcaggaagcagaggcaggcggatttctgagttcgaggccagcctggtctacagagtgagttccaggacagccagggctatacagagaaaccctgtctcaaaaaaccaaaaaaaaaaaaaaaaaaagagagagagagaaaaaaaaaagtgaaaggattttgatgataataactacagccccaatcagatgtggaacctttcacagtgagaaagatggactatacctagttctatagctggactttcttccttcttgtatttggtgctaaggttgtgccccatggcctcctgtttttgagacagcctccactgtataggtgtctaagcctttgcggtcctcctacctgagcttcccaggtgctggcatcatactatatcctggtcatatttatttgtttagtggggggaggggatcaccctatgcaagcatctaccacagagccacatctccggtcccagcactctttcttggccagtcttcaggccttggaagtttccagatgttgagctacgtggagtctcagattgtgtgattcagactcttatttcccctacaggaagctttgcagtgtggggaggtctgttctccaccatcgactgtggcctggtccggctacggggcaaagaagacccctggaattccatcagcagtggagcgttgactggagctgtgctggctgcgcgcagtgagtgccgccagcctctcaccccagtccttgccctgtcctgcctgcccttcctcagctgtgtgtctttccgcctcccaggtggtccgctggccatggtgggctctgcgatgatgggaggcatcctgttggccctcattgagggtgttggcatccttctcacccgctatactgcccagcagttccgaaatggtgagaacttggtgggcggtgggcagggagagtcaggaagcactgtcaaccctctccatgcttcctcgcctcattacctcattctcccttctccagcacccccattcttggaggaccccagccagctaaccccgaaagagggatctccggccccaggttatcccaactaccagcagtaccactgaggaagccgctgcctgacccccgccaccgtgggagccactcctcagttccctcccggatgatctacctccaagggaggactggctcctacatagccctgagaggccttcacagagggcctcaattctactctctggttttgtggtaggggtggggacaccccagcagccttgtcatatgggttcccttt

SEQ ID NO: 13 - DNA, 713 bp, mus musculus
atggcggccgccttagctgttcgtggagcgggatctgcagtggtctttgggcctgaggctctcaccccagactgggaaaactgagaagtctccacagggaccatgatcatggctttgtaatttaatggaggcgtggttctaggagcagactccagaataacactgggttttacatcgccaatcgagtgactgacaagctgacccctatttatgattacatctgctgctgctcaggctcagcagctgataccggagcagtagcagatgctgtcagttaccagcttggtttccacagtattgaactgaacaattctccactagtacacatggctgccaggctctttaaggagatgtgttaccggtgcagagaagatctgatggcaggaatcatcattgtaggctgggaccctcaagaaggagggcaggtgtcctctgtacccatgaagggtatgatggtaagacaatcttttgccaccggagcctccggaagctcatacatctatgactatgttggtgctatccatcctgaaggcacgaccaaggacgaatgtctgcagttcactgccaatgctctctctttggctagaaaacacgaaggctccagtggaggagttatccgcttggcaaccattcaaggatcaggggtagagcggcaggtgctttgaggagaccagatccccaagtttaccactgccactttgtcacctccctga

SEQ ID NO: 14 - DNA, 171 bp, mus musculus
atgggtcaccagcagctctactggagtcacccacggaagttcggccagggttcccgctcttgccgcgtctgctccaaccgccacggtctgatccgcaactacgggctgaacatgtgccgccactgcttccggcagtacgcgaaggacctaggcttcataaagttggactaa

SEQ ID NO: 15 - DNA, 171 bp, mus musculus; identical to SEQ ID NO: 14

SEQ ID NO: 16 - DNA, 820 bp, mus musculus
atggcagcagctatgtcagtgtttcagccaccggtcagaggcttttctttttataattgccacaggaatgatgtcttggaagctgagtttgaaaaaaaaggggttcaagctcctgaaagcttggaaaactgtcactacgatcacaggggtggtctataagaatggcatagttcttggagcagacacaagagcgactgaagggatggttgttgttgacaaaaactgttcaaaaattcactttcatacctcctaatagttattgctgtggagctgggatagctgcaaacacagatatgacaacccagcttatttcttccaacttggagctctactcttcactggccaccttccgagagttgttacagctaataggatgttgaagcagatgcttttccggtatcaaggttacattggtgcaaccctagttttgaggagagtagacagtactggtcctcatctctacagcatctatcctcatggatcaactgataaatcgccttatgtcactgtgggttctggctccttggcagcaatggctgtgtttgaaggttaaatttaggctggatatggaggagaaagaagctagtgagtgaggctattgcagctaagcatctttattgactgagggtctggaagcaacattgatctgcgtgttatcagcaagagcaagctggactttcttcgttcatactcagtgcccaacaagaaagggaccggatttggccggtacagatgtgagaaaggcactaccgctgtcctcactgagaaagccacccttctggagattcgggtactagaagagacaatggatacttcgtga

SEQ ID NO: 17 - DNA, 820 bp, mus musculus; identical to SEQ ID NO: 16

SEQ ID NO: 18 - DNA, 2794 bp, mus musculus
gggtgatgaccacgctaacgacccagtgggatttcgcgacatcacctgtgtggagggacttcgtgtctatggcaactgtcacctggtgggcggaactagattttctctgcctgggacgctgacattccaagcccttgccctgcaggctcccgcaggcagacaaaccaaagaaggaagccagggaatggccgcggtgtggcagcaagtattagcagtggacgcgaggtgaggcgtggggttggagcccatgggagaggaacttactgtggtgcatgagcaatggcgataagtgcagctgggcggagaagttggctggtgcggctgcgtgagcatgcgcagtagcttggtgtgggatagtcctgcggttaagtggcctgggctggagccggttctaaagagcatgctgggaaaatgcggtttgaaatggacatgcgcagactgtctttgagtgggtagtggaagtcaggctggtgacttcctatctagtccctcattgcttatcctcttccccaacttttctcgatatcactaccctactattattacaattgctaccccatactaacctctaccgttatctgaccctaacctccattgttgtacattaccaatctgacgtatgtcatcatgctagactgatattacagctggcccagactgaccccaacagagctgcaaattgactatattgtcgctagagtgatcttttcatcataaccactaattattgcataattgccccccatcacaatcccaagagaaatccccctttgctgctcttgttcactcttaccatcccagtcactgccaaaccttgtaccacctcgagctgatttattccctctgtcctgtgcctgctgcctgccctgcctcctggaccccacaggtacaacgcctaccgtacaccaacgtttccacagtttcggacccagtatatccgccggcgcagccagctgcttcgggagaatgccaaagctggtcaccccccagcattgcgtcggcagtacctgaggctacggggccagctattgggccaacggtacgggccactctcagaaccaggcagtgctcgtgcctatagcaacagcattgtccgcagcagccgaacaacccttgatcgaatggaggtgagctcctagctgcaccacccgccatgtatctcccctgcctctgtagtcaccatagtttttggtcaaacatcagtgatgtacaaagtactgttccaggtcagtagaggactaaaagggaatagagaagccaagtcaatgaacattgataagcagacagtgaattagataaacacagagcaggtaagactgatgagttgataatttaccatggtatagtaagcaatgcaaagatagtaacatacaacagacttaaaaagcaaaaaggaacacaagtgtttggtgcatggatatagttcagtaactagcgtgattgcctagtatgtatgagactgatggttctattctcaacatggccaagaagaatgaaaagtcactgctttgagctaaaggagggagctgtgcttaatagggaagacttgtctggggagggaacaccgaaacctgacagaagtgagagactgatttgagtgcttctctgggaagaaagtagtcatcccttgtgaggaaagcatgtatgtactaaggatgtttggaacaggaaaggaaggacagaaacaaaggcactagtgaagaaactgttgaaaccacacaagtgagcagtgacagtggtggctggcgccatgtgtggtgacgagaagtcaggccccagatttaagctcatctcagagattaatttctatttatttatttatttatttattatatgtaagtacactgtagctgtcctcagacactccagaagagggagtcagatctcgttacagatggttgtgagccaccatgtggttgctgggatttgaactcctgaccttcggaaaagcagttgggtgcttttacccactgagccatctcaccagcccaatttctcttctttttgagacaggatctcacccagactggcctcaaattcactgtgtagccaaggcaggccttgagcacggtgaccttcctgcctcagtttcccaaagtgctggaattagaggtatgcaccatccccaaccctcttctctttgcaggactttgaagatgaccccagagccctgggggctcgaggacaccgccgatctgtcagccgaggttcctaccagctgcaggcacaaatgaaccgtgcagtctatgaggacaggtacataccagaggcaggcagggggtggagattcaccaggaggagaggggccctgggacgtggcagtctgaacacccatacctacctcctatcaccccttcccacctcctgttggggctcaggcctcctggcagtgtggtacccacgtcggtggcagaggcaagtcgggccatggccggggacacgtcgctgagtgagaactatgcctttgcaggcatgtaccatgtttttgaccaacacgtggatgaggcaggtgagctaatgggtggtagggcccatcaccaaacatttgttcaaacaactacccaaggcatccttttctagaatgcaaggcctctgacaccatacctcagaaggaggaaatagcactgataaaacctttagcaaagccaagcagtgatggcgcacacctctaattccagcactcgggaggcaggtggatttgagttcgaggccagcctggtctacagagtgagttccaggacagccagggctacacagagaaaccctgtctcggaaaaagaaaaagaaaaaaaaa

SEQ ID NO: 19 - DNA, 1517 bp, mus musculus
cgatttgctctgtgctccgcagctctttctcgttgcaggcagccatcttgcctggagcttgagacagggagaagagagagaaggaaccggtgacactgggctcagggtcgccggggggggggggcgcctcaagagctaggggtagccccggaggtggtcctggatcctgagctatgctctaggactagaaaagggaaggcggagggcagaaggcttgatgggtggggaatgtcaaacaagacttgctatgggggggaggggcgttgctacggcaactggagagggcggggtcatgtctgaactgctgctgtgagtcaccggagtgctgcccaggaaaggcagggctggggtgatgaccacgctaacgacccagtgggatttcgcgacatcacctgtgtggagggacttcgtgtctatggcaactgtcacctggtgggcggaactagattttctctgcctgggacgctgacattccaagcccttgccctgcaggctcccgcaggcagacaaaccaaagaaggaagccagggaatggccgcggtgtggcagcaagtattagcagtggacgcgaggtgaggcgtggggttggagcccatgggagaggaacttactgtggtgcatgagcaatggcgataagtgcagctgggcggagaagttggctggtgcggctgcgtgagcatgcgcagtagcttggtgtgggatagtcctgcggttaagtggcctgggctggagccggttctaaagagcatgctgggaaaatgcggtttgaaatggacatgcgcagactgtctttgagtgggtagtggaagtcaggctggtgacttcctatctagtccctcattgcttatcctcttccccaacttttctcgatatcactaccctactattattacaattgctaccccatactaacctctaccgttatctgaccctaacctccattgttgtacattaccaatctgacgtatgtcatcatgctagactgatattacagctggcccagactgaccccaacagagctgcaaattgactatattgtcgctagagtgatcttttcatcataaccactaattattgcataattgccccccatcacaatcccaagagaaatccccctttgctgctcttgttcactcttaccatcccagtcactgccaaaccttgtaccacctcgagctgatttattccctctgtcctgtgcctgctgcctgccctgcctcctggaccccacaggtacaacgcctaccgtacaccaacgtttccacagtttcggacccagtatatccgccggcgcagccagctgcttcgggagaatgccaaagctggtcaccccccagcattgcgtcggcagtacctgaggctacggggccagctattgggccaacggtacgggccactctcagaaccaggcagtgctcgtgcctatagcaacagcattgtccgcagcagccgaacaacccttgatcgaatggaggtgagctcctagctgcaccacccgccatgtatctcccctgcct

SEQ ID NO: 20 - DNA, 21476 bp, mus musculus
gtcctacagcacctctgcgcctgcgctctggtgcaaggtggggccgcgggcgcccgcactgttgggtgtacgttagggtacgggtaactatcggttatcacctggacagagacgacagcggcgggatggcaaccacctccgcggcctcggactcggcgtgctcggcagcgcccccgcccgtcggaggtgcccaggcggccgcggcggttgaggaggaggagcgtgaggtggtacgggtccgagtcaaggtgaggctagcctgcttgggcgcccagtggacgaaaagaccgtaactgtcctaggatagagcatcagacctgaaatttggggcgtgacttggagactgggggcgaggctggagagcggaattgatagaatgaaggcgtgggttttggggacttgtcgttgggtgtggaactgtagaggagacagggccaatggagtggatgggtggagcctacgggtagagaggtgggttgtagggttaccggaggggcctctggagtccagaggaaggaaggaggtgctgtcgctgtcagaagggatagtcctaaagtcagtcaacaaatagctattgagagttcacttttgtccatgtcccacccctgagcccacgtgcttgtgggagggggacaaaaacaattaaatgagatattttgaacattggtgaatatcaggagaaagtgataggaaaggttaggatctctagggagttactttacccaaagctgtataggaaaatcccctaaagaggactcaagtcacagagacctggataataataataataacaaaatgttagcatatgcatttaggatgggagaagagttctaggtagagggaacacctagatgagtgtggtatgttcctgtaggttcccatattgttggagaaggaagcctgggggcaaaagtaatagacaatcaggagggagaagggcacataggacagcttgtgacatataacacactctgaggaaggaacccgttgtgatacctgcaagcagtgaccggtggctcagactggagtgccagagatcacttttggggtgttagcgctctaaggcaaaggttttagtaagccagatgaagtgggaaggatgttcactctgagagaggtcagcacacagaagtctggaaagcatgtactcaaaggaactctcaacagtttgataccagtagagccataaatacatctcagagtggagggagggctagctccagcacctaggtttgctgttgaagaaggatctgagcaacaaacagtgttacagggagatttgcactatggggggtgggggggagtcactgatttgattgtgtcaagctggacatggtgattctggcaaccatatttaagggactctggaaggactggacacctggactactgcattagccttcgttcctgccagtctgctttggcagagcaaacatggaccctgtaaattcaaaggacatatcatcttttctctgcgcagagacttcctgtgacttcccctcgcccagaacaaaaaccaagaacatctcacctaaaacctggtccctcccctgtcttcgactcctgccttctgccactctttaccttacccaccctttccacacggtgatgtgccccctcatggcctccccctgtcctctttccacagaaatgtgagagcttcttgtcccctgagttccgctcttttgcggtggatcctcagatcacctcgctggacgtgttgcagcacatcctcatccgagcctttgacttaaatgggtgagtgggaagatgaagcagggcgctcatcttaaaagtcactgccaggtttctggggtttggttttgttgtttggctgcttttttttccaaataattccacagtgaataggtgtatcttgcttggaatctgtgagaaaagtcctaagaaaaaattagcagtagtatttctgggctacttaaaaactttcaaggaatagctgggtgatggtagtacacacctttaatcccagcatttaggaggcagaggtaggtggatctctgtgagttcaaggccagcctggtctacagaacaagttttagaacagccaaggctacacagagaaaccctgtctcaaaaacaaacaaacaaacaaaatccttcaaggaatgttttcaaaatgactctccagacaggttttacctgcacagcacagaaaaggttttgctggatatggtggtccacacctttagtccggggactctggaagcagaggcacacacatctctgacagttcaaggccagcctggtctacagagtgagttccaagacagccagggctacacagagagacctctcaaacacatacacacacaagacaaaagaaaacatttgtttcaccaagcatggtgatatcagtactatggaggctgggacaagaggatcaaggccactctaagcaacataatgaaactgcctcagaagtataaaatcactttctttcttcctgtcctcccagacaatggtttcgcaaaatttgccagtctgatagctgagaattgatatcacttgggggcaggtgggttggttatcttgttgtgggggactgaatttaaatagtgtgaaattgatccatatttaggatgatccttggtttacagtgatcatcaagtaaaatatctgtgtatatagttgcacaagtggatctgaatagatttgtagttgcagttgaacatttgtgcgtttacatcttgtaaaaaataacaaccatacagactgcttttttttatgtagtaagaaggctgctttcttccacttctatccctcaactacactgttaccatccccagaggggaaccaacattctaccagttttcagtgtaccctccagatataagcaggtgtgtatctgtttctgtgtttgtgtaacaaagtggatataaatgacctaacctcaggatacccataatccttagcagagttcccagcagagagaaggaagttgttttcagtacctttcacattgcctgccttgttttgtaaatctgatcttgaagccaatgctggggaactggggatcccaaaagctcccttatatcctttgtccaggaagaagaactttggcatcagctacctggctcgagaccggctaggacaggaaactttcctctccctcctttctgattgggacctcagcacagctttcgccactgcctccaaaccttatctgcagttgcgtgtagacattcggccctcagaggacagtgagtacccagaacgtttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttttttaattatgtcagaagacctgggttcaatcatcagtactgcccccaaaagttttattatagtaatggtatttgtacactttaaactcaagttcaaagctagcctgagctataaagcaaccctgtctccaaacagaactacaaaataattcaggttttgggttttaaaatttcatgttaggaatattcagcctatattatcgcattggtaattaatttgaaagcatagcagtatggtaatggtttcagggttactggaggaaaatatctgtgctcttgggaaaaacccatttacacgtgaaggggtatagtacaaggtgtttgaaggagttgtaggagagtgtgtttccatggagaaagggtaagatgaagcaaatgtggtagaaaagctaatggcttctggtgagggctataggcacagggtgtctgtcagtctgctcgcttttgcaatgcaagaaagccaggccttgctcactcacatcaggccttcactgtgccacggagctatagagccacctccagtgtgcattctggtaggtttctgttggttgtggtgggcttttgtctggttggttgtttttgttgttgtttttaaacataaagggtgtttcacctgcttgtatgtctgtgtgctacatgcatgcttgatgcccgaggaggccacaagaggacataggctctcctgacctggaattacagatggctgtgagcccacttctgggttctgggaatcaaactctggtcttcttgaagagcagccagtttctttgagccatctttccagcgccacacattgtactcgtttttaacattttatgggtttgaatttgtttttgtttgtggcttttttttttaatagttgtggtatatagccctgggtagctgggaacttgtcatgtaaattttgctggcatcaaacttacaaagataccttctgtctgtgcttccctagtgctaggataacatagcccaccatgcttcactgtgttactgcttggttttggtttggttctaagaattgactacaggccatatgtttgctaggcaagtgttataccactgaactatacctgtttgtttgtttgtttgtttgtttgttttgttttttgagataggtcttactacatttcctgggctgacctaaaacctaacagttcttccacccgacacactcagcactgctcaacacccagcaagtttttaaaatcaattttgtttatttagtgtgtgtgtgtgtgtgtgtgtgtgtgtgtgtatgcatgtatgcatgagcacatgtgcacatgtgtgccatgacacctatgcagaggtcagagaacagcttgtgggagtcagctctctcctgtcatgtaaatcctggggttcacactcgggttctcaggcttggcagcaggtgccttaaagaaccactgaaacgtcttgccaactcagcaagtttttgtttcatttttgtaataacatatgttggagccgtacaattcgtacccttagagaacttttgtacctacttggaatgactgaggcattttattcacatcgtgtagctaaatggaatacctggacatttaatgaatagagttaattgtccccataatcttacagagctagagtggcgcacgcctttaaccccagcactcgagaggcagaggcagccagatctctgggagtttgaggccagcctggtctatagagtgagtactaggacagccagggctacacagagaaagcctgtcaaaaagaaaaaaaaataacaaaacaaaactacatggcaaccttgaaaaagaggaagaaagagaaggacaaaaagaggaatgcaggaggaaacagaggaagaaagagttgaaagaaaggaaagataatagggcacaggaaaatgtgtcaataacttatttcccggcctccatttcttcacctctaaagtggaaacagtagtgtcatttaaacacataaagtcttcctggctgaataagcacaaggccaacccagctgtgtaagagctgagaggacgccagtggagcagaggtgatgacacctgtctctttcacagaaactcatttgaaaagtccttttctccatgtctatatgtttatgggtgcccgtgtgtggatgcatgggtgtgcctgtgagcagaccagaggttaacgttgagattctcaatcacccttcgccttattttttgtttgtggttggttggtttgttctttcaaggcagggtttctctgtatagccttggctatcctggaactcgctctacagtctaggctgctttggaactcacagaaatccacctgccctctgccttccaagtgctgggattaaaggcatgtgtcaccatgcctggtatccaccttattatttgagatagtttctcattgaacccagatctcaccatttggctagattggctggtcagcaagcccatggatcctcctagcttcctcccaagagctgggattatatgtgtacactaccgtgtctctcgttttttatgtcggttctggaacttactagggatccatgcccaggccctcattgcttatatggcagccactgagatatcttcataaccataaacttacctataagatgcttttccataaggtagagagatggctcagcagctgggagtactggctactcttctatagaacctgggtttggttctcagtatccacatggcaattcaaaccagtctgtaactcttgtcccagggaccttgacaagccttgcaagcatgtgtgcagataaacctctcataaaattaactctccagctaatgacgaatcagttttcccctcactatttccatctcttacttgccaggttccagggtaagcgtggtctgtttctgaatttttaaaaattttcttattctgatctcttcatttacaaatgtccttaaaaggactagcaagcaaaattgatggagagaaaaaaacagctccctgaagccatgggaggacacaaaaatgagctgccttaaacttgtatgatacttattttgtatatgtgtgtgtgtgtccacagacataccaaagaatgcatgtgtaggtcagaagacaactttcagaagtcagttcttccttctctcgtgggagtcttggggattgaatttagctcatcaacctactgagccatgctgcatgggctcacatgcacctgcatgccatggcatgcatggtacacagaggacaacttgtgggatgctgtccttccaccatgtgggttctgcaggttgaaccaggtcactagacttggtaacaggcacctctgcctgttggtccatctcactggctgtgtggggccttcctttcctttgtttcctaacaggctctaactgtatagttcaggctgccttggccttccttctaggtgctaagattccaagtataaaacaccacattcaggttatgaaagttttagtgtttcctttcataaaaatgttactttctggatttgtttcagtactgggaatggaagccagagccttgcacatggtagacaagcacttttccactgagccatctccccagccctaaaatgtttcatgaaagtcttataagggttttcttcttgtttgcatatgtgttcataggtgtgcatttgtgtgagtatgtgatgtacatgtgcaggagtttggagaccagggatcagtgttgctcgtcttcctccatcacttgtccatgtaactctgccaacagggtcttttactaaaagttgagcctgctgactggctccatggctggccaggaagcagaagtaagatgcttctgcttttattacttcactgctccaagtacaggctttcgcctatcatctgtttgcatgtgtgaatctgtgtgtgtgtgtgtgtgtgtgtgtgtgtgtgtgtgtgtgtgtgtgtgtgtgtgtgaaacacatgtggaagtcagaggacagtttttcaagagtcagtgtttccttcctcttcgttaaggccgggtctctttttctcttgctatactgtatactcctaggctagctggcccggcaatttcaggcaattcttttctctactagcctattttgccacaggagtactgggattatagatgggaatgcataccacaacatctgtctttttgaggctagaagtcaggtcactggacttgagccatctcactagcccacccctggctttagcctgcagcagagatacaaactgttatacttataccgcaagtgcttcaccaattcagccaacttcccagggcctattcttatttaactgaattaatttgtcattttaatttgtctccattaaaatgctaaggagaggactaggtgtggtagcacatgcctttaatcccagcactcgggaggcagaggcaggcggatttctgagtttctgtgtagaccaggctggccttcaactcagagatctgccagcccctgccttcctctgcctcctgagtgctgggactaaaggcatgtgccgccactgccccagcgaagttaaaattcagggcctacaggaatgtttagtgactcagagaatatacatttgtagcagaggacccaagttcagttcccaacactcaggtcaggtgaagtgtctggtctcagtgagcaccggcacctcatagactttcaactgaaaagctttttaatatgtaaaagagaaattaatggagtgctgagagagagagagagagagagagagcgcgcgtgagagcgtgtgtgtgtgtgtgtgtgtgtgtgtgtgtgtgtgtgtgtgtatgtgtgtgtatgtgtgtgtatgtgtgtgtgtgtatgtgtgtgtgtgtgtgtgtgtgtatatatgtgtgtgtgtgtgtatgtgtgtgtgtatatatgtgtgtgtgtgtgtgtgtgtgtgtatgtatatatgtgtgtgtgtgtgtgtgtgtgtgttttccaaattgccaagtctgtctcaggagagcagagaggagtgagtgaggtgccatgggggagccccttggttaaaagcgaaaggataccatcatggagggagcctggagactagcacagatctgactcgctaaccaagacctaaagcaagagcccaggtctctttggccagaggtaaggagaaaataaacacttttgtctaggaggaaataactcttcaagcccctgagggaattctggcttctgtctaaatgcctgatcttggtaaaaggaatttcttggggaaactgacatgaaactgtttagtaacctactaaacacattcaccttattaaaaataaaaaaatgaggcccaggggactgaaagtttgtaagatcagagggtcctgtgctgtagttgagttcaaggccagtgtgggcaagtaaacagtgcgctcaggatttgagctacatttgctaggccctgaattcagtgcctagtattgcgataataatcagaaatgagcgtgagggccagcgataaagcttagtgatagagcacttgcctagcattcgggagaccctgggtttgattcacagtatcacagaaaataaacagaaatgaaaatgtttttaaacaatgctaggccgggcagtggtggcacacgcctttaatcccagcacttgggaaacagaggcaggcagatttctgagttcgaggccatcctggtctacagagtgagttccaggacagcgagggctacacagagaaaccttgcctcaaaaagcgaaacaaaacaacacaaaagtcctacatactctagggaacactatgcttaactttatacatctctctcacacacacaccttctgcttgagtgatcagtttgctgtataaccttacaggtcctttactctttacaaacaaatttagtcatatgtagggacatgagagtatattcatatttatatacaattggcttatgatctacatgttatactctttttataaaacgttttaaagctatttgtattttatgtacattggtgttctgcctacatgtatgtctgtgtgagggtgtcggattccctggaactggaattacaaacagttgtgagctccaacatggttgctgagaattgaacccaaatgctttggaagaccatgatatactcttaagtgtcgagtatatggactgtgtagtataatattgttaatgccattctttaaaaataaaagatttacttaaatatacacagccttgtgcctgcatgtacacctgcagcagagggcatcagatctaattatagatggttgtgagtcaccatgtggttgctgggacttgaactcaggacctctggaagagcagccagtgctcttacccactgagccatctctgcagccctgttaatggcattcttgagatcatattgctttccttatttattttctgtgtataggtgttttgcctgcatgtgaatatgtgcaccatgtgcatgcctggtgcccagggaggacagaagaggattagagatcttggggctggagttacagatagttgtgggctgcagtgtgtgtgctaggaatagaactaaggtcctctattatgagcccagtggctcataacagctgagccatctctccagccccttgagtccattttcatggctctgaaagcaacaagcatgtgactcagtggaaggttgagtctctctgaggagcccatttcgcctctacacttggtagattatcaagccaggaccttgaaccaatttggacatttgtgataattttctttatattattattattattattattattattattgctactaatagtttccttgtttgtctgtctctctctctatctatctgggttttttgagccagggtttctctgtgtagccctggctgtcttggaactcactctgtagaccagtctggcctcaaactcagacatctgtctgcctctgcttcctgaggccagcctggcctacacagagaaatccttgaaaagcaaaaaaaaaaaaaaaaaaaaaaagaaagaaaaaaaaactgtctggggctggagatgtaacttaatagtataagaatgcttatacagggctggagagatggctcagtggttaagagcactgactgctcttctgaaggtcctgagttcaaatcccagcaaccacatggtggctcataaccatctgtaatgagatctgacgccctcttctggagtctctgaaaacagctacagtgtactcacatatagtaaatgaataagtaaaaaaaaaaaaaaaaaaaaaaaagaatgcttgtacagtagtagtatgcataagtcctctacaatgctcaccgaaacagctgggtagaggaccacatgtctgtgatcctagcaatcaagaagcagaaagaagcaaagacaggaggattattgtaagcccctgcaatcgggctgagacagaaggatttctgtgagctcaaggccagcttaggctacataatcagaaactttctccctctttctcccccaacacaaagggaaaacaattgagatagttgcgagattgaggcagagatgacaagtttaagacctgcctgcgcagtgggttcatggtcagcctaggcagcttagtgaggccatctcaaaacaaaaaacaaaaagctctagggctggggctggatgctggctcagtaagaggactcgctgctactgcagaaacctggcttcagttcccagcaaccatatgctagcttaaaactgtctttaactcaggttccaggggctctgctgccttcttctagcctccataggcaccaggcttgcacaaagtgtacaagcatgcgtgcaggtaaatccactcatacacatagagagaaatatattttagaaagaaagaaaaggtatgggctggaaagctggctcagcagttaagaactcatagtgctttcagaggatctgagttctgctgcttcccagcaccaacaatgcagcagctcatggctgcctgtaactctagctccaaagacttttataccttctttataccccttaggggtgtgtgtgtgtgtgtgtgtgtgtgtgtgtgtgtgtgtgtgtgtgtgtgtaccacctacatgcctggtgtccttggaggccagaggaaggcattggaccccttagaactggaattaaggtgattgtgagccactgtgtaggccctggaagtacaaggacctcgggaagaagttagtggtgtttgtttgtttgtttgttgtttgtttgagacagggtttctctgtatagctctgtatagctctggctgtcctgaaactcactttgtagaccaggctggcctcgaactcagaaatccacctgcctctgcctcccaagtgctgggattaaaggcatgcaccaccacgcctggctagtggtcttaatcactgagccatctctctagccatatatatgtatgtatgtgtgtgtgtgtgtgtgtgtaactatatatatataacacacacttttttttagatggggtcttactatgtagccctggctggcttgaaacttacagaggttcaccggcctcttcttcccaagtgctgggatttacatagggctaacactattatgtttaatgacagtgatttttgtggtcagttttaatttttaaaaaagcctttgtcatcctcctgatgttctttttcttagctattcttaaacatgaatttgttcttgtgaatcttaaaataatttcatgcagtttcagggggaaaacattagaattctggggttttttttttttttgtttttgtttttttgtttttgtttttgttttttgttttttttttttggtttttcgagacagggtttctctgcgtagccctggctatcctggaactcactctgtagaccaggctggcctcgaactcagaaatccacctgcctctgcctcccgagtgctgggattaaaggcgtgggctaccacacccggcctttctgatttctatattagtttaaggtttggcaagtttgacaactttatgatgaaaatgtagtatgtatcatatatattatataataccacagatagggtctgggccagaagcccatattgaaatgcttggatgtgtctgcaggaaatgtgtgcacactcacccaaagtgggttatgtaaagactatttatagcctctgttagcccatgccaggttttctcactcgacaggtttgtgtttgcagaaatcctgtgcctgtttttaaacacactttcaatttccctactgtttatcagtatttcataaatggtttctctttccccgttgactccttttagcctttgaaagtatatttgttctctcactccctacctcctttcctcgtaccacccccgtttttctttgtttcctctcttctccctgcttcctctcttggtctcatacaatccttccttctctgccccccaagtaccagcattataggttttaggtatgggctactagtagagttggctggctgacactgtttgtggtcatactgttgctggagctttctatttatgtgtgccaggtttatcttaaagtttcttttcttttcaactccaccccacccctgcttttgttgttgttttgttttgttttgtttttgtttttgtttttttgagacagggtttctctgtgtagccctggctgtcctggaactcactctgtagaccaggctgacctcaaactcagacatccggctgcctctgcctccagagtgctgggattaaaggcgtgcgccaccatgcccggctcactcctgctttttgaggcaggttctcacaatatatcctatatcagctttggacttactgtgtagcccatgctgactgtcaacttgtgcctatctggctcacaaatatgagccactttttaaatatatatttatgattttataagtcaggcagtggtagcacacacctttaatcccagcactcaggaggcagaggcaggtggacttctgtgagtttgagaccagcctgggctacagagtgagttccaggacagccagagctatacagagatccagtctcaaaaaaacaaaaaaaagcaccccaaatctatgtgtattatttcctgtgaatgtatttgtagctatccaccaccctcatcagcatgtgaatgggctctgagggagcctagttgtctacactgtatgctaactagccctggccaattgatgagccatttctgttttctttttctttctcccccaccacctcttgagacagggtttctctgtgtagccctgatgtcttggaactttgttggaccagggtggccacaaactcagagatccccttgcctctgcgtctgcctctgaagtgctaggattaaaggcatgtggcaccacacctggcctaaaatggtcttaagttgtgtttggctttcattctggaatttattcatattttatgtgtatggtgttttgtctgcacgtttttgtgtaccatgtgcatgcactgtgctcatagaggccagaagacagggtcagatgacttgggattggagttacaggcagttgtgagctgtgccttgtgggtactgagatttgaacctgtctcctctgaaagtccatctaatactcctaactgaggagctatctctccagccccttggtgagccatttctttacatcagaaaagtgtccatctatttattcagaactgtctgatctttttattctcttcagtttttgctctgtgcatattgggcatattgggtctctcaagcttggcctcagggctcttgactttttttatgtttttggtttttgagacagggtttctctgtgtagccctggctgtcctggtactcactctgtagaccaggtccagtagcttcttaattcagtaagtggtacagtctccatcgcacctggaagtgttttaatgctctgattaatgtcgtagcaagaccacactggaggctgttaggggctgggacagaaagaaagcagcagtctaaggtctctgcgctggtgactcagatgggatcacaaggtggatgagaaactaggtatgttggctaatattggtttgtatagataagccacaggggcttggcaatgatttggacttgaggactgagggaattgggggagcagggaccagtcaggttttgacaattgaacagatgaagcaaaacaaaatggaacagctgtgctgggagcagatctctgcctctccttcgtgactattgttttggagtatgctcagggacatacacggagagatagaggtatctagtcacggcctcactacagctctatgcaagaaagggctgagtccgtgaaaatgatgcttaggggtaccattggcctgcagatgatagtgacttaaatagaagttgctttgtctcctgtaactatttgtttcatataattatcagcataatggaatgatcattggatgttgttaccttttgcaacactgtaatgtcagttgatgtctattaagatttttggacctggagtctcatgcctataaccctcaagaaactgaagtataagaatcaccatgagttcaaggctagcctgagccacagaatcaagttccaagtcagcctgggttacagtgagacactctctctctctctctctctctctctctctctatatatatatatatatatatatatatatatatatatatatatatatatatgtgtgtgtgtgtctgtgtgtgtgtgtgtgtgtgtgtgtgtgtgagtgtgtgtatgtgtgtgtgtgtgtgtgatttatttcatgtatatgactacaatgtcaacgtcttcagacacaccagaagagggtatcagatcccattacagatggtcgtgagccaccatgtggttgctgggacttgaactcagaacctctggaagagcagtcagtgctcttaaccgcagagccatctctcagcccaagaccttttctcaaacaagattttcaaccgtatagttaggttaatggagtacctttcacatgcatgggggccttggtttctagccctaccacacacacacacacacacacacacacacacacacacacacgcatgctcgcacagggttcacggtagctgagatgattcagcagttaagagtgcctactggggtaagatgggtcagccagtaaggtaaagacagttgccactaagcctgactggcagagtgagaaagtgactcccatgcgttgtcctgtaacctccacacatgcaccatagcacatacatgtacctacacaggaaacgaatcattttgttcagttttgttttgttgagacagggtttctctttgtagccctgattggcctggaacttgctctgtagaccagggtggccttgaactaaaaaaaaaaaaaaaaattcctgccccctgctgggattaaaggcatgcactaccttgtctagcaataaatgtaattttttaaaataaagatttatttattattatacataagttcactgtagctgacttcagacacatcagaagagggtgtcagatcttgttgtgagccaccatgtggttgctgggatttgaactcaggaacctcaaaagagcagtcagtgcctttacccgctgagccatctcaccagccccctaaatgtaattttttaatttaaaaaatgggactggagagctggctgagtggttaagagcagcaggttgctcttctagaggaccaggggttagttgccagcacccttgtcaggggctcccaactgctgctaactccagttccagggcatatgagatcctcttctgaattccgagtgcagctccatttcacatgcacataacccaacacagcacacctatgtacatcattcaaaataaaataaatgcttctatgaaagagtgcttgctattctttcagggaacctgagttcaattcctagcattcacatatggtggttcacaatctcgacaattccagggaaatccaaggcttcagtaggactctgcaggtacatatacctccataaagatatactcacacacaattaaaagtaaaaggaaagggaaatcttcctgggttggagccatgactaagcagttaagagcactggctgctgttccagaagacccaggttcagttcccaacacccacatgactgctcacaactctataattccagtcccgagatatctcatgccctctcttctgggcgccctgggcaccaggcatgcatatggtgcacagacatacatgtaggcaaaaacccatacacataaatttatttattttttccaagacagggtttctctgtcaatttggctggtctggaaccactctgtagaccaggctggccttgaactcaagagatccacctgtctcttactcctgatttctgcgattaaaggcatgcaccactactgcccagtttatttttaattttaaagaaaacataaataaacaagaattcttgaacttacccataggtgtccattgctgctgcaaccacatacttgaaggggagaattgtgttgagaaagagatttttaaaaaaataattacttattcttttaattatgcatatgagtacactgtcgctgtcttcaaacacagaagaaggcatcagatcccattacagatggttgtgagccaccatgtggttgctgggaaatgaactctggaagaacatccagtgcttttaactgctgagccatctctccggactgaggaagacatcttaagggaaggggtagtgataatggaatacatgtggcttaaaacagaaggggaccagtgagagggggtaagaataggggaggacagctgggcggtggtggcgcacgcctttaatcccagcacttgggaggcagaggcaggtggatttctgagttcgaggccagcctggtctacaaagtgagttccaggacagccagggatacacagagaaaccctgtcttggaaaaccaaaaaagaaaataaataaagaataggggagggcaacaaacagggtggtggtgaataagaagaaaggattttgatccatgtttatggaaacttcataatgaagcccattactttgtatggtaacttaaaatacttaatttaaaaaggaaatggactccaggggaaataatggtagagaagtagatagttagggccaggagcagctaatcctttgtctaacacatacaacatacttcctcacgaacccttgttctaagatatgactgacctctggggaaaggtaaatggggctgtgctcctagaaatggaaacctaccatttcccagctgtagaatcttggtcactaactagtttttccaaacctctttggtctttttctgtcaaggaagactggcagtagcatttcctatcatttcagtggggaacactatcacgaatgtaagatgaggagtgctggctcacagacttagggcacaggcttcatatcccacttctttcattcactaggtatggagccttgaacaaatatctataggcctgtttcctcatcaaagctactgagaaagccaaggaaggtggtggcacatgtctgtagtcctttcattcctgctactcatgaggctgaggcagcaagaggactggaataagttcagggccagcctgggcaacttaatgacactgccttaaagagttgttttgtagaaggtctcatgatagagcttagcagtagagcacttgggtagcgagcgcatgtgacaccctgggtttggattccccaggactattacctccaggcacaaaaaatatatatttaacggctggagagatggctcagcgattaagagcattgactgcacttccaagggtcctgagttcaggtcccagcaaccacatggtggctcacagctatccataatgagatctgatgccctcttctgggtgtctgataaataaatcttttttaaaaaattatatatatagctagtatctccataggactgagtataaggaactgatttggttttactgggggcaggggtacacattatcacagtgcattgtgaagatcaaagaacaatttcttccaagtatgttccatactaaactagattttcaggcttggtggcaagtgtctttactcacactggtcctcaagatttgtttgtttgtttttgtttttgttttgagacaggatctcactatgtagctctggttgtcctggaacgcacttgtagaccaggctgtctacaaattcagagatctgtctgcctctgactcccaggtgctgggactaaaggcgtgtactaccaggccttcaagtatttttttaatgagatatagagtcttattatatagcccaggcactgaccttgaactcctgattttcctaccttggtctccagagtaactgccaggctcaatagatattattgtttaaatgttacttaaatcattaaaatattaaagacttcccagctattttgtgaaatagttcccatgtaagacagatcatgagtgatctattattattattattattattattattatttggatgaaacagggaggaggagatcgaggctgcttgttgccctgcaggtagctaagcttttagaaaggaaccccgccctgtaatctgggctcacatggttcacacccgtgttctcatagttctttactctgtgtgctcaggcccattgctggaagactgggacataattagccccaaagatgtcattggatctgatgtgctactggctgagaagcgatcatcactgacgacagctgccttgccttttacacagtccatcctctctcaggtgatttcaggagacttgggggtgtggtttccagctgtggttgaagggaagggcttatctgataataccattccagagcccgctggttgatgcctgccctatcctgcacaggggacctgtagcttctttccctttttccttcccaggtgggtcgtacactgtctaaggtccagcaggtgctgagttggtcttatggggaagatgtgaagccttttaagccccccctgagtgatgctgagttccacacgtacctgaatcatgaaggtcagctctcccggcctgaggagttgcgtttgaggatctaccacggcggtgtggagccttcacttcgaaaagtgagccgcctcagtccgtcaccgaacccatcacactctatcaaatgttcagtagaacacagtcataggtgggatagagaaatcccagggaaggagggtctctgtcgggtatgtcccagtggcaggaaggcagacctatcacaaggaggacagaggtcacaagagatgggtggtaactagttgacgtacatgggtacgtacggcagcacactagttgaaactcagccccatctcttctgtctctggcaggtagtatggcggtacctccttaatgtgtacccagatgggctgactggccgtgagcggatggactacatgaaacgtaagagccgagagtacgagcagctcaaaagtgagtgggcccagcgagtgaaccctgaggacctggaattcatccgcagcacagtcctcaaggatgtgctccgcacagaccgagcccatccctactacgcagggcctgaggatggcccacacctacgggccctacacgacttgctcaccacctatgccgttacccatccacaggtatcatactgccaggggatgagtgacctggcctcaccaattcttgctgtcatggaccatgaaggccatgcctttgtatgcttctgtggcatcatgaagcgcttagctgccaacttccaccctgatggccgtgccatggccaccaagtttgcccacctcaagctgctattgagacatgctgacccagacttctatcagtacctgcaagaagcaggtgccgatgacctctttttctgttaccgctggctgctgctggagctcaagcgtgaattcgccttcgatgatgctctccgaatgctagaagtcacctggagttcactgccccctgaccctcctgaacacgaagtggagctcgtcggacctcccagccaagtagcagacactggctttggtagccacaggggacggccagtacgtcagaggcacatgctgaggcctgctggtggaggaggcggtgcttttgaagatgctgttgtccacttagctgcatctagccagggacctagtggtggggggcgtctcctaagacaagccagtctggatggtctccaacaactcagggataacatgggcctcaggaaggaccatctggtccaactatcccacccagctaccctcattagctctaagtccctctctgagcccttgctgaattccccagatccactcctctccacctcttctcggcccgattccccatcttcgtcatctcctccatctacccaggaggcttctccttctggtgacatagctgtaggatcccccttaatgcaagaggtaggttctcccagagaccctgggaagcctgtaccacctccacctccaatgggccttcccccaccccaggagtttggccgagggaacccattcatgctcttcctctgcttggctatcctgctggagcatcgtgaccacatcatgcgcaatgggctggattacaatgagctagccatgcattttgaccgcctggttcgtaaacaccatctagggcgtgtcttgcgtagggccaaagcactctttgctgattacctacagtctgaagtgtgggactctgaggagggggctgaggccacagctccatcttgattatactccctccaacgctccaaccccaatggtactccattctttgccatgagggcctacacatgagaccttattccctgcctgccatccccagacatgttggagcctgaggccctctctccccagatttgagtatgtgtggctcagccttggcactgccccacagaggccacagcctcgttctgtttttgttgtttctaaactatactttccatatacaaa

SEQ ID NO: 21 - DNA, 21476 bp, mus musculus; identical to SEQ ID NO: 20

SEQ ID NO: 22 - DNA, 21401 bp, mus musculus
gtacgttagggtacgggtaactatcggttatcacctggacagagacgacagcggcgggatggcaaccacctccgcggcctcggactcggcgtgctcggcagcgcccccgcccgtcggaggtgcccaggcggccgcggcggttgaggaggaggagcgtgaggtggtacgggtccgagtcaaggtgaggctagcctgcttgggcgcccagtggacgaaaagaccgtaactgtcctaggatagagcatcagacctgaaatttggggcgtgacttggagactgggggcgaggctggagagcggaattgatagaatgaaggcgtgggttttggggacttgtcgttgggtgtggaactgtagaggagacagggccaatggagtggatgggtggagcctacgggtagagaggtgggttgtagggttaccggaggggcctctggagtccagaggaaggaaggaggtgctgtcgctgtcagaagggatagtcctaaagtcagtcaacaaatagctattgagagttcacttttgtccatgtcccacccctgagcccacgtgcttgtgggagggggacaaaaacaattaaatgagatattttgaacattggtgaatatcaggagaaagtgataggaaaggttaggatctctagggagttactttacccaaagctgtataggaaaatcccctaaagaggactcaagtcacagagacctggataataataataataacaaaatgttagcatatgcatttaggatgggagaagagttctaggtagagggaacacctagatgagtgtggtatgttcctgtaggttcccatattgttggagaaggaagcctgggggcaaaagtaatagacaatcaggagggagaagggcacataggacagcttgtgacatataacacactctgaggaaggaacccgttgtgatacctgcaagcagtgaccggtggctcagactggagtgccagagatcacttttggggtgttagcgctctaaggcaaaggttttagtaagccagatgaagtgggaaggatgttcactctgagagaggtcagcacacagaagtctggaaagcatgtactcaaaggaactctcaacagtttgataccagtagagccataaatacatctcagagtggagggagggctagctccagcacctaggtttgctgttgaagaaggatctgagcaacaaacagtgttacagggagatttgcactatggggggtgggggggagtcactgatttgattgtgtcaagctggacatggtgattctggcaaccatatttaagggactctggaaggactggacacctggactactgcattagccttcgttcctgccagtctgctttggcagagcaaacatggaccctgtaaattcaaaggacatatcatcttttctctgcgcagagacttcctgtgacttcccctcgcccagaacaaaaaccaagaacatctcacctaaaacctggtccctcccctgtcttcgactcctgccttctgccactctttaccttacccaccctttccacacggtgatgtgccccctcatggcctccccctgtcctctttccacagaaatgtgagagcttcttgtcccctgagttccgctcttttgcggtggatcctcagatcacctcgctggacgtgttgcagcacatcctcatccgagcctttgacttaaatgggtgagtgggaagatgaagcagggcgctcatcttaaaagtcactgccaggtttctggggtttggttttgttgtttggctgcttttttttccaaataattccacagtgaataggtgtatcttgcttggaatctgtgagaaaagtcctaagaaaaaattagcagtagtatttctgggctacttaaaaactttcaaggaatagctgggtgatggtagtacacacctttaatcccagcatttaggaggcagaggtaggtggatctctgtgagttcaaggccagcctggtctacagaacaagttttagaacagccaaggctacacagagaaaccctgtctcaaaaacaaacaaacaaacaaaatccttcaaggaatgttttcaaaatgactctccagacaggttttacctgcacagcacagaaaaggttttgctggatatggtggtccacacctttagtccggggactctggaagcagaggcacacacatctctgacagttcaaggccagcctggtctacagagtgagttccaagacagccagggctacacagagagacctctcaaacacatacacacacaagacaaaagaaaacatttgtttcaccaagcatggtgatatcagtactatggaggctgggacaagaggatcaaggccactctaagcaacataatgaaactgcctcagaagtataaaatcactttctttcttcctgtcctcccagacaatggtttcgcaaaatttgccagtctgatagctgagaattgatatcacttgggggcaggtgggttggttatcttgttgtgggggactgaatttaaatagtgtgaaattgatccatatttaggatgatccttggtttacagtgatcatcaagtaaaatatctgtgtatatagttgcacaagtggatctgaatagatttgtagttgcagttgaacatttgtgcgtttacatcttgtaaaaaataacaaccatacagactgcttttttttatgtagtaagaaggctgctttcttccacttctatccctcaactacactgttaccatccccagaggggaaccaacattctaccagttttcagtgtaccctccagatataagcaggtgtgtatctgtttctgtgtttgtgtaacaaagtggatataaatgacctaacctcaggatacccataatccttagcagagttcccagcagagagaaggaagttgttttcagtacctttcacattgcctgccttgttttgtaaatctgatcttgaagccaatgctggggaactggggatcccaaaagctcccttatatcctttgtccaggaagaagaactttggcatcagctacctggctcgagaccggctaggacaggaaactttcctctccctcctttctgattgggacctcagcacagctttcgccactgcctccaaaccttatctgcagttgcgtgtagacattcggccctcagaggacagtgagtacccagaacgtttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttcctataggatgataattccacaccttccactcttggtaggccacagggacacaattttttttaattatgtcagaagacctgggttcaatcatcagtactgcccccaaaagttttattatagtaatggtatttgtacactttaaactcaagttcaaagctagcctgagctataaagcaaccctgtctccaaacagaactacaaaataattcaggttttgggttttaaaatttcatgttaggaatattcagcctatattatcgcattggtaattaatttgaaagcatagcagtatggtaatggtttcagggttactggaggaaaatatctgtgctcttgggaaaaacccatttacacgtgaaggggtatagtacaaggtgtttgaaggagttgtaggagagtgtgtttccatggagaaagggtaagatgaagcaaatgtggtagaaaagctaatggcttctggtgagggctataggcacagggtgtctgtcagtctgctcgcttttgcaatgcaagaaagccaggccttgctcactcacatcaggccttcactgtgccacggagctatagagccacctccagtgtgcattctggtaggtttctgttggttgtggtgggcttttgtctggttggttgtttttgttgttgtttttaaacataaagggtgtttcacctgcttgtatgtctgtgtgctacatgcatgcttgatgcccgaggaggccacaagaggacataggctctcctgacctggaattacagatggctgtgagcccacttctgggttctgggaatcaaactctggtcttcttgaagagcagccagtttctttgagccatctttccagcgccacacattgtactcgtttttaacattttatgggtttgaatttgtttttgtttgtggcttttttttttaatagttgtggtatatagccctgggtagctgggaacttgtcatgtaaattttgctggcatcaaacttacaaagataccttctgtctgtgcttccctagtgctaggataacatagcccaccatgcttcactgtgttactgcttggttttggtttggttctaagaattgactacaggccatatgtttgctaggcaagtgttataccactgaactatacctgtttgtttgtttgtttgtttgtttgttttgttttttgagataggtcttactacatttcctgggctgacctaaaacctaacagttcttccacccgacacactcagcactgctcaacacccagcaagtttttaaaatcaattttgtttatttagtgtgtgtgtgtgtgtgtgtgtgtgtgtgtgtatgcatgtatgcatgagcacatgtgcacatgtgtgccatgacacctatgcagaggtcagagaacagcttgtgggagtcagctctctcctgtcatgtaaatcctggggttcacactcgggttctcaggcttggcagcaggtgccttaaagaaccactgaaacgtcttgccaactcagcaagtttttgtttcatttttgtaataacatatgttggagccgtacaattcgtacccttagagaacttttgtacctacttggaatgactgaggcattttattcacatcgtgtagctaaatggaatacctggacatttaatgaatagagttaattgtccccataatcttacagagctagagtggcgcacgcctttaaccccagcactcgagaggcagaggcagccagatctctgggagtttgaggccagcctggtctatagagtgagtactaggacagccagggctacacagagaaagcctgtcaaaaagaaaaaaaaataacaaaacaaaactacatggcaaccttgaaaaagaggaagaaagagaaggacaaaaagaggaatgcaggaggaaacagaggaagaaagagttgaaagaaaggaaagataatagggcacaggaaaatgtgtcaataacttatttcccggcctccatttcttcacctctaaagtggaaacagtagtgtcatttaaacacataaagtcttcctggctgaataagcacaaggccaacccagctgtgtaagagctgagaggacgccagtggagcagaggtgatgacacctgtctctttcacagaaactcatttgaaaagtccttttctccatgtctatatgtttatgggtgcccgtgtgtggatgcatgggtgtgcctgtgagcagaccagaggttaacgttgagattctcaatcacccttcgccttattttttgtttgtggttggttggtttgttctttcaaggcagggtttctctgtatagccttggctatcctggaactcgctctacagtctaggctgctttggaactcacagaaatccacctgccctctgccttccaagtgctgggattaaaggcatgtgtcaccatgcctggtatccaccttattatttgagatagtttctcattgaacccagatctcaccatttggctagattggctggtcagcaagcccatggatcctcctagcttcctcccaagagctgggattatatgtgtacactaccgtgtctctcgttttttatgtcggttctggaacttactagggatccatgcccaggccctcattgcttatatggcagccactgagatatcttcataaccataaacttacctataagatgcttttccataaggtagagagatggctcagcagctgggagtactggctactcttctatagaacctgggtttggttctcagtatccacatggcaattcaaaccagtctgtaactcttgtcccagggaccttgacaagccttgcaagcatgtgtgcagataaacctctcataaaattaactctccagctaatgacgaatcagttttcccctcactatttccatctcttacttgccaggttccagggtaagcgtggtctgtttctgaatttttaaaaattttcttattctgatctcttcatttacaaatgtccttaaaaggactagcaagcaaaattgatggagagaaaaaaacagctccctgaagccatgggaggacacaaaaatgagctgccttaaacttgtatgatacttattttgtatatgtgtgtgtgtgtccacagacataccaaagaatgcatgtgtaggtcagaagacaactttcagaagtcagttcttccttctctcgtgggagtcttggggattgaatttagctcatcaacctactgagccatgctgcatgggctcacatgcacctgcatgccatggcatgcatggtacacagaggacaacttgtgggatgctgtccttccaccatgtgggttctgcaggttgaaccaggtcactagacttggtaacaggcacctctgcctgttggtccatctcactggctgtgtggggccttcctttcctttgtttcctaacaggctctaactgtatagttcaggctgccttggccttccttctaggtgctaagattccaagtataaaacaccacattcaggttatgaaagttttagtgtttcctttcataaaaatgttactttctggatttgtttcagtactgggaatggaagccagagccttgcacatggtagacaagcacttttccactgagccatctccccagccctaaaatgtttcatgaaagtcttataagggttttcttcttgtttgcatatgtgttcataggtgtgcatttgtgtgagtatgtgatgtacatgtgcaggagtttggagaccagggatcagtgttgctcgtcttcctccatcacttgtccatgtaactctgccaacagggtcttttactaaaagttgagcctgctgactggctccatggctggccaggaagcagaagtaagatgcttctgcttttattacttcactgctccaagtacaggctttcgcctatcatctgtttgcatgtgtgaatctgtgtgtgtgtgtgtgtgtgtgtgtgtgtgtgtgtgtgtgtgtgtgtgtgtgtgtgaaacacatgtggaagtcagaggacagtttttcaagagtcagtgtttccttcctcttcgttaaggccgggtctctttttctcttgctatactgtatactcctaggctagctggcccggcaatttcaggcaattcttttctctactagcctattttgccacaggagtactgggattatagatgggaatgcataccacaacatctgtctttttgaggctagaagtcaggtcactggacttgagccatctcactagcccacccctggctttagcctgcagcagagatacaaactgttatacttataccgcaagtgcttcaccaattcagccaacttcccagggcctattcttatttaactgaattaatttgtcattttaatttgtctccattaaaatgctaaggagaggactaggtgtggtagcacatgcctttaatcccagcactcgggaggcagaggcaggcggatttctgagtttctgtgtagaccaggctggccttcaactcagagatctgccagcccctgccttcctctgcctcctgagtgctgggactaaaggcatgtgccgccactgccccagcgaagttaaaattcagggcctacaggaatgtttagtgactcagagaatatacatttgtagcagaggacccaagttcagttcccaacactcaggtcaggtgaagtgtctggtctcagtgagcaccggcacctcatagactttcaactgaaaagctttttaatatgtaaaagagaaattaatggagtgctgagagagagagagagagagagagagcgcgcgtgagagcgtgtgtgtgtgtgtgtgtgtgtgtgtgtgtgtgtgtgtgtgtatgtgtgtgtatgtgtgtgtatgtgtgtgtgtgtatgtgtgtgtgtgtgtgtgtgtgtatatatgtgtgtgtgtgtgtatgtgtgtgtgtatatatgtgtgtgtgtgtgtgtgtgtgtgtatgtatatatgtgtgtgtgtgtgtgtgtgtgtgttttccaaattgccaagtctgtctcaggagagcagagaggagtgagtgaggtgccatgggggagccccttggttaaaagcgaaaggataccatcatggagggagcctggagactagcacagatctgactcgctaaccaagacctaaagcaagagcccaggtctctttggccagaggtaaggagaaaataaacacttttgtctaggaggaaataactcttcaagcccctgagggaattctggcttctgtctaaatgcctgatcttggtaaaaggaatttcttggggaaactgacatgaaactgtttagtaacctactaaacacattcaccttattaaaaataaaaaaatgaggcccaggggactgaaagtttgtaagatcagagggtcctgtgctgtagttgagttcaaggccagtgtgggcaagtaaacagtgcgctcaggatttgagctacatttgctaggccctgaattcagtgcctagtattgcgataataatcagaaatgagcgtgagggccagcgataaagcttagtgatagagcacttgcctagcattcgggagaccctgggtttgattcacagtatcacagaaaataaacagaaatgaaaatgtttttaaacaatgctaggccgggcagtggtggcacacgcctttaatcccagcacttgggaaacagaggcaggcagatttctgagttcgaggccatcctggtctacagagtgagttccaggacagcgagggctacacagagaaaccttgcctcaaaaagcgaaacaaaacaacacaaaagtcctacatactctagggaacactatgcttaactttatacatctctctcacacacacaccttctgcttgagtgatcagtttgctgtataaccttacaggtcctttactctttacaaacaaatttagtcatatgtagggacatgagagtatattcatatttatatacaattggcttatgatctacatgttatactctttttataaaacgttttaaagctatttgtattttatgtacattggtgttctgcctacatgtatgtctgtgtgagggtgtcggattccctggaactggaattacaaacagttgtgagctccaacatggttgctgagaattgaacccaaatgctttggaagaccatgatatactcttaagtgtcgagtatatggactgtgtagtataatattgttaatgccattctttaaaaataaaagatttacttaaatatacacagccttgtgcctgcatgtacacctgcagcagagggcatcagatctaattatagatggttgtgagtcaccatgtggttgctgggacttgaactcaggacctctggaagagcagccagtgctcttacccactgagccatctctgcagccctgttaatggcattcttgagatcatattgctttccttatttattttctgtgtataggtgttttgcctgcatgtgaatatgtgcaccatgtgcatgcctggtgcccagggaggacagaagaggattagagatcttggggctggagttacagatagttgtgggctgcagtgtgtgtgctaggaatagaactaaggtcctctattatgagcccagtggctcataacagctgagccatctctccagccccttgagtccattttcatggctctgaaagcaacaagcatgtgactcagtggaaggttgagtctctctgaggagcccatttcgcctctacacttggtagattatcaagccaggaccttgaaccaatttggacatttgtgataattttctttatattattattattattattattattattattgctactaatagtttccttgtttgtctgtctctctctctatctatctgggttttttgagccagggtttctctgtgtagccctggctgtcttggaactcactctgtagaccagtctggcctcaaactcagacatctgtctgcctctgcttcctgaggccagcctggcctacacagagaaatccttgaaaagcaaaaaaaaaaaaaaaaaaaaaaagaaagaaaaaaaaactgtctggggctggagatgtaacttaatagtataagaatgcttatacagggctggagagatggctcagtggttaagagcactgactgctcttctgaaggtcctgagttcaaatcccagcaaccacatggtggctcataaccatctgtaatgagatctgacgccctcttctggagtctctgaaaacagctacagtgtactcacatatagtaaatgaataagtaaaaaaaaaaaaaaaaaaaaaaaagaatgcttgtacagtagtagtatgcataagtcctctacaatgctcaccgaaacagctgggtagaggaccacatgtctgtgatcctagcaatcaagaagcagaaagaagcaaagacaggaggattattgtaagcccctgcaatcgggctgagacagaaggatttctgtgagctcaaggccagcttaggctacataatcagaaactttctccctctttctcccccaacacaaagggaaaacaattgagatagttgcgagattgaggcagagatgacaagtttaagacctgcctgcgcagtgggttcatggtcagcctaggcagcttagtgaggccatctcaaaacaaaaaacaaaaagctctagggctggggctggatgctggctcagtaagaggactcgctgctactgcagaaacctggcttcagttcccagcaaccatatgctagcttaaaactgtctttaactcaggttccaggggctctgctgccttcttctagcctccataggcaccaggcttgcacaaagtgtacaagcatgcgtgcaggtaaatccactcatacacatagagagaaatatattttagaaagaaagaaaaggtatgggctggaaagctggctcagcagttaagaactcatagtgctttcagaggatctgagttctgctgcttcccagcaccaacaatgcagcagctcatggctgcctgtaactctagctccaaagacttttataccttctttataccccttaggggtgtgtgtgtgtgtgtgtgtgtgtgtgtgtgtgtgtgtgtgtgtgtgtgtaccacctacatgcctggtgtccttggaggccagaggaaggcattggaccccttagaactggaattaaggtgattgtgagccactgtgtaggccctggaagtacaaggacctcgggaagaagttagtggtgtttgtttgtttgtttgttgtttgtttgagacagggtttctctgtatagctctgtatagctctggctgtcctgaaactcactttgtagaccaggctggcctcgaactcagaaatccacctgcctctgcctcccaagtgctgggattaaaggcatgcaccaccacgcctggctagtggtcttaatcactgagccatctctctagccatatatatgtatgtatgtgtgtgtgtgtgtgtgtgtaactatatatatataacacacacttttttttagatggggtcttactatgtagccctggctggcttgaaacttacagaggttcaccggcctcttcttcccaagtgctgggatttacatagggctaacactattatgtttaatgacagtgatttttgtggtcagttttaatttttaaaaaagcctttgtcatcctcctgatgttctttttcttagctattcttaaacatgaatttgttcttgtgaatcttaaaataatttcatgcagtttcagggggaaaacattagaattctggggttttttttttttttgtttttgtttttttgtttttgtttttgttttttgttttttttttttggtttttcgagacagggtttctctgcgtagccctggctatcctggaactcactctgtagaccaggctggcctcgaactcagaaatccacctgcctctgcctcccgagtgctgggattaaaggcgtgggctaccacacccggcctttctgatttctatattagtttaaggtttggcaagtttgacaactttatgatgaaaatgtagtatgtatcatatatattatataataccacagatagggtctgggccagaagcccatattgaaatgcttggatgtgtctgcaggaaatgtgtgcacactcacccaaagtgggttatgtaaagactatttatagcctctgttagcccatgccaggttttctcactcgacaggtttgtgtttgcagaaatcctgtgcctgtttttaaacacactttcaatttccctactgtttatcagtatttcataaatggtttctctttccccgttgactccttttagcctttgaaagtatatttgttctctcactccctacctcctttcctcgtaccacccccgtttttctttgtttcctctcttctccctgcttcctctcttggtctcatacaatccttccttctctgccccccaagtaccagcattataggttttaggtatgggctactagtagagttggctggctgacactgtttgtggtcatactgttgctggagctttctatttatgtgtgccaggtttatcttaaagtttcttttcttttcaactccaccccacccctgcttttgttgttgttttgttttgttttgtttttgtttttgtttttttgagacagggtttctctgtgtagccctggctgtcctggaactcactctgtagaccaggctgacctcaaactcagacatccggctgcctctgcctccagagtgctgggattaaaggcgtgcgccaccatgcccggctcactcctgctttttgaggcaggttctcacaatatatcctatatcagctttggacttactgtgtagcccatgctgactgtcaacttgtgcctatctggctcacaaatatgagccactttttaaatatatatttatgattttataagtcaggcagtggtagcacacacctttaatcccagcactcaggaggcagaggcaggtggacttctgtgagtttgagaccagcctgggctacagagtgagttccaggacagccagagctatacagagatccagtctcaaaaaaacaaaaaaaagcaccccaaatctatgtgtattatttcctgtgaatgtatttgtagctatccaccaccctcatcagcatgtgaatgggctctgagggagcctagttgtctacactgtatgctaactagccctggccaattgatgagccatttctgttttctttttctttctcccccaccacctcttgagacagggtttctctgtgtagccctgatgtcttggaactttgttggaccagggtggccacaaactcagagatccccttgcctctgcgtctgcctctgaagtgctaggattaaaggcatgtggcaccacacctggcctaaaatggtcttaagttgtgtttggctttcattctggaatttattcatattttatgtgtatggtgttttgtctgcacgtttttgtgtaccatgtgcatgcactgtgctcatagaggccagaagacagggtcagatgacttgggattggagttacaggcagttgtgagctgtgccttgtgggtactgagatttgaacctgtctcctctgaaagtccatctaatactcctaactgaggagctatctctccagccccttggtgagccatttctttacatcagaaaagtgtccatctatttattcagaactgtctgatctttttattctcttcagtttttgctctgtgcatattgggcatattgggtctctcaagcttggcctcagggctcttgactttttttatgtttttggtttttgagacagggtttctctgtgtagccctggctgtcctggtactcactctgtagaccaggtccagtagcttcttaattcagtaagtggtacagtctccatcgcacctggaagtgttttaatgctctgattaatgtcgtagcaagaccacactggaggctgttaggggctgggacagaaagaaagcagcagtctaaggtctctgcgctggtgactcagatgggatcacaaggtggatgagaaactaggtatgttggctaatattggtttgtatagataagccacaggggcttggcaatgatttggacttgaggactgagggaattgggggagcagggaccagtcaggttttgacaattgaacagatgaagcaaaacaaaatggaacagctgtgctgggagcagatctctgcctctccttcgtgactattgttttggagtatgctcagggacatacacggagagatagaggtatctagtcacggcctcactacagctctatgcaagaaagggctgagtccgtgaaaatgatgcttaggggtaccattggcctgcagatgatagtgacttaaatagaagttgctttgtctcctgtaactatttgtttcatataattatcagcataatggaatgatcattggatgttgttaccttttgcaacactgtaatgtcagttgatgtctattaagatttttggacctggagtctcatgcctataaccctcaagaaactgaagtataagaatcaccatgagttcaaggctagcctgagccacagaatcaagttccaagtcagcctgggttacagtgagacactctctctctctctctctctctctctctctctatatatatatatatatatatatatatatatatatatatatatatatatatgtgtgtgtgtgtctgtgtgtgtgtgtgtgtgtgtgtgtgtgtgagtgtgtgtatgtgtgtgtgtgtgtgtgatttatttcatgtatatgactacaatgtcaacgtcttcagacacaccagaagagggtatcagatcccattacagatggtcgtgagccaccatgtggttgctgggacttgaactcagaacctctggaagagcagtcagtgctcttaaccgcagagccatctctcagcccaagaccttttctcaaacaagattttcaaccgtatagttaggttaatggagtacctttcacatgcatgggggccttggtttctagccctaccacacacacacacacacacacacacacacacacacacacacgcatgctcgcacagggttcacggtagctgagatgattcagcagttaagagtgcctactggggtaagatgggtcagccagtaaggtaaagacagttgccactaagcctgactggcagagtgagaaagtgactcccatgcgttgtcctgtaacctccacacatgcaccatagcacatacatgtacctacacaggaaacgaatcattttgttcagttttgttttgttgagacagggtttctctttgtagccctgattggcctggaacttgctctgtagaccagggtggccttgaactaaaaaaaaaaaaaaaaattcctgccccctgctgggattaaaggcatgcactaccttgtctagcaataaatgtaattttttaaaataaagatttatttattattatacataagttcactgtagctgacttcagacacatcagaagagggtgtcagatcttgttgtgagccaccatgtggttgctgggatttgaactcaggaacctcaaaagagcagtcagtgcctttacccgctgagccatctcaccagccccctaaatgtaattttttaatttaaaaaatgggactggagagctggctgagtggttaagagcagcaggttgctcttctagaggaccaggggttagttgccagcacccttgtcaggggctcccaactgctgctaactccagttccagggcatatgagatcctcttctgaattccgagtgcagctccatttcacatgcacataacccaacacagcacacctatgtacatcattcaaaataaaataaatgcttctatgaaagagtgcttgctattctttcagggaacctgagttcaattcctagcattcacatatggtggttcacaatctcgacaattccagggaaatccaaggcttcagtaggactctgcaggtacatatacctccataaagatatactcacacacaattaaaagtaaaaggaaagggaaatcttcctgggttggagccatgactaagcagttaagagcactggctgctgttccagaagacccaggttcagttcccaacacccacatgactgctcacaactctataattccagtcccgagatatctcatgccctctcttctgggcgccctgggcaccaggcatgcatatggtgcacagacatacatgtaggcaaaaacccatacacataaatttatttattttttccaagacagggtttctctgtcaatttggctggtctggaaccactctgtagaccaggctggccttgaactcaagagatccacctgtctcttactcctgatttctgcgattaaaggcatgcaccactactgcccagtttatttttaattttaaagaaaacataaataaacaagaattcttgaacttacccataggtgtccattgctgctgcaaccacatacttgaaggggagaattgtgttgagaaagagatttttaaaaaaataattacttattcttttaattatgcatatgagtacactgtcgctgtcttcaaacacagaagaaggcatcagatcccattacagatggttgtgagccaccatgtggttgctgggaaatgaactctggaagaacatccagtgcttttaactgctgagccatctctccggactgaggaagacatcttaagggaaggggtagtgataatggaatacatgtggcttaaaacagaaggggaccagtgagagggggtaagaataggggaggacagctgggcggtggtggcgcacgcctttaatcccagcacttgggaggcagaggcaggtggatttctgagttcgaggccagcctggtctacaaagtgagttccaggacagccagggatacacagagaaaccctgtcttggaaaaccaaaaaagaaaataaataaagaataggggagggcaacaaacagggtggtggtgaataagaagaaaggattttgatccatgtttatggaaacttcataatgaagcccattactttgtatggtaacttaaaatacttaatttaaaaaggaaatggactccaggggaaataatggtagagaagtagatagttagggccaggagcagctaatcctttgtctaacacatacaacatacttcctcacgaacccttgttctaagatatgactgacctctggggaaaggtaaatggggctgtgctcctagaaatggaaacctaccatttcccagctgtagaatcttggtcactaactagtttttccaaacctctttggtctttttctgtcaaggaagactggcagtagcatttcctatcatttcagtggggaacactatcacgaatgtaagatgaggagtgctggctcacagacttagggcacaggcttcatatcccacttctttcattcactaggtatggagccttgaacaaatatctataggcctgtttcctcatcaaagctactgagaaagccaaggaaggtggtggcacatgtctgtagtcctttcattcctgctactcatgaggctgaggcagcaagaggactggaataagttcagggccagcctgggcaacttaatgacactgccttaaagagttgttttgtagaaggtctcatgatagagcttagcagtagagcacttgggtagcgagcgcatgtgacaccctgggtttggattccccaggactattacctccaggcacaaaaaatatatatttaacggctggagagatggctcagcgattaagagcattgactgcacttccaagggtcctgagttcaggtcccagcaaccacatggtggctcacagctatccataatgagatctgatgccctcttctgggtgtctgataaataaatcttttttaaaaaattatatatatagctagtatctccataggactgagtataaggaactgatttggttttactgggggcaggggtacacattatcacagtgcattgtgaagatcaaagaacaatttcttccaagtatgttccatactaaactagattttcaggcttggtggcaagtgtctttactcacactggtcctcaagatttgtttgtttgtttttgtttttgttttgagacaggatctcactatgtagctctggttgtcctggaacgcacttgtagaccaggctgtctacaaattcagagatctgtctgcctctgactcccaggtgctgggactaaaggcgtgtactaccaggccttcaagtatttttttaatgagatatagagtcttattatatagcccaggcactgaccttgaactcctgattttcctaccttggtctccagagtaactgccaggctcaatagatattattgtttaaatgttacttaaatcattaaaatattaaagacttcccagctattttgtgaaatagttcccatgtaagacagatcatgagtgatctattattattattattattattattattatttggatgaaacagggaggaggagatcgaggctgcttgttgccctgcaggtagctaagcttttagaaaggaaccccgccctgtaatctgggctcacatggttcacacccgtgttctcatagttctttactctgtgtgctcaggcccattgctggaagactgggacataattagccccaaagatgtcattggatctgatgtgctactggctgagaagcgatcatcactgacgacagctgccttgccttttacacagtccatcctctctcaggtgatttcaggagacttgggggtgtggtttccagctgtggttgaagggaagggcttatctgataataccattccagagcccgctggttgatgcctgccctatcctgcacaggggacctgtagcttctttccctttttccttcccaggtgggtcgtacactgtctaaggtccagcaggtgctgagttggtcttatggggaagatgtgaagccttttaagccccccctgagtgatgctgagttccacacgtacctgaatcatgaaggtcagctctcccggcctgaggagttgcgtttgaggatctaccacggcggtgtggagccttcacttcgaaaagtgagccgcctcagtccgtcaccgaacccatcacactctatcaaatgttcagtagaacacagtcataggtgggatagagaaatcccagggaaggagggtctctgtcgggtatgtcccagtggcaggaaggcagacctatcacaaggaggacagaggtcacaagagatgggtggtaactagttgacgtacatgggtacgtacggcagcacactagttgaaactcagccccatctcttctgtctctggcaggtagtatggcggtacctccttaatgtgtacccagatgggctgactggccgtgagcggatggactacatgaaacgtaagagccgagagtacgagcagctcaaaagtgagtgggcccagcgagtgaaccctgaggacctggaattcatccgcagcacagtcctcaaggatgtgctccgcacagaccgagcccatccctactacgcagggcctgaggatggcccacacctacgggccctacacgacttgctcaccacctatgccgttacccatccacaggtatcatactgccaggggatgagtgacctggcctcaccaattcttgctgtcatggaccatgaaggccatgcctttgtatgcttctgtggcatcatgaagcgcttagctgccaacttccaccctgatggccgtgccatggccaccaagtttgcccacctcaagctgctattgagacatgctgacccagacttctatcagtacctgcaagaagcaggtgccgatgacctctttttctgttaccgctggctgctgctggagctcaagcgtgaattcgccttcgatgatgctctccgaatgctagaagtcacctggagttcactgccccctgaccctcctgaacacgaagtggagctcgtcggacctcccagccaagtagcagacactggctttggtagccacaggggacggccagtacgtcagaggcacatgctgaggcctgctggtggaggaggcggtgcttttgaagatgctgttgtccacttagctgcatctagccagggacctagtggtggggggcgtctcctaagacaagccagtctggatggtctccaacaactcagggataacatgggcctcaggaaggaccatctggtccaactatcccacccagctaccctcattagctctaagtccctctctgagcccttgctgaattccccagatccactcctctccacctcttctcggcccgattccccatcttcgtcatctcctccatctacccaggaggcttctccttctggtgacatagctgtaggatcccccttaatgcaagaggtaggttctcccagagaccctgggaagcctgtaccacctccacctccaatgggccttcccccaccccaggagtttggccgagggaacccattcatgctcttcctctgcttggctatcctgctggagcatcgtgaccacatcatgcgcaatgggctggattacaatgagctagccatgcattttgaccgcctggttcgtaaacaccatctagggcgtgtcttgcgtagggccaaagcactctttgctgattacctacagtctgaagtgtgggactctgaggagggggctgaggccacagctccatcttgattatactccctccaacgctccaaccccaatggtactccattctttgccatgagggcctacacatgagaccttattccctgcctgccatccccagacatgttggagcctgaggccctctctccccagatttgagtatgtgtggctcagccttggcactgccccacagaggccacagcctcgttctgtttttgttgtttctaaactatactttcca

SEQ ID NO: 23 - DNA, 680 bp, mus musculus
tgtgcgttacctcgagatgttggggagatgttgtgtgtgttgcttgttcattccacagataagtaagcacaatgagcagacccacagccatcagctctgcctgccccagctctgcccagtgtggaagaagcaagtgtcctaagcacctaactctagttttgttacaagtataacttaggagaaaaaattggtagaaataatacagtatgttgctaatttgtaacctactttaaactctgatttatagcctcacatacagtattcagggcacagaaatcttttgattgactcaagtaagtttcggcttccgtgtaacttcaagttaaagttaatttttttcagctcttctttatctctatactctcttagtatcagaatttcttatgttctttcttttaggaatttgagagcactgtgtttgggagaagttaggaaacataagggatgaatgaagcagttgaacttggagatactgtaggtgctaatactggatctaatctttcagatttaatttgttttctgggccttgtagttactcagtaaaccccttagatctgtgtaataatttaattgtataacgctcatttgttcctttaaagcctattctagtctgtctgccttttaaacttgttgcaataatgtcgccaagatataaacacattagtaaaacttttcttaaa

SEQ ID NO: 24 - DNA, 314 bp, mus musculus
acaggcagttggccagcccaagacagagtcgttttcttaccagataccagtgtcactggttcttcttgtcccttgggtcagtttcctaggtggctttatgatcccacaagtcatgtcttagctcagtccctcccccagattagtaacaggctttgagggtgtgtgtgcctgtggtccggctgatccgccgcccgagtccccaagctaccagccttgacctgcttcagatcttcagattgatttctgctgttcaatttcagaggctccttgagagaataatatatgttacttgttttagtgttgcagttattatt

SEQ ID NO: 25 - DNA, 30635 bp, mus musculus
tgcggagtcctggggggcggggggggggagggagacggaaatacaatgtgcgcagctgcggttgatcccagcgcgatttttgtcgctccgcccttaccttgctaaatagatccccggcctaagtttgtttacgagttcggcgaggtgcggactctattttgcctcccacgccgtgtcgctaccgaatcaacgttatcatttctgttagtctgggagagagttgtttttgagaggtctgttcattttcttcgtaagaagaaagcggtgacatctagatggccctgtagggaaagaggtggagcttctagttgtctttcaacttcaaaggacagcaagcttctaaagagcgggcctcttaggggtagccaatagctactcttttttctggactcctgggccgttctcacagggaatggggaggtagcatatgcttgccaatcagagaatgccagggccagccaatggtgaccggcaaccaatcgtcaaggccggccagagcgcgctcccttagtaggtggatggtggtcggatcgccggctctcttctcgtcgccattttgtgttggtgactgtggccggctaggaggaggtggcaccgagtttccttgggagggcaacgcgtcggtcgcgtctcccctccccctttcctcctttttgctcccagtcttggacttggtagttgcatgcattggctcccatttgaactaacagttctgaaggaggtggtggcgggcggaggtgatgcctgggagccctcccttgacagcccgggccgagaaggtgagcgccgttgcgggtcgtgggatcggaggtaaaggagctgggcgcgtgggagggggagagggccggtgtgcatagaagaggcgcggggacggactgtaccctcggagttcgcacagagctgagggatgcctgcacagcctgcacctgaagagggggtatggtcccccaccccagcttttttcttatgaaagcaaaagcgcgtgcgcgattgggacgcgggatgggtgcacgcgggttgggggaagggagagacagatgggagtggggtactgtgacttactgtatttgcccaccgaactttttatcttttgaaacgcgcgtgtttgcgactttgcggggggtgttcttagaggagggttgtgctgactgcccttgttacttaactatccacggggaaatactctggctgcggcctctattcatttatgtggtgggaatgagggtgacaagcgcggagaaagaaagtgaatatggtttttatccttggggtctgtatctgacctctgatccttatcaggaagcaggcttgttactgatcgaccccaacttagttagtttggggagggggtgcagagaatatatatatccggcgtttcttcttttgggagttgtatctgtaacagtgaggtctatatattcaaagggaaatccgtttaattgtgtctcttataggtatcctgtgatcctggcccttggctattttgggggcttgtctgtaactttgtttcttttctgtgctgtgtatgcaacaaaattagactcattcttttgccattgagcattttgtgtcaggttctcatccactggggttcctgcctgtgattcttttccccatctgggggaagttaactgatccttgagttggaagagaaaataggtacttaagagaaaaggtgttgtggcaacctaccgttgggcaagtactatacccgcctagctttacttggttcctgtacaaatgggtggcagctaaagattcaggggtaattttgatctctggttgggtcatgacactctcagatcttgtacttctcaaggcagtcccaaaagttggatgaagtagctgtccctgtcactcagtagaacaagatgttttggaaccacttgggaaagaggccccttttgcctctggaaagcttagcctaagctccctggggagagattcacctggggacctggctgcacattagggcggaactacttgctgtgttgaggatcagagctgtgttggccaaaaagcccagggaggtggcagctgtcttgttgccatgttagccgcctcccccctccaaaagcctttcagggtttctgactgccttgttgggggtatagttggcatcttgttgggaggttgaaataataccctgacccatggaaaggagtctgagattccttctgttgtgaagtcttttgctactgtattgtcttttggagttttgctagtttttgtgatgggacctcagggccttgaatgtgctgggcaagtgttctaccctcaactataccccatccaattattgtaaaagtcttatttttgtgactaatgtgcctaatctaggcaaatcatttagcacttgcccttcccttcccagcaaccagccatgggcttacatttgtctaccagtctaagaatgcaaaaccttggtcataaatagcctgtggccccaccaaatctttatgagatatctttgtttgatgagggctttgctattttctagggtagtggaatatgggggaagaaaaggagagagagccaagtaggggttgtcttcctgaactgttgcacggaagcacgaggaaatggaaaacaatgtccttgggttataggacagtagggaatcttgacaatgactgtctcctcaaggaggccctctctgctccaactgccttgacccctttcttccttccattctctgtagagtctctgcaggaggtatcacccagacgggcagatcatgctggcagcaacaggggtggctgagaagtgaaaggagccagctactgaggaggggccccagcagcccctaaaactcctatcaggacatggagtatgaaagacggtgagttatcccctccctcccctcccagtgtgagcactggtttaggatgaagggcgctctaggcaggagaaacaacacagcaaagaaatggactcttttcagcacatgtgcatctgtgctctgagaatgcacaggtgaatgacacaatgactgtaggtctcccctgtaagagactgtcttgctatgtatagcattacatggaagagcacatagtttacaggtgataccaaacagcctgatgagtaccatgactggacgtgaaggtggggtttttgttaatatgggtgtggaggccagagagtggtgccaggtgtccacccaattgctcctccatcttagtttttgagactgggtctttcattgaacccagagctcacagatttagctatactggctggccagcaagcctgagggagtctctttttttctacctcttcatcactgggattgaaggcatgtgctacacctggtgtttttatatggacactggataatcaagcttatgccctcatataccacaagaagtttactgattaaggcatcttccaggcctgcttttcttttttttttttttttttgtcttgagacagtttctctttatagtccatactggccaacttgtggttttcctaagacctggggtgacaggtgttccaccacacccagtttatacacaaagtgctttggtttggttttgagatggatcttgttctgttaactaagttggtctcaaaatcttgagctccagttctacttcatcttccttagtagctgagaaaacggggtgtgacatctcatggtatatatagttttgttttgcttttcagctagttgtgttttgctcttcagctctgataaaaaaaaaagtagtatacttggtaaaatttagaaacattgagtgtaagtataagatcctttagcactctggtagattcctgccccaggtgattctgaaatcagcgacttagctaccatattttaagagagcccagggggaataaaaagccgggcagtggtggcgcacgcctttaatcccagcactttgatcccagaggcaggcagatttctgagttcaaggccagcctgctctacagagtgagttccaggacagccagggctacagaaaaaccctgtctcaaaaaaccaaaaaaaaaaaaaaaaaaggcgcccagaaaggcaaaccaaactcttacagaaaagtcataataaatttgctggacatggtacttgtaatcctggcatttggaggtggaggcaggaggatcaggaattcaaagtccacttgtgctacttgagatcccagcttgaaaaagcagtcaataaacgtataaaacactggagagaaagcaggtttgggaatgtctttgttggcccaaggagcaaggtcctagaggttaaacctagggcttgcactactcagcaagtgctgtacccttgtgagcaagtgctctgctactctgtacctttacattttgctcggagatagactctccattttccaggttgttcttgtacttgatctgtagcccagaccagatttgcaactgtcctacatcagtttcttgagtatctaggtttacaggcctatctatgccactggacccagcttatagatgccattttacttacttattttattttatgtatttgaatgaatgtctttgcatcacacatgttattggtacctaccattggatcccctggaactggagttacggatggatagttttgagtgagccaccatgtagacgcgagaaatcaaacctgttctctgaaagagcagtccagtattcttaactgctaagccacctctccaaccatatttacttatttttgagataacgtttcactgtgtagtctatgtctcccctaccccatctcaaccttccaggtatgggactagcatatgctatcatggctggcattgacttccttttaaaactgtcttttgaaaggcaggcgttagggtcaatacagtactccctttgggaaagatttgattgtagaccataagtataagtaataagtatcactataagtaatgtgtgattgagcttcaagtagttatgctttgaaatttgttgccaaataaagacttctttttaaagatttatttattttatgtgtatgagtacactgttactctcttcagacacaccagaagaggacatcggatcccattacagatggttgtgagccaccatgtggttactgagatttgaactcaggacctctggaagagcagtcagtgctcttaaccgctgagccatctcttcagcccaagacattgtttttttgtttgtctttaaataatgcataggtttaagttaatcccactttccagttctgcaaaggtcttatcacaggaggcctcctcttgccttgtttatttgtttccatttattcccaatttccatctctgtaggcagcagctctgttgtacttaatttgtatccttgtaaatattgttgtctcaagtatctgttttcagttctcataaacaacagagtgctgcagtctttcttttgtttcctgaattccacattactcagcactggatattttgggtgtctctattgccatttggatagtaatgtttcatctcttaactgttgccaagggcaccatgagctatgtctgttatgttttacttaatagtatgtgactaccaagctgggcggtggtggcgcacacctttgatcccagcacttgggaggtgagttccaggacagccaggactatacggagaaaccctgtctcgaaaaacaaacaaacaaacaaacaaacaaacaaaacaaaagaataaataatgctcttttgttattgttgagacaggatctcacactataattcatgctggtctgaaactcaccatagcctaccctgacctgagtcttgtggcaattttcctgcttcggcctcctcactacctgtttttaacaagttcttagcttccttgttttgttttttgttttttgtttttttttgagatagtcttaccttgatcctctcactgtcatggaacttgttatgttacgtagaccagactggcctctaactcacacacagccacctctcaagtgctgagattaaaggcatgtgcctccatgtccagctcttcctgtatttgtgtttttagaatcttttctttttcctatgcagaatcacataagagttttggtattaccataaagtttcaccttttgcattcacatctttaattcacttagagtccagttttgaatatggtgtaagataggttttaggttttttccttcacatagtaggcagtttgctgggtaccatctcctaactagtagttcattcttgctcaagttccctccttgacttagccttataccatgaccttactgttttcattcctatggattaatacatggtcttaatagctccctcttcgttcttattttttaaagtcgatgtaaccatttatggcgattaattacatgtaaaaatgaatcaaggggcttagtgggagagcatttgcttagtatatgtgagccctaggttttatccccaacattccaaaaaagaaaaaagatcaagtctctcaaaacaagactttttctttttttggtttttcaagacagggtttctctgtatagccctggctgtcctggacctcactttttagaccaggctggccttgaactcagaaatccgcctgcctctgcctcccgagtgctgggattaaaggcaaaacaagacttttgattgagattacatcaaatttctgtatttggtgaggggggaaatttgtcatctttctaagtagtcatctttttctaggaactttagtgaaacaaacttaaatggcataaaaaactactgatttaatatcctattctgttaaagtgcagttccctaggaaactggaaagatagttagttggcttagcttttaagagcactctttcagttcccagcatccatgtccactaattgctctttacctcagagccatctcttcaaccccaatttattttatttttatttatgtgtatgtatttatgtgtgagtgtagatgtatgttcccatgtcagcctatgtgtttacatgtgaggggctgtgcatgtatatgtacatatatataggtcagaggacagccttaagtaccatacatacttgagcacttgtgtttgagataaggtctctcgttggcctggaacttcaccaagtaggctagcttagctagccactgagctccagggatccacctatctcctaggcttgacgtcactggattacaagcacatactacttactatatctgactttgtatctggattccggggatctgaactcagggccttatgctttagaggcaagagctttactgacagctttaccatctctcgagccatatacacatgggtgtttggtttttgagacagtttctcagtgtaatacacctggctgtcctggaactcactttgtagaataggctcacctgaaactcagctcttgcctgcctctgtttcccgagtgctgggattaaaggcatgtgccaccacatctggctcacgcatggcatttttataattaaggatattaggtgtggtagcacatggcctgtaatcctagccctcaggagatggaaacagaatgaatcgttattcaagttactacataatgagttccaagcttgctgaagaccctgcttcctataaaacagaacaaggcaaaagaatattgagggctgactgtgggtataactcagaggtagaatgtatgcttagcatgtaccatgccctggcttccatcaacagtaaaatgtggagggtaaggagagaagagagatgagagtggtgggtgtcatatgcaataaatagaccactgtccctagtcctaaaaggacatgttcaaaatgcctccattttttcccttttttccttttctttgcttttaaaaaaaatttaagacaaggtctcaggctgaagagatggctcagccattaaaggctaggctcacaaccaaaaatataagacaaggtctcactgtataggccaggctgacctcaacatagaaatctgcctgccggggctggtgagatggctcagtgggtaagagcacccgactgctcttccgaaggtccagagttcaaatcccagcaaccacatggtggctcacaaccatctgtaacaagatctgacaccctcttctggagtgtctgaagacagctacagtgtacttacatataataaataaataaatcttaaaaaaaaaaaaaaaaaaaaagaaatctgcctgcctttgcttctcaagtgctgagattaaaggtgtgtgccaccctgcccagtcagaatttttctattgagtataatgtatgaaggaatttttgaaatacagcttttaataaatcaagaaaacttgggctggaagtaatgaatcctattatcccactgtctagacgctgaggcaggaggatccagagtttcagaacagtttgggctatgttgtgagaattgtctcaagaggaccaactaaagagaattgagcagtacattgagctaatatgtattttcagtcttctttaaatctgaaatattcagtgtttgtcttctatctttttaatgtttattagtatatattttatgtaacagtgggctttgtgtacttttatacttcatattcactccccttcctactctattcctgctaatctcctgcctttgctcaactgtactgtcttatattttcacatatttaaaaaactatatttatcttgggggggccataagtgtgtggaggtcagaggacaacttgggagactcagttcttccttggcaataagtgtctttacccactgaaccatcttgtgccttcccccagtacttttcattagggttgtttacaggagcattggcaccttgccagtgactataccactgaaaaaaatctctctccctccatcaactattaactgcctataaccttcttggagggataggaacccatgagtacctccactcctgtagcaggatgtgatgggcccaatcatgagatgttgctcaagtgatcacagctgtaagttaaaaaaaaaaatacaacagccatttcattccctgctccccctcaaccaacccacaccttcctctactgagtattgttttgttttttgttttttttggttttttgggtttttttttgagacagggtctctttttaactctaagctgtctttggaactcagagatatccacccacctctgcctccagaacgcccacctgacctggtttttttattcttaaaaacaaaattattgtgtgtattcattgtttatggtactattacataagggcaatatatgttgagcatattctctgccctccccacttttcatctttgtgttagtctattttattcccttagacagttttgcttctactttcttgttaaatacatacgcttttatgtatctataaaaagtttaggaaccacagaaaaagcatgatgtctatcattctgaaattggctcgattcacttaatatgactatacccaattgcatccattttttgaaaaaggtctaattccattctttgcagctggataaaaatgtcattatgtttatatagcacaatttccttatccattcctttgttgttggacaactagattggtttcataagttagttgctgtaaatggtctgcaataaatattgatgtctctgtgatttgttgacttggagtcctttaggtaatgataaagctagacctcgggagagatctatttttagtttttgtgaggagcctccatacagtgttgcattgtagctagtctattacattcccagatacaatctaggaagacttcctgtcgtccacgctctcaccagcattattgttattttaaaactgctaagttagccgggcatggtggcccatgcctttaatcccagcactcaggaggcagaggcaggaggatttctgagttcgaggccggcctggtctacaaagtgagttccaggacagccagggctatacacagagaaaccctgtctcaaaaaaccaaaaaaaaaaaaaaaaaaaaaaaaaactgctaagtttagttggtaattgtattagtttggttattttgtatctttgttatatttatctggaattggatcaagatggcctcatggtataaattagacagcttttgctgtttttgaagaagtttgtagaaaagtcactgttgtggtagtgcatgcctttaatcctagcacttctgaaacagaggcaaggcagatctctgagttccaggctagctcaagttagatgatgagatcttgccttttatcccagcacttgggaggcagaggcaggcaggtttctgagttcaagaccagcctcgtctacagagtgagttccaggacagccagagctatacaagaaaccctgtgtaaaaaacaagaaaaacaaaaaaaaaaagccaggcatggtggcgcatgcctttaatcccagcactttgggaggcagaggcaggcggatttctgagttcaaggccagcctggtctacaaagtgagttccaggacaaccagggctatacagagaaaccctgtctcaaaaaaccaaacaaaacaaaacaaaacaaaaccaaaaagttatggggctggagagatggctcagtggttgagagcactggctgctctccgggaggaccagggttaaatcccatcacccacatgatagctcacagctgtctgggatctgacaccctcacccatgaatgcagacaaaaacatcaatgcacataaaattaaatgaattatttcttaaaagttattctaaccttaaaacttagtggaacttactttccgagggatctgtggtccttgtttgttctggggcgagaacccagagagctctaccacttgctatgctccagcctttggtgcatgtttacatgtgtacatgggcaattgtatgtgcacatacatatgtgtgtatgtggaagctagaggtcaactttgaacattatttctcaggaatctcctaccttgtttttgttggtaatatttgtgtgtgcatgtgccatgacacacaggtccagaaacaacttgcaggaatctcttctctcctaccatatgggttctgaagattgaactcgggtcctctggcttggtggcaggtgcctttactttttttgggttggttggttatatgttatattatattataggttggttggttgcttgcttgcttggtttgttcatttgttggagcagggcctctctccacatacctctggctgtcttggaactcactatgtagaccaggctaccctcaactcacagatagtcctgcctctgctaccacacccagcagatagctagaggtccttttatatctgcctcacctgcctggcttgttatattggtgttggacatcaaacacaggtccgtaggcttattcagtaaaccctttactgactgagttctttcctcgaatacacatacatcataagcatgcaccatgcccagcggattctttgttttttcagcattttattatgaaaatttaagcatataacaagttaaaagaattttacagtcagtacctctctatcaattaattaggttctatcatttaccacactcatcacgtgttttttttttttttacatgttagctctttttaactttcacaaaatcatatagtcccattggggtttgttgttgtgctgttttgtttttcattttacaatttctgggttctctttttcaaaaaacagttaatgtgtatgagttttttacctgcatacatgtctttgcaccatgtatgtgcctggtacctgtagacactggatgtggacataaaatcccttggaattggagttacaaatggttatgaccctccgtgtagtactaggaatcgatcctaggtcctctgaaagggcagcgggtgctattaactgctcagtcattttttttagctctcaaggatttggtctctttgccataggagacttcgttttattttatttttaaagatttatgtatttactacatgtaagtacattgtagctgtcatcagacaccccagaagagggagtcagatctcattacagatggttgtgagccaccatgtagttgctgggaattgagctcaggaccttcagaagagcagtcagtgctcttaaaaccactgagccatctctccagccagagacttcattttattgttgtttctttgtttttgttttttgaagcagagactatgtagcagtggctgtcctggtctcctctatacagagatctgcccgcctctgtcttcaaagttttaggattaaaagtgtgctctaccaccacctggcaaacacagagttttaaaatcttctgtgttaaaaatgtcctggcttggggttagccgaggaactattgacagttgaagagtctgttttccttaaaggtgtggcctctgattggttgaccactttccagtggatggccctacacctatataagtatataggcagtacaaattggaatcgatgggctatttaaacaacaaaaacgaggacatgaaattgggaaggattatgtggatctgggaggagttacagagaagtggaggatgaatatgatcaaaatgcattgtatatatgtatgaaattattttttaaaaaccacaaaagtgttatcaaaagtctgccacagatcttccttatagaaggccagacatgatggcatatgcctttcattctagcacttaggagacagagttatgtaaatctctgagtttgaggccaacctggttggcatagtgaattccaggtcagttgggactgcatagtaagaccctgtctcaaaagaaggaaaacaaaggaagggcgggggaagggtagaaacattccaaataggatagatatttcttctcatcagggaacagcttaattcttctcttgagtgtgaggtagttttagtgattttcctctaaattaaatggtagagtatggagaaaagaaaaatagaaatttctttttgagatatggtctctagcccaggatagcctcaaactccctatgtagcttaggatcatcttctggttgtctgcctcccaattgctgagcttacagacaagtaccaccatgcctggttctgacacggggatcaaactgagggcttcatacctgcatacacgtaccctaccgtaaactgagctacattccctagcccccgaaatcacatgtgggtgagaaaaataaccacatgatgaaggtctacatcaccagagataagtcataccactgctacttgataatcagaagaacgtctcacttttgttattgcttctcaaccaaacaaaccccaaaacttttaagcctaatcaaaagatcacatcaaataaaaccactacaatccttaaaaagagaaaataactataaagagaagattctatatattaaaaaccttaaacagggtaggtgttggtggtgtggtgttgcatgccttgagtcccagcacttgagaagcagaagcagacagctctaagttcaagtatagctatggctacacagagaaacactgtctcaaaaaaatatatatatatacaaccaacctttcacaggccaaagatgactttggcatccttcaagtaagacatactacaaatggctcaatgattaagaacagttcctgctgctgggcatggtggctttatgcctttaattaaagcacttgggaggcagaggcagaggcaggcagatttctgagttcaagaccagcctggtctacagagtgagttcccgggcagccagggctatacagaaaaatcctgtcttgaaaaaccaaaaacgggctggtgagatggctcagcagttaagaacactgactgctcttctgaaggtcctgagttcaaatcccagcaaccacatggtggctcacaaccatctgtaatgagattagactccctattctggagtgtctgaagacagcaacagtgtacttacatataataaataaataaatcttaacaagaaaaaagaaaaaacaaaaacaaaacacgtcctgcttttccagaggtcgagtccatgttgggtggctcacaactgccctttacaccaactgtaaggaaatctcgtgcttctggcctccaccggcaactctactcacctgtacacatgcatgtacacacacttaaaaactaataatgaaaataaagtttgcaagataacatacttatatgagaaaattggtgaaatcccaataaaacctgttatctagttgacataatgccatggtcctctaagtattaggggaaactgggcagaggggtatgcgtgggtttttttatctttcaactttcctgtaagtcaaaacatacttcaaaataagtttaactttatcaagattagaaacttccagatcaatggacactcaagatgaaaagaaattccccagaataggagaacatatctatgtatatctggaaaggggttcctatctagaacatgtaaagtacttttatagcaagaaaacaaaacaatcccaattgaaaagtggtaagggctaaggatagatatagctcagccactgagctatgtccttaaacctttagttattaaattccccaggctggccttaaatttgtgatcctcctgttttggctttcttgaatgctatgattacagatatgagtcactgggctatattttctttattttatatttatttacttgtttgtttgaaatttttataatttgagtcatggtctccctctgtagttgaaaatagcctcggcatttccctctttctgcctcagcctcctaaattctgagattacagcatgtaccactactcccagtttgcttgcttgcacaagttcattttctttattttcagtgctgggcacaggacctaggcctttgtgcaagctagtcaacatagagctgcacatctagctctttgggtttttttggttggttggttggttggttagttggttggtggttttttgttggttttttttgttggtttttttgttgttgttgttggttttttgtttttgtttttgttttttttgtttttgttttttgtttttgtttttcgagacagggtttctctgtgtagccctggctgtcccggaacccactctgtagaccaggctggcctcaaactcagaaatctgctggtctctgcctcccaagtgctgggattaaaggcgtgcgccaccaccgcccagcgtgtattttgtttttaaatataactcatgattgtttctgggtaatcttaaatatttttatatagttcaattaaatgattttttctatgccttgggatttgggttattgctttttcccatttaagagtagggctaagggctcagtgggtagaacatataaaagattatgaagaattgttttcccagtttacttttttctttttctgatttgagccagggctttgtacatagcaccatggtgcatgctccaccatggagctttagtcatttgtttgttactggtgtaaggtggtcagaggacagctttgtggcattggttctatccatctaccttcttctagattctgggaatccaactcaaattgttaggcttacattggtgagcagtaagcacttttacctgctaagccatctttctcttactccaccttacccctgtgcttttttttttttaaacatagcccaacctggcatcaaaattaggatcctcctgccttaacctgggattataggcatgtgacactacatctggcccttgaactttttctattatggcttaatgtccttccatttacatctttgatccaagctggcatgatagtccaggccataatcccagaatttaagaggcaaaagctagtcttggctacataatgagttcaaggtcagcctgaaataaataccaaaaaactgtctcaagaaaaagtaaatcaggttgtagtagttcatgcctttaatcccagcacttaggagatagaggcagtcaaatgtctgagatcaaggccagcctgatctacagaatgggttctgtctcaaaaaaagaaaaccccaaaacaaaggaaaaggtaagtaagtgaatcttcatatatgtgaagaatagtcaaaagatcttacatgtgcatagatattaataatttatttaaagatttcttttcatttttgtgtatatgtttgcatgtgtgcacactgatcccaaaggagctgaagttacaggctgtcgtgaaccactttgtgggtaataggaatcaaaccagggtcctgtggaagaatagtcagtgctcttaactgctgaaccatctctttagcccaatatttaaccttttagatgtaatcataggtagttgtcttcctgttttccaaacaatggctatttgaatgtaagcaaaatatatattttgtatattaattttatagccagaatctttattaaatttatttgtgtgtgtctttacgagtgtatgcttacatgtgtgcatctggaagccagaagtgtgcatcacacctgctggagctagagttacttgtgagtgagctgactgacatggatacagggaattgaacttgagtcctctagaagagcaaaaagtactcttaacctctgaggcatctctctagcccctgatgttttgtttttttgtttttaatcatcagcattgctgttagtattttgggagtactgaagttagcgcaggccttgaatgtgttgtcattgaactatatacccacagctcctaatttattacttgtattctttcttcccttttttttaaaaaacatgattcatttaggctttgcagggttattctcattggccacaaataatggtgattttacctttacaggtttttttgttttgcttgtttggattttgttttttagcttttcaagatagcttctctgtattaccctggacatcctgggactcacctttatggttcttaatgcttttttttttctttcttccacttacttaattgttttagttagtgtcagaataatatagtctaagagtggtgtcaataacagactctaatgtattacttttcatgagtggactcttaccgcattcttctaatgggcctgattcttcttgcttgaccatgttcttttttacatctttatttttttttctccaatactagatattaaacccagggtctcataggtggtctgccactgagttaaatagccatagcagcatatttcctttttaaataaacacgtattgtttaaaaaaacaaaaaaaaaaaaaaaccagggtctcatataaccttaaactcattttgtactttggctgaccttgaattcctgatcttcctacctccacctctcaagtgctgtgattataggtatacactgctacacctgccatacgatactcgattatcatcacccactgactcccatatactatgttaagctttgagaaataaggtagtaagcccagcagtcatgttccatcatttcctagaactcacctttaagtaatgttgtttgtttttttgttttgacgtgtgaagagcccagtaccttctacataaagggcttgtgcactgccactttactacacgcacaaccccaattttcttaaaatgtgtgtggtgggggaatctcactatattgccttgggcttaaacctcttgtctcagcaccttgagcaactgagactacagacctggtaatttttctcagtctgagatggaaaccagcaattttcatatattagccaagcactctactattgagctatatccataagattaaaagattactatcgagccgggcatggtggcgcgcacctttaatctcagcacttgggaggcagaggcaaacggatttcagagtttgaggccagcctggtgtacaaagtgagttccagccaaggctatacagcgaaaccctgtctcaaaaaacacaaaacaaaacaaaaagattactatcttttaactcatcgaagatttacaatttaaattaactttgaagtaattgttttatagttaactatagttagagaatttttaaatttttaattatgtgtatgtgtccctatgtgggtatgtgcgtatgaatacaaaagccagaagaagacgctgaagttggatttataggcagttatgagcatctgcccaatctgagtgccaagaactcgggtcctttacaagagttccacagttggagaaattttacctgaagaactaccaattctagcaatatggctttgaaataggtagagtgacttcgtagggcagacagagatagagctgcagagaccttaccctgtagggttggtgggatcttgatgaacatttgggtgttcttatgtgtttatttaggtgaaattactaaagcaaatggcatggttgggttgatgaactttatttagagagcactcatgtttggaatttgaggtgaagaattcagtcaggaaaccgtacctgatgtacatgtggactagaggttaggaaggagcggagatagtgggttggctttaagagcctgtgctaattagcccatgcagtgaagcgagacttttcagagtcctagtctaggaaatgggactgaagccctagagagggggttgtaggttagctttcatatcttgagccttttggaaaatctggtattctaactcccatccttcttctagaggtggtcgtggtgacaggactggccgctatggagccactgatcgttcacaggatgatagtggagagaaccgcagccgggaccatgattatagagacatggactaccgctcatacccacgagagtatggcagtcaggagggcaagcatgagtatgacgactcatctgaagagcaaagtgcagaggtgagggcaaggccaggccttgggggcagtgctcctgaaaggcctgtgtgtctggctgcagcaccaggtgtaggtagctctccgctcctgtgcttttggactacttggttgctttgcgtcacctaggggagggtctgtccctgctcccttctctgaggactcttctgagttgagtctccctggctttcacactgcttgactctgtatttctcagggctcctagccactacttctttcccttcttccctgttgttcagttttggcctttggttcactgcaagttctatactgcttactcccaccaatttagggaactcaaaaggatctcttctatgggacccagcatctagggttgggaggacaacctgagagcaaaattatcaaccaatccatacaactctgggaggctaacactgactgtttctggtcttgacagaaaggaaggaaagaagctttggggaagtcagtcccatgtaggtagttacctccagcctaacgggtacaatgctcactatgagagagcacatctgagggctagggaatttcagtctgagagggccagggagatctaatggaagcatataggcagatagctctctgtctagtaggatggaaagggtacacttttgtaagcccagccctgtggagaaattatatttaaaatatcttctaccctctgggtatttgaagggactatcaagggattccactgataaactacaagctttgtttggttagccagggcttacaggcatccaggcttctccattgcctgctactgtgcagtatctcttagtgtctccatgggtacagtggaccttgtgaatggaccattgacaagtgtggaacatggcatccagttgtctggacctgtcccctgcaggtttggggggcggtgtagggtcatgcctgacctgcttagtattgaaattagtaggttggacaattaagaactcaacaaccacactctttgtgaaggagactgatagtgaacagagacttttccaggcctgaggactaaggaccaagggggagtataatggcccatgaactcctgctggctgcctctggcccatatctgaaactatttctgaactgatggcttggttccagggcccaatcttaagcagggaactataggagacgggtgtttttcagtgccacagtaaacaattgtacacataccagctgagctggcaaaagaagacattgaaagcaaagtctagtttgcttaccccaggctagtttatcccaaggaggtttaagcagtgtttctgtcggcctgcctttgggagttcctcctccacaccaatattgctgttcttgaaggcagctcctagaaataccctgtggaacatttgcagccttaaaaagcctgagcctttaaccggagcccgcctgcccacccctggctttcagagcctgcctgtctcagagagccagtggccagccactaggcccacccagactgactacccgtctggtgtctctcatctcattctgtcggccaggattcctacgaggcctccccgggctccgagactcagcgtaggcggcggcggcggcacaggcacagtcccactggcccgccaggcttccccagagacggcgactatcgggaccaggactatcggaccgagcaaggggaggaggaggaggaggaggatgaggaggaggaggaggagaaggccagtaacatcgtcatgctgaggatgctgccacaggcagccactgaggatgacgtacgtgcccccccaatggccctgggcaggaggcaaagcaggaggccaggctgggtctcctccagggccctcagcttctctccacccatcttttgccaccaaccacagcacctttcctctcttctcccccaccagctcctgtcccccagtactgtccatcctccaggatggccccatcagttcctggtctggaagggagaaggcagcagacaggctgacttgacccaggggcagtagccatgggtgtccggtgctggtgggtgtgagagaagaacatctctcctgcacattccattggctttcacccttttgtatatgtggatggagaaccaggcccactgttgggtattcttggtgtcagaaacccatgagagtgagatattagggtccatgggcttttctgaacttccatattcctccccttttgtcagcagtgacagcctggccgcagctacccataaggtggctctttgatagcttctcaacctgtttgcctttgtgacattctctgccttccatcttcctctcttcactcattcccttctcgcgcagatgtcttatggcaagccacaatcaaaacccaagagtattactaaagtagaattttgactagcttccctggactttgtacctctctaccctcagccccagtcagttctctacacagtgcttccctggaagcctgccagctacccattttctaacagtagtaatcccacctaagaaatgtgagggcttctagaatcaggctgatagctgacattacctgttgttttatggcagggtgggccacatgccaggctgattgaatcctcacagagcctctttctggaaggtatacattgtagtcagtcccacatagccccaatcagcaaagtgacttgcttcatgttccagcaaatggcagagcagagttggggtttaaacctggactgctggactccagagtccaagttcttgatatttcctaagtcctccctgattgtttggaatcttgataagatttgtgtatcttgacttttcatcttctgaatacctgtgtgcttaagacttaatttcttgtcttgtaccctgatggggagcagatgcccagaagcacagagacttttactgaagtatctggcataaactccccattcacttaaagaggtactgccagcctagagaatgcctcacctgggctcttaagttgcctctctagtgtccctcaaactcctttcactcaggaagctttccagatcaagcatcatgcctatttgtcttcacatttctcctgacatggctggaatggctccggctcctgtccttccctgtttactctttgtgccctaggtagctttagtgcaagtcaaggagagggagcagttccttcgtgatgggcacaagttgtattccagcttctatgcttcatggctgctactaagcctcttgtcagatcaccctgcctaccattcctgatttgctgcctcacttgctctcctgttgtctttgtgcccctggaggtcatcttgctgccatccttattccgtactgttttctgtctttgtttgactcactttctgcaagtccaaagctggaagcgagactgaatactagtgtaggctgcagttgttgttactggggaaagctttgaaagaggtagaggacgcaggtgtgtgtgggctgtgtgtatgtgtttctttcatgaccccttggggctcagaggccttgagctggcctcacatactcagccgctttctttgctgaacatagcctgcttctgtatttcctgaacagatccgtggacagctgcagtcccatggtgtccaagcacgggaggtccggctgatgcggaacaaatcctcaggtgagctttcgttcccagtgccctccccttttgctggccagcctgagcctccgatctccctctgcctctccctctctcttcccttccctgctcctctcctgccacagctgggaatgggcagcttgcggggggtgccctctcctttctcccatcctctactctcacagctccagccagcagcctcagggttgctgtcctgaaggggatgcagctctgggctgagctgactactcccaggagcaaggccagagtcaggctctggaaaaccttttctttgggactttgagtatctgaggtggtgacccttcccaggacatacatttttttctccttcctctgccccttggtgtcctccaccctgacaacagcttctaatgaaaagtaggtgtgacatggacccacccatatatcccaagaagggaggcagggatggctttcatcgaaagggtatcctaaggagcagccagaactttttggccttacctgttccctccctccctccctccctctttcaggctgcttggagctggcctggggttttagcagggtggagggctgttgtctctgcaggactactgcccaggctccccaaggcagacacagtggggcctcactctgcctgggcttctctttcaatctcagtctctcctccttccacctcctccatctctccatcgtcccttgtctgtttccctatactcttccatccttccatgcatcctggtgatgattcttttggagatcaagcatgcccctccagacccgccacagccaaaacttcctttcatgactacctctgaaggaccttaagcctcaagcccctttctcagtcctggccaggcctggagactatgtcaatgacatgtaggtcttgctctgctttactctacttatatcactcactgacagaatctctgtatctttccctaaggaggcatcctaggtatggcctctcagtgacttcggtcatttctcctaggcacctgctgactcttacctataacatcctcttggccggctccagccaccatctgcctatttaggagaacctcgactgtcagtggctatagtctccctactgtggcactgaagtgactccctagtgatcatcatcccctttcccacaccaaggttaagctgacattacgttcctaaccacctctgctttcctgtgtgctgcctggaaacccccagtagcctcatagaccagcttagcctggcttctcttttgctcttttgattaaacacccgttccaggactcctcctgggcttgctctaggcttgcccatgagttgtttgctctggactatgtgaagtcaaagcaacctcctcttctagagacagatctctccttgtatcccttccatctcaggtctccatctgtcaccccaagttagctaggcaagactaccagagacccatttcactacagttatgctgatctgactcatgctttcattttcttccctccccttttccctctttcctgcccttcccaaccatctaccttgactcctgccttccctgttctttctctgatcactttttctcttcctttctcctctccccctttccctctctgcccctggtccactcccctcgggttctgcccccgggaacaccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccctccccccaaaacaaatactactttataatcgagcgctccccatcgcctgaatcttatggacacagttccctgccctgtgaccctgtgtcccatatccctgcccctttttcccccctcctgacccccactatttcctcttcccatctctcactacccactgggcttcccatttgtggcccagtctcaacactgacccctggcccccttcctactgccaggcactagcgctccctcacctctcctggctgagctttcagagaaagagctgccagggtgggttcccttcttagcttcccagaccccagcaggacccttttgctcccgagtcagcagagccagaacttggttgtgctctcaggaccactggaggtcctgtcactgagggaacatagatgttggcacataaactagcaacacttgttttgccagttttctcctgcatgtgaatttggccctctgagttccatgcagagggacatcactgcttttggttgaaagttccagtcaagtgtgatagttttattgacaccgtgggctcagttcactggcccctcccattcacagcaccctccccacccacaggaggccccacctctaccttctcagtaaggaactgtgctctgtcagctacggaggggccagctcccctagcctggcactgaatcccaactcaactgcgttgggaccttccaagactcaagggtctaacctggctacccagccctatcctgatgtagagtcactggtgtagagcactggaaagaagtgtcaggggaggaaggggcagccgtggtaaagtggagggtcctggcagaggcagccctgtggccggctctgtgggtctggtcaataagctagtgcggtgggcccaggacccggccaaccttgggaaggtggcctcatggcgggaaatctccgtctgttaaattggctttctttttccccttctccagcattagcgctcgtgcgctctttctctttttctctcccctcctctctcttccctgcccatctcccctcattcccagtgtagcctgtgtagtgctagccctgagtatggcctggcactgtcaagggccaagctgggggagccctcccaactctcgacagtcgttggtcaaccaagtactatgtgcctgattgtgtttgtgtgtgtgcgtgcgcgtgtgtgtgtgtgtgtgtgtgtgtgtgtgtgtgtgtgagtgcgttcgtgcgtgcgtgcgtgcgcacgtgcctgtgagtaaacagcaaacagatgcgccctgagagctgtggcgctttccttccctcatccccatcccgtccctccgttccttcttccctccatcagttctccaaactcccttcattccctgtccctcatccatccagctgaagggctcgctcactcttttctcctttgctgaaacggtatgtggggcactgctacctgggtcttgattgtgctctgctttttcccacagcactccctcaacatcctgggccagaaggtatccatgcattacagcgaccccaagcccaagatcaatgaggactggctgtgtaataaggtacaggggtggatgggtatctggtgctggggagaaagtcagttccagcaggagcagcagcagcagcagcttacttagtcggagaaggcgtagtcttagagatatgttgtctagccccagtcagtaggctctgtcctcatcaaacacagccttgcctaaaggtccagtagagttgaaagaaataatagcatataagtgactaatcggtgacaacacaagcctactatagtatataggacatgggcttcagagccacactgcttgcagtctgtctcaggtctgccttgatgctggtcaaggtgcttatcctacctctgtatcacttttctcatctttatgtgagtgagcactaatacagtgttgaaagaatgaaactgttggtgggagaataataaaggcttctggctcacattcaactctgtaagtggctgctgttccctttaaaaagaagcagagtgttctgaggtaactcagctgtgtctaccttgaaggtccctgtaggttatgtgatcacgctatattccctaagagaaagctaaggctcaggtggaaccatgcatgagcttttagctcgcagggccacctcctgttccctacgtggccttaggtctgccctgaggccagcattgtgattctgcaaccccatctcctggggctctctgtagtcctaaaacctaaggaaagctgagagctagtggaggaccctgacttttccctgaggagtctgcttagtgggagagtgctatctgtcatctttacataggtgatcaacctttctggagagagagggacaacatgatactggcacttcatcttttttttttcatattttccttgaagctggtgtttgctttgtgttcttctcctcctttttgtcctgcatgtctttcagttaccagatcctgtcccatccatctcagaatagtcaccttcctttgctcttcttacagttcatgccagttcctacaccttcccatcgagttcccatagagccctttttgttgttagcctcactcctctttctccacccttacctgtaatgttgcagctgaaacctagctctgaccatgccttaccttctctgcccaaaacatgagtctctcctttaactgtcaccatcttcccttgccagccttgactttctctctctgcatgccccccccccaacttcatcagctatagaaagtctcttagcccctccagcaagactaaaacctctggatttcccagctctaactgccctgcttctgtgaagcccagctcagtgagctgaggccctttcagcccattctctgctcctaactcctatcagtgcagtctaagcagactgtcctgaacacatgatgttgggccttacacaggagcactgtttagtatctgaccggaacagagatagagttgtgatggaagccgaacaaggtagctggaatatctaagaaaaaagtcaaaagtagcagaattcaatctaggcctagcaataaggaaggaaatgaatctgactaaaagattgtggcttccagtaggaaacagtgaaagtttctgttaggtaagcaagtctcaggaagaagggaccatgagatacagtgctgagagttgatagtcccaagaagatagggaagggacacaactgctgtaatgtgtgagagttgctgattgctgaagtaagagggttggtgctgggaaccagttgtcagatttataggattgaagataataaagttccaaaaaactcgtgctacccctgaccctcaaagttcccttctgcgggattatgttgttctgtgggtcgatatttggaggatatcatggaaagtcttgaccccctggcctgtgcctcacagtgtggtgtccagaacttcaagcgccgagagaagtgcttcaaatgtggtgtgcccaaatcaggtgagctgtactaactgggagtggtgagaggcgttgaaggccagtgtgtaggggctggtgaggggtggggagtatggtcaaccatggagcctctaccttcatcatcatcatatttcccaccattcctgacagaggcagagcagaagctgcccctgggcactcggctggatcagcaggcactgccactgggtgggcgggagctaagccagggcttactcccactgccgcagccctaccaggcccagggagtgctaacctcacaagccctgtcacagggctcagagccaagctccgagaacgccaatgacagtgagtcagttgttctttctccttactttataccctagggtatctggtgtgggacctctgagggccaaagaaatggtaatgaacaatacttggtccttattaagggagagtgtttctacctggtgtggggataactatatgatagagagcagagggagaagctgcccacaaactaatttggggggtagatgagagggttcctgatagttgagacactgttgacacctggactgacaagccgagtttcttcaagagaagagtaaaaggaagcaaggccgagtttcttcaagagaagagtaaaaggaagcaagaaaacagggagccgtggggatctttaatgggggccctgaacagactgtcagaggtgcttcctaacactgggccctctcccgcagccattattttacgaaacctgaacccacacagcactatggactccatcctcggggccctagcaccctatgcggtgctgtcctcttccaatgtgcgtgttatcaaggacaaacagactcagctgaaccgaggcttcgccttcatccagctctccaccatcgtggtgagggcggcacaggggggggtccgggcaaccacggtcccggcccccagggtagggaggggggaacctttaccccatcctcaccgcggtcccagtctggaaatggggcaatggagccggggggcctccccgggcctgacccttccgtccctgctacccctctacccataggaagcagcccagctgctacagatcctgcaggccctgcaccctccgctcaccatcgatggcaagaccatcaacgtggagtttgccaagggttctaagaggtcagagccccacctaagctccctcacagcttgccccaccctcctaccttggggatccctgtttcatttccagtttctactatcctccccagggatatggcctccaatgaaggcagtcgcatcaatgctgcctctgtggccagtactgccattgctgctgcccagtgggcaatctcacaggtacttggcctcctctgaccccatcaccctggcatctgactttcttaaaacgagtgttataggccttcctacctttactccttttcttctgcctttatagatagttatccattcccgctccatcctttctatcatccccagtcaccttttggacttctttcttttttaagactggttactactttatttttatgtgtatgagtgttttgcctgtacctgtgcatgtgcaccatatgtgtgctcagtgcctgcagaagtcagaagagggtgatctgaacctagaattttgaggtcttgtgaacaaccatgtgggtgctaggaaccaaacctgcccctttgcaagagcaacaagtgttcttatctgctgagtcatctctccattcctgtcttggtagttggtgctctatgctgttgaacttttttagattgttctgagttagtataatgtgttgcatattgtttgggtgtgtgtgtgtgttgtactgtttttaagtatatgtgccatgaataaaaaggaatttataaatatttgtttaaaaagtctctgggagccaggtatagtggtaagcacctgtaatccccgttcttatgagtgaaggcaagaggatgaggtgttgaaggccagtctttggttctctaatgaatttgaagtcctgtctcaaaaaaaaaagtaaaaattttggtagaagagaattaagagtaagaggacagcaagatatgataatgcctgcctatatttctagcaatgatgtggggagtggtggcaaagtcaggatttctacgagttccaggccagcatgggctacatagttgtaggtgggagagaggaaagaggaaaacaaaagggaaaagagtgagggtgtcttgcttggtatggacctcatcagtatcagcctaggatgtatttgggcatgtagcctttttctagtctctcttttcttccctgttctcttgtgaccaggacaccttgattgtcacttaagactacatgctttctgtcaagtagaaatcctagctccagcagggcaatggtggcgcacgcctttaatcccagcacttgggaggcagaggcaagcggatttctgagttcaaagtcagcctggtctacagaatgagttccaggacagccagggatacacagagaaaccctgtctcgaaaaacttaaaaaaaaaaaaaaaaggaaatcctagctccacatatagggacaggtgcatctagcagatttcttcatttatgtcccctcctgatctaatgatctctcatctgcctctcaggcctcccagggtggagagagtgcctgggctgcccccgaggagccaccagttgactacagctactaccaacaggatgagggctatggcagcagccagggaacagattccctctatgcccatggctacctgaagaacagcaagggccctggcatgactgggaccaaaggggacccagctggaacaggtgagcctcatactctctagctgagcctaattatggggcctagaggcctatggccgtatgctctgacatttgtgggcattcattctccatggtttctcttttcaggtcctgaggcctcccttgaggctggagcagactctgtgtcactgcaggctttctctcgagcccagcctggtgctgcccctgggctctatcagcaatcagctgaggggagcagtggccagagcactgctaccaacagccaggtgaggatgccgctggtcctctggggaggttggtaggctggcaaggtgccccctgagtgggcagggtgccattacgagacactgagtcctgttcccttctgtgacccatgagcagtcatacaccatcatatcacctgctgtgctcaaggctgagctt

SEQ ID NO: 26 - DNA, 30635 bp, mus musculus; identical to SEQ ID NO: 25

SEQ ID NO: 27 - DNA, 33399 bp, mus musculus
gaggtctgttcattttcttcgtaagaagaaagcggtgacatctagatggccctgtagggaaagaggtggagcttctagttgtctttcaacttcaaaggacagcaagcttctaaagagcgggcctcttaggggtagccaatagctactcttttttctggactcctgggccgttctcacagggaatggggaggtagcatatgcttgccaatcagagaatgccagggccagccaatggtgaccggcaaccaatcgtcaaggccggccagagcgcgctcccttagtaggtggatggtggtcggatcgccggctctcttctcgtcgccattttgtgttggtgactgtggccggctaggaggaggtggcaccgagtttccttgggagggcaacgcgtcggtcgcgtctcccctccccctttcctcctttttgctcccagtcttggacttggtagttgcatgcattggctcccatttgaactaacagttctgaaggaggtggtggcgggcggaggtgatgcctgggagccctcccttgacagcccgggccgagaaggtgagcgccgttgcgggtcgtgggatcggaggtaaaggagctgggcgcgtgggagggggagagggccggtgtgcatagaagaggcgcggggacggactgtaccctcggagttcgcacagagctgagggatgcctgcacagcctgcacctgaagagggggtatggtcccccaccccagcttttttcttatgaaagcaaaagcgcgtgcgcgattgggacgcgggatgggtgcacgcgggttgggggaagggagagacagatgggagtggggtactgtgacttactgtatttgcccaccgaactttttatcttttgaaacgcgcgtgtttgcgactttgcggggggtgttcttagaggagggttgtgctgactgcccttgttacttaactatccacggggaaatactctggctgcggcctctattcatttatgtggtgggaatgagggtgacaagcgcggagaaagaaagtgaatatggtttttatccttggggtctgtatctgacctctgatccttatcaggaagcaggcttgttactgatcgaccccaacttagttagtttggggagggggtgcagagaatatatatatccggcgtttcttcttttgggagttgtatctgtaacagtgaggtctatatattcaaagggaaatccgtttaattgtgtctcttataggtatcctgtgatcctggcccttggctattttgggggcttgtctgtaactttgtttcttttctgtgctgtgtatgcaacaaaattagactcattcttttgccattgagcattttgtgtcaggttctcatccactggggttcctgcctgtgattcttttccccatctgggggaagttaactgatccttgagttggaagagaaaataggtacttaagagaaaaggtgttgtggcaacctaccgttgggcaagtactatacccgcctagctttacttggttcctgtacaaatgggtggcagctaaagattcaggggtaattttgatctctggttgggtcatgacactctcagatcttgtacttctcaaggcagtcccaaaagttggatgaagtagctgtccctgtcactcagtagaacaagatgttttggaaccacttgggaaagaggccccttttgcctctggaaagcttagcctaagctccctggggagagattcacctggggacctggctgcacattagggcggaactacttgctgtgttgaggatcagagctgtgttggccaaaaagcccagggaggtggcagctgtcttgttgccatgttagccgcctcccccctccaaaagcctttcagggtttctgactgccttgttgggggtatagttggcatcttgttgggaggttgaaataataccctgacccatggaaaggagtctgagattccttctgttgtgaagtcttttgctactgtattgtcttttggagttttgctagtttttgtgatgggacctcagggccttgaatgtgctgggcaagtgttctaccctcaactataccccatccaattattgtaaaagtcttatttttgtgactaatgtgcctaatctaggcaaatcatttagcacttgcccttcccttcccagcaaccagccatgggcttacatttgtctaccagtctaagaatgcaaaaccttggtcataaatagcctgtggccccaccaaatctttatgagatatctttgtttgatgagggctttgctattttctagggtagtggaatatgggggaagaaaaggagagagagccaagtaggggttgtcttcctgaactgttgcacggaagcacgaggaaatggaaaacaatgtccttgggttataggacagtagggaatcttgacaatgactgtctcctcaaggaggccctctctgctccaactgccttgacccctttcttccttccattctctgtagagtctctgcaggaggtatcacccagacgggcagatcatgctggcagcaacaggggtggctgagaagtgaaaggagccagctactgaggaggggccccagcagcccctaaaactcctatcaggacatggagtatgaaagacggtgagttatcccctccctcccctcccagtgtgagcactggtttaggatgaagggcgctctaggcaggagaaacaacacagcaaagaaatggactcttttcagcacatgtgcatctgtgctctgagaatgcacaggtgaatgacacaatgactgtaggtctcccctgtaagagactgtcttgctatgtatagcattacatggaagagcacatagtttacaggtgataccaaacagcctgatgagtaccatgactggacgtgaaggtggggtttttgttaatatgggtgtggaggccagagagtggtgccaggtgtccacccaattgctcctccatcttagtttttgagactgggtctttcattgaacccagagctcacagatttagctatactggctggccagcaagcctgagggagtctctttttttctacctcttcatcactgggattgaaggcatgtgctacacctggtgtttttatatggacactggataatcaagcttatgccctcatataccacaagaagtttactgattaaggcatcttccaggcctgcttttcttttttttttttttttttgtcttgagacagtttctctttatagtccatactggccaacttgtggttttcctaagacctggggtgacaggtgttccaccacacccagtttatacacaaagtgctttggtttggttttgagatggatcttgttctgttaactaagttggtctcaaaatcttgagctccagttctacttcatcttccttagtagctgagaaaacggggtgtgacatctcatggtatatatagttttgttttgcttttcagctagttgtgttttgctcttcagctctgataaaaaaaaaagtagtatacttggtaaaatttagaaacattgagtgtaagtataagatcctttagcactctggtagattcctgccccaggtgattctgaaatcagcgacttagctaccatattttaagagagcccagggggaataaaaagccgggcagtggtggcgcacgcctttaatcccagcactttgatcccagaggcaggcagatttctgagttcaaggccagcctgctctacagagtgagttccaggacagccagggctacagaaaaaccctgtctcaaaaaaccaaaaaaaaaaaaaaaaaaggcgcccagaaaggcaaaccaaactcttacagaaaagtcataataaatttgctggacatggtacttgtaatcctggcatttggaggtggaggcaggaggatcaggaattcaaagtccacttgtgctacttgagatcccagcttgaaaaagcagtcaataaacgtataaaacactggagagaaagcaggtttgggaatgtctttgttggcccaaggagcaaggtcctagaggttaaacctagggcttgcactactcagcaagtgctgtacccttgtgagcaagtgctctgctactctgtacctttacattttgctcggagatagactctccattttccaggttgttcttgtacttgatctgtagcccagaccagatttgcaactgtcctacatcagtttcttgagtatctaggtttacaggcctatctatgccactggacccagcttatagatgccattttacttacttattttattttatgtatttgaatgaatgtctttgcatcacacatgttattggtacctaccattggatcccctggaactggagttacggatggatagttttgagtgagccaccatgtagacgcgagaaatcaaacctgttctctgaaagagcagtccagtattcttaactgctaagccacctctccaaccatatttacttatttttgagataacgtttcactgtgtagtctatgtctcccctaccccatctcaaccttccaggtatgggactagcatatgctatcatggctggcattgacttccttttaaaactgtcttttgaaaggcaggcgttagggtcaatacagtactccctttgggaaagatttgattgtagaccataagtataagtaataagtatcactataagtaatgtgtgattgagcttcaagtagttatgctttgaaatttgttgccaaataaagacttctttttaaagatttatttattttatgtgtatgagtacactgttactctcttcagacacaccagaagaggacatcggatcccattacagatggttgtgagccaccatgtggttactgagatttgaactcaggacctctggaagagcagtcagtgctcttaaccgctgagccatctcttcagcccaagacattgtttttttgtttgtctttaaataatgcataggtttaagttaatcccactttccagttctgcaaaggtcttatcacaggaggcctcctcttgccttgtttatttgtttccatttattcccaatttccatctctgtaggcagcagctctgttgtacttaatttgtatccttgtaaatattgttgtctcaagtatctgttttcagttctcataaacaacagagtgctgcagtctttcttttgtttcctgaattccacattactcagcactggatattttgggtgtctctattgccatttggatagtaatgtttcatctcttaactgttgccaagggcaccatgagctatgtctgttatgttttacttaatagtatgtgactaccaagctgggcggtggtggcgcacacctttgatcccagcacttgggaggtgagttccaggacagccaggactatacggagaaaccctgtctcgaaaaacaaacaaacaaacaaacaaacaaacaaaacaaaagaataaataatgctcttttgttattgttgagacaggatctcacactataattcatgctggtctgaaactcaccatagcctaccctgacctgagtcttgtggcaattttcctgcttcggcctcctcactacctgtttttaacaagttcttagcttccttgttttgttttttgttttttgtttttttttgagatagtcttaccttgatcctctcactgtcatggaacttgttatgttacgtagaccagactggcctctaactcacacacagccacctctcaagtgctgagattaaaggcatgtgcctccatgtccagctcttcctgtatttgtgtttttagaatcttttctttttcctatgcagaatcacataagagttttggtattaccataaagtttcaccttttgcattcacatctttaattcacttagagtccagttttgaatatggtgtaagataggttttaggttttttccttcacatagtaggcagtttgctgggtaccatctcctaactagtagttcattcttgctcaagttccctccttgacttagccttataccatgaccttactgttttcattcctatggattaatacatggtcttaatagctccctcttcgttcttattttttaaagtcgatgtaaccatttatggcgattaattacatgtaaaaatgaatcaaggggcttagtgggagagcatttgcttagtatatgtgagccctaggttttatccccaacattccaaaaaagaaaaaagatcaagtctctcaaaacaagactttttctttttttggtttttcaagacagggtttctctgtatagccctggctgtcctggacctcactttttagaccaggctggccttgaactcagaaatccgcctgcctctgcctcccgagtgctgggattaaaggcaaaacaagacttttgattgagattacatcaaatttctgtatttggtgaggggggaaatttgtcatctttctaagtagtcatctttttctaggaactttagtgaaacaaacttaaatggcataaaaaactactgatttaatatcctattctgttaaagtgcagttccctaggaaactggaaagatagttagttggcttagcttttaagagcactctttcagttcccagcatccatgtccactaattgctctttacctcagagccatctcttcaaccccaatttattttatttttatttatgtgtatgtatttatgtgtgagtgtagatgtatgttcccatgtcagcctatgtgtttacatgtgaggggctgtgcatgtatatgtacatatatataggtcagaggacagccttaagtaccatacatacttgagcacttgtgtttgagataaggtctctcgttggcctggaacttcaccaagtaggctagcttagctagccactgagctccagggatccacctatctcctaggcttgacgtcactggattacaagcacatactacttactatatctgactttgtatctggattccggggatctgaactcagggccttatgctttagaggcaagagctttactgacagctttaccatctctcgagccatatacacatgggtgtttggtttttgagacagtttctcagtgtaatacacctggctgtcctggaactcactttgtagaataggctcacctgaaactcagctcttgcctgcctctgtttcccgagtgctgggattaaaggcatgtgccaccacatctggctcacgcatggcatttttataattaaggatattaggtgtggtagcacatggcctgtaatcctagccctcaggagatggaaacagaatgaatcgttattcaagttactacataatgagttccaagcttgctgaagaccctgcttcctataaaacagaacaaggcaaaagaatattgagggctgactgtgggtataactcagaggtagaatgtatgcttagcatgtaccatgccctggcttccatcaacagtaaaatgtggagggtaaggagagaagagagatgagagtggtgggtgtcatatgcaataaatagaccactgtccctagtcctaaaaggacatgttcaaaatgcctccattttttcccttttttccttttctttgcttttaaaaaaaatttaagacaaggtctcaggctgaagagatggctcagccattaaaggctaggctcacaaccaaaaatataagacaaggtctcactgtataggccaggctgacctcaacatagaaatctgcctgccggggctggtgagatggctcagtgggtaagagcacccgactgctcttccgaaggtccagagttcaaatcccagcaaccacatggtggctcacaaccatctgtaacaagatctgacaccctcttctggagtgtctgaagacagctacagtgtacttacatataataaataaataaatcttaaaaaaaaaaaaaaaaaaaaagaaatctgcctgcctttgcttctcaagtgctgagattaaaggtgtgtgccaccctgcccagtcagaatttttctattgagtataatgtatgaaggaatttttgaaatacagcttttaataaatcaagaaaacttgggctggaagtaatgaatcctattatcccactgtctagacgctgaggcaggaggatccagagtttcagaacagtttgggctatgttgtgagaattgtctcaagaggaccaactaaagagaattgagcagtacattgagctaatatgtattttcagtcttctttaaatctgaaatattcagtgtttgtcttctatctttttaatgtttattagtatatattttatgtaacagtgggctttgtgtacttttatacttcatattcactccccttcctactctattcctgctaatctcctgcctttgctcaactgtactgtcttatattttcacatatttaaaaaactatatttatcttgggggggccataagtgtgtggaggtcagaggacaacttgggagactcagttcttccttggcaataagtgtctttacccactgaaccatcttgtgccttcccccagtacttttcattagggttgtttacaggagcattggcaccttgccagtgactataccactgaaaaaaatctctctccctccatcaactattaactgcctataaccttcttggagggataggaacccatgagtacctccactcctgtagcaggatgtgatgggcccaatcatgagatgttgctcaagtgatcacagctgtaagttaaaaaaaaaaatacaacagccatttcattccctgctccccctcaaccaacccacaccttcctctactgagtattgttttgttttttgttttttttggttttttgggtttttttttgagacagggtctctttttaactctaagctgtctttggaactcagagatatccacccacctctgcctccagaacgcccacctgacctggtttttttattcttaaaaacaaaattattgtgtgtattcattgtttatggtactattacataagggcaatatatgttgagcatattctctgccctccccacttttcatctttgtgttagtctattttattcccttagacagttttgcttctactttcttgttaaatacatacgcttttatgtatctataaaaagtttaggaaccacagaaaaagcatgatgtctatcattctgaaattggctcgattcacttaatatgactatacccaattgcatccattttttgaaaaaggtctaattccattctttgcagctggataaaaatgtcattatgtttatatagcacaatttccttatccattcctttgttgttggacaactagattggtttcataagttagttgctgtaaatggtctgcaataaatattgatgtctctgtgatttgttgacttggagtcctttaggtaatgataaagctagacctcgggagagatctatttttagtttttgtgaggagcctccatacagtgttgcattgtagctagtctattacattcccagatacaatctaggaagacttcctgtcgtccacgctctcaccagcattattgttattttaaaactgctaagttagccgggcatggtggcccatgcctttaatcccagcactcaggaggcagaggcaggaggatttctgagttcgaggccggcctggtctacaaagtgagttccaggacagccagggctatacacagagaaaccctgtctcaaaaaaccaaaaaaaaaaaaaaaaaaaaaaaaaactgctaagtttagttggtaattgtattagtttggttattttgtatctttgttatatttatctggaattggatcaagatggcctcatggtataaattagacagcttttgctgtttttgaagaagtttgtagaaaagtcactgttgtggtagtgcatgcctttaatcctagcacttctgaaacagaggcaaggcagatctctgagttccaggctagctcaagttagatgatgagatcttgccttttatcccagcacttgggaggcagaggcaggcaggtttctgagttcaagaccagcctcgtctacagagtgagttccaggacagccagagctatacaagaaaccctgtgtaaaaaacaagaaaaacaaaaaaaaaaagccaggcatggtggcgcatgcctttaatcccagcactttgggaggcagaggcaggcggatttctgagttcaaggccagcctggtctacaaagtgagttccaggacaaccagggctatacagagaaaccctgtctcaaaaaaccaaacaaaacaaaacaaaacaaaaccaaaaagttatggggctggagagatggctcagtggttgagagcactggctgctctccgggaggaccagggttaaatcccatcacccacatgatagctcacagctgtctgggatctgacaccctcacccatgaatgcagacaaaaacatcaatgcacataaaattaaatgaattatttcttaaaagttattctaaccttaaaacttagtggaacttactttccgagggatctgtggtccttgtttgttctggggcgagaacccagagagctctaccacttgctatgctccagcctttggtgcatgtttacatgtgtacatgggcaattgtatgtgcacatacatatgtgtgtatgtggaagctagaggtcaactttgaacattatttctcaggaatctcctaccttgtttttgttggtaatatttgtgtgtgcatgtgccatgacacacaggtccagaaacaacttgcaggaatctcttctctcctaccatatgggttctgaagattgaactcgggtcctctggcttggtggcaggtgcctttactttttttgggttggttggttatatgttatattatattataggttggttggttgcttgcttgcttggtttgttcatttgttggagcagggcctctctccacatacctctggctgtcttggaactcactatgtagaccaggctaccctcaactcacagatagtcctgcctctgctaccacacccagcagatagctagaggtccttttatatctgcctcacctgcctggcttgttatattggtgttggacatcaaacacaggtccgtaggcttattcagtaaaccctttactgactgagttctttcctcgaatacacatacatcataagcatgcaccatgcccagcggattctttgttttttcagcattttattatgaaaatttaagcatataacaagttaaaagaattttacagtcagtacctctctatcaattaattaggttctatcatttaccacactcatcacgtgttttttttttttttacatgttagctctttttaactttcacaaaatcatatagtcccattggggtttgttgttgtgctgttttgtttttcattttacaatttctgggttctctttttcaaaaaacagttaatgtgtatgagttttttacctgcatacatgtctttgcaccatgtatgtgcctggtacctgtagacactggatgtggacataaaatcccttggaattggagttacaaatggttatgaccctccgtgtagtactaggaatcgatcctaggtcctctgaaagggcagcgggtgctattaactgctcagtcattttttttagctctcaaggatttggtctctttgccataggagacttcgttttattttatttttaaagatttatgtatttactacatgtaagtacattgtagctgtcatcagacaccccagaagagggagtcagatctcattacagatggttgtgagccaccatgtagttgctgggaattgagctcaggaccttcagaagagcagtcagtgctcttaaaaccactgagccatctctccagccagagacttcattttattgttgtttctttgtttttgttttttgaagcagagactatgtagcagtggctgtcctggtctcctctatacagagatctgcccgcctctgtcttcaaagttttaggattaaaagtgtgctctaccaccacctggcaaacacagagttttaaaatcttctgtgttaaaaatgtcctggcttggggttagccgaggaactattgacagttgaagagtctgttttccttaaaggtgtggcctctgattggttgaccactttccagtggatggccctacacctatataagtatataggcagtacaaattggaatcgatgggctatttaaacaacaaaaacgaggacatgaaattgggaaggattatgtggatctgggaggagttacagagaagtggaggatgaatatgatcaaaatgcattgtatatatgtatgaaattattttttaaaaaccacaaaagtgttatcaaaagtctgccacagatcttccttatagaaggccagacatgatggcatatgcctttcattctagcacttaggagacagagttatgtaaatctctgagtttgaggccaacctggttggcatagtgaattccaggtcagttgggactgcatagtaagaccctgtctcaaaagaaggaaaacaaaggaagggcgggggaagggtagaaacattccaaataggatagatatttcttctcatcagggaacagcttaattcttctcttgagtgtgaggtagttttagtgattttcctctaaattaaatggtagagtatggagaaaagaaaaatagaaatttctttttgagatatggtctctagcccaggatagcctcaaactccctatgtagcttaggatcatcttctggttgtctgcctcccaattgctgagcttacagacaagtaccaccatgcctggttctgacacggggatcaaactgagggcttcatacctgcatacacgtaccctaccgtaaactgagctacattccctagcccccgaaatcacatgtgggtgagaaaaataaccacatgatgaaggtctacatcaccagagataagtcataccactgctacttgataatcagaagaacgtctcacttttgttattgcttctcaaccaaacaaaccccaaaacttttaagcctaatcaaaagatcacatcaaataaaaccactacaatccttaaaaagagaaaataactataaagagaagattctatatattaaaaaccttaaacagggtaggtgttggtggtgtggtgttgcatgccttgagtcccagcacttgagaagcagaagcagacagctctaagttcaagtatagctatggctacacagagaaacactgtctcaaaaaaatatatatatatacaaccaacctttcacaggccaaagatgactttggcatccttcaagtaagacatactacaaatggctcaatgattaagaacagttcctgctgctgggcatggtggctttatgcctttaattaaagcacttgggaggcagaggcagaggcaggcagatttctgagttcaagaccagcctggtctacagagtgagttcccgggcagccagggctatacagaaaaatcctgtcttgaaaaaccaaaaacgggctggtgagatggctcagcagttaagaacactgactgctcttctgaaggtcctgagttcaaatcccagcaaccacatggtggctcacaaccatctgtaatgagattagactccctattctggagtgtctgaagacagcaacagtgtacttacatataataaataaataaatcttaacaagaaaaaagaaaaaacaaaaacaaaacacgtcctgcttttccagaggtcgagtccatgttgggtggctcacaactgccctttacaccaactgtaaggaaatctcgtgcttctggcctccaccggcaactctactcacctgtacacatgcatgtacacacacttaaaaactaataatgaaaataaagtttgcaagataacatacttatatgagaaaattggtgaaatcccaataaaacctgttatctagttgacataatgccatggtcctctaagtattaggggaaactgggcagaggggtatgcgtgggtttttttatctttcaactttcctgtaagtcaaaacatacttcaaaataagtttaactttatcaagattagaaacttccagatcaatggacactcaagatgaaaagaaattccccagaataggagaacatatctatgtatatctggaaaggggttcctatctagaacatgtaaagtacttttatagcaagaaaacaaaacaatcccaattgaaaagtggtaagggctaaggatagatatagctcagccactgagctatgtccttaaacctttagttattaaattccccaggctggccttaaatttgtgatcctcctgttttggctttcttgaatgctatgattacagatatgagtcactgggctatattttctttattttatatttatttacttgtttgtttgaaatttttataatttgagtcatggtctccctctgtagttgaaaatagcctcggcatttccctctttctgcctcagcctcctaaattctgagattacagcatgtaccactactcccagtttgcttgcttgcacaagttcattttctttattttcagtgctgggcacaggacctaggcctttgtgcaagctagtcaacatagagctgcacatctagctctttgggtttttttggttggttggttggttggttagttggttggtggttttttgttggttttttttgttggtttttttgttgttgttgttggttttttgtttttgtttttgttttttttgtttttgttttttgtttttgtttttcgagacagggtttctctgtgtagccctggctgtcccggaacccactctgtagaccaggctggcctcaaactcagaaatctgctggtctctgcctcccaagtgctgggattaaaggcgtgcgccaccaccgcccagcgtgtattttgtttttaaatataactcatgattgtttctgggtaatcttaaatatttttatatagttcaattaaatgattttttctatgccttgggatttgggttattgctttttcccatttaagagtagggctaagggctcagtgggtagaacatataaaagattatgaagaattgttttcccagtttacttttttctttttctgatttgagccagggctttgtacatagcaccatggtgcatgctccaccatggagctttagtcatttgtttgttactggtgtaaggtggtcagaggacagctttgtggcattggttctatccatctaccttcttctagattctgggaatccaactcaaattgttaggcttacattggtgagcagtaagcacttttacctgctaagccatctttctcttactccaccttacccctgtgcttttttttttttaaacatagcccaacctggcatcaaaattaggatcctcctgccttaacctgggattataggcatgtgacactacatctggcccttgaactttttctattatggcttaatgtccttccatttacatctttgatccaagctggcatgatagtccaggccataatcccagaatttaagaggcaaaagctagtcttggctacataatgagttcaaggtcagcctgaaataaataccaaaaaactgtctcaagaaaaagtaaatcaggttgtagtagttcatgcctttaatcccagcacttaggagatagaggcagtcaaatgtctgagatcaaggccagcctgatctacagaatgggttctgtctcaaaaaaagaaaaccccaaaacaaaggaaaaggtaagtaagtgaatcttcatatatgtgaagaatagtcaaaagatcttacatgtgcatagatattaataatttatttaaagatttcttttcatttttgtgtatatgtttgcatgtgtgcacactgatcccaaaggagctgaagttacaggctgtcgtgaaccactttgtgggtaataggaatcaaaccagggtcctgtggaagaatagtcagtgctcttaactgctgaaccatctctttagcccaatatttaaccttttagatgtaatcataggtagttgtcttcctgttttccaaacaatggctatttgaatgtaagcaaaatatatattttgtatattaattttatagccagaatctttattaaatttatttgtgtgtgtctttacgagtgtatgcttacatgtgtgcatctggaagccagaagtgtgcatcacacctgctggagctagagttacttgtgagtgagctgactgacatggatacagggaattgaacttgagtcctctagaagagcaaaaagtactcttaacctctgaggcatctctctagcccctgatgttttgtttttttgtttttaatcatcagcattgctgttagtattttgggagtactgaagttagcgcaggccttgaatgtgttgtcattgaactatatacccacagctcctaatttattacttgtattctttcttcccttttttttaaaaaacatgattcatttaggctttgcagggttattctcattggccacaaataatggtgattttacctttacaggtttttttgttttgcttgtttggattttgttttttagcttttcaagatagcttctctgtattaccctggacatcctgggactcacctttatggttcttaatgcttttttttttctttcttccacttacttaattgttttagttagtgtcagaataatatagtctaagagtggtgtcaataacagactctaatgtattacttttcatgagtggactcttaccgcattcttctaatgggcctgattcttcttgcttgaccatgttcttttttacatctttatttttttttctccaatactagatattaaacccagggtctcataggtggtctgccactgagttaaatagccatagcagcatatttcctttttaaataaacacgtattgtttaaaaaaacaaaaaaaaaaaaaaaccagggtctcatataaccttaaactcattttgtactttggctgaccttgaattcctgatcttcctacctccacctctcaagtgctgtgattataggtatacactgctacacctgccatacgatactcgattatcatcacccactgactcccatatactatgttaagctttgagaaataaggtagtaagcccagcagtcatgttccatcatttcctagaactcacctttaagtaatgttgtttgtttttttgttttgacgtgtgaagagcccagtaccttctacataaagggcttgtgcactgccactttactacacgcacaaccccaattttcttaaaatgtgtgtggtgggggaatctcactatattgccttgggcttaaacctcttgtctcagcaccttgagcaactgagactacagacctggtaatttttctcagtctgagatggaaaccagcaattttcatatattagccaagcactctactattgagctatatccataagattaaaagattactatcgagccgggcatggtggcgcgcacctttaatctcagcacttgggaggcagaggcaaacggatttcagagtttgaggccagcctggtgtacaaagtgagttccagccaaggctatacagcgaaaccctgtctcaaaaaacacaaaacaaaacaaaaagattactatcttttaactcatcgaagatttacaatttaaattaactttgaagtaattgttttatagttaactatagttagagaatttttaaatttttaattatgtgtatgtgtccctatgtgggtatgtgcgtatgaatacaaaagccagaagaagacgctgaagttggatttataggcagttatgagcatctgcccaatctgagtgccaagaactcgggtcctttacaagagttccacagttggagaaattttacctgaagaactaccaattctagcaatatggctttgaaataggtagagtgacttcgtagggcagacagagatagagctgcagagaccttaccctgtagggttggtgggatcttgatgaacatttgggtgttcttatgtgtttatttaggtgaaattactaaagcaaatggcatggttgggttgatgaactttatttagagagcactcatgtttggaatttgaggtgaagaattcagtcaggaaaccgtacctgatgtacatgtggactagaggttaggaaggagcggagatagtgggttggctttaagagcctgtgctaattagcccatgcagtgaagcgagacttttcagagtcctagtctaggaaatgggactgaagccctagagagggggttgtaggttagctttcatatcttgagccttttggaaaatctggtattctaactcccatccttcttctagaggtggtcgtggtgacaggactggccgctatggagccactgatcgttcacaggatgatagtggagagaaccgcagccgggaccatgattatagagacatggactaccgctcatacccacgagagtatggcagtcaggagggcaagcatgagtatgacgactcatctgaagagcaaagtgcagaggtgagggcaaggccaggccttgggggcagtgctcctgaaaggcctgtgtgtctggctgcagcaccaggtgtaggtagctctccgctcctgtgcttttggactacttggttgctttgcgtcacctaggggagggtctgtccctgctcccttctctgaggactcttctgagttgagtctccctggctttcacactgcttgactctgtatttctcagggctcctagccactacttctttcccttcttccctgttgttcagttttggcctttggttcactgcaagttctatactgcttactcccaccaatttagggaactcaaaaggatctcttctatgggacccagcatctagggttgggaggacaacctgagagcaaaattatcaaccaatccatacaactctgggaggctaacactgactgtttctggtcttgacagaaaggaaggaaagaagctttggggaagtcagtcccatgtaggtagttacctccagcctaacgggtacaatgctcactatgagagagcacatctgagggctagggaatttcagtctgagagggccagggagatctaatggaagcatataggcagatagctctctgtctagtaggatggaaagggtacacttttgtaagcccagccctgtggagaaattatatttaaaatatcttctaccctctgggtatttgaagggactatcaagggattccactgataaactacaagctttgtttggttagccagggcttacaggcatccaggcttctccattgcctgctactgtgcagtatctcttagtgtctccatgggtacagtggaccttgtgaatggaccattgacaagtgtggaacatggcatccagttgtctggacctgtcccctgcaggtttggggggcggtgtagggtcatgcctgacctgcttagtattgaaattagtaggttggacaattaagaactcaacaaccacactctttgtgaaggagactgatagtgaacagagacttttccaggcctgaggactaaggaccaagggggagtataatggcccatgaactcctgctggctgcctctggcccatatctgaaactatttctgaactgatggcttggttccagggcccaatcttaagcagggaactataggagacgggtgtttttcagtgccacagtaaacaattgtacacataccagctgagctggcaaaagaagacattgaaagcaaagtctagtttgcttaccccaggctagtttatcccaaggaggtttaagcagtgtttctgtcggcctgcctttgggagttcctcctccacaccaatattgctgttcttgaaggcagctcctagaaataccctgtggaacatttgcagccttaaaaagcctgagcctttaaccggagcccgcctgcccacccctggctttcagagcctgcctgtctcagagagccagtggccagccactaggcccacccagactgactacccgtctggtgtctctcatctcattctgtcggccaggattcctacgaggcctccccgggctccgagactcagcgtaggcggcggcggcggcacaggcacagtcccactggcccgccaggcttccccagagacggcgactatcgggaccaggactatcggaccgagcaaggggaggaggaggaggaggaggatgaggaggaggaggaggagaaggccagtaacatcgtcatgctgaggatgctgccacaggcagccactgaggatgacgtacgtgcccccccaatggccctgggcaggaggcaaagcaggaggccaggctgggtctcctccagggccctcagcttctctccacccatcttttgccaccaaccacagcacctttcctctcttctcccccaccagctcctgtcccccagtactgtccatcctccaggatggccccatcagttcctggtctggaagggagaaggcagcagacaggctgacttgacccaggggcagtagccatgggtgtccggtgctggtgggtgtgagagaagaacatctctcctgcacattccattggctttcacccttttgtatatgtggatggagaaccaggcccactgttgggtattcttggtgtcagaaacccatgagagtgagatattagggtccatgggcttttctgaacttccatattcctccccttttgtcagcagtgacagcctggccgcagctacccataaggtggctctttgatagcttctcaacctgtttgcctttgtgacattctctgccttccatcttcctctcttcactcattcccttctcgcgcagatgtcttatggcaagccacaatcaaaacccaagagtattactaaagtagaattttgactagcttccctggactttgtacctctctaccctcagccccagtcagttctctacacagtgcttccctggaagcctgccagctacccattttctaacagtagtaatcccacctaagaaatgtgagggcttctagaatcaggctgatagctgacattacctgttgttttatggcagggtgggccacatgccaggctgattgaatcctcacagagcctctttctggaaggtatacattgtagtcagtcccacatagccccaatcagcaaagtgacttgcttcatgttccagcaaatggcagagcagagttggggtttaaacctggactgctggactccagagtccaagttcttgatatttcctaagtcctccctgattgtttggaatcttgataagatttgtgtatcttgacttttcatcttctgaatacctgtgtgcttaagacttaatttcttgtcttgtaccctgatggggagcagatgcccagaagcacagagacttttactgaagtatctggcataaactccccattcacttaaagaggtactgccagcctagagaatgcctcacctgggctcttaagttgcctctctagtgtccctcaaactcctttcactcaggaagctttccagatcaagcatcatgcctatttgtcttcacatttctcctgacatggctggaatggctccggctcctgtccttccctgtttactctttgtgccctaggtagctttagtgcaagtcaaggagagggagcagttccttcgtgatgggcacaagttgtattccagcttctatgcttcatggctgctactaagcctcttgtcagatcaccctgcctaccattcctgatttgctgcctcacttgctctcctgttgtctttgtgcccctggaggtcatcttgctgccatccttattccgtactgttttctgtctttgtttgactcactttctgcaagtccaaagctggaagcgagactgaatactagtgtaggctgcagttgttgttactggggaaagctttgaaagaggtagaggacgcaggtgtgtgtgggctgtgtgtatgtgtttctttcatgaccccttggggctcagaggccttgagctggcctcacatactcagccgctttctttgctgaacatagcctgcttctgtatttcctgaacagatccgtggacagctgcagtcccatggtgtccaagcacgggaggtccggctgatgcggaacaaatcctcaggtgagctttcgttcccagtgccctccccttttgctggccagcctgagcctccgatctccctctgcctctccctctctcttcccttccctgctcctctcctgccacagctgggaatgggcagcttgcggggggtgccctctcctttctcccatcctctactctcacagctccagccagcagcctcagggttgctgtcctgaaggggatgcagctctgggctgagctgactactcccaggagcaaggccagagtcaggctctggaaaaccttttctttgggactttgagtatctgaggtggtgacccttcccaggacatacatttttttctccttcctctgccccttggtgtcctccaccctgacaacagcttctaatgaaaagtaggtgtgacatggacccacccatatatcccaagaagggaggcagggatggctttcatcgaaagggtatcctaaggagcagccagaactttttggccttacctgttccctccctccctccctccctctttcaggctgcttggagctggcctggggttttagcagggtggagggctgttgtctctgcaggactactgcccaggctccccaaggcagacacagtggggcctcactctgcctgggcttctctttcaatctcagtctctcctccttccacctcctccatctctccatcgtcccttgtctgtttccctatactcttccatccttccatgcatcctggtgatgattcttttggagatcaagcatgcccctccagacccgccacagccaaaacttcctttcatgactacctctgaaggaccttaagcctcaagcccctttctcagtcctggccaggcctggagactatgtcaatgacatgtaggtcttgctctgctttactctacttatatcactcactgacagaatctctgtatctttccctaaggaggcatcctaggtatggcctctcagtgacttcggtcatttctcctaggcacctgctgactcttacctataacatcctcttggccggctccagccaccatctgcctatttaggagaacctcgactgtcagtggctatagtctccctactgtggcactgaagtgactccctagtgatcatcatcccctttcccacaccaaggttaagctgacattacgttcctaaccacctctgctttcctgtgtgctgcctggaaacccccagtagcctcatagaccagcttagcctggcttctcttttgctcttttgattaaacacccgttccaggactcctcctgggcttgctctaggcttgcccatgagttgtttgctctggactatgtgaagtcaaagcaacctcctcttctagagacagatctctccttgtatcccttccatctcaggtctccatctgtcaccccaagttagctaggcaagactaccagagacccatttcactacagttatgctgatctgactcatgctttcattttcttccctccccttttccctctttcctgcccttcccaaccatctaccttgactcctgccttccctgttctttctctgatcactttttctcttcctttctcctctccccctttccctctctgcccctggtccactcccctcgggttctgcccccgggaacaccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccctccccccaaaacaaatactactttataatcgagcgctccccatcgcctgaatcttatggacacagttccctgccctgtgaccctgtgtcccatatccctgcccctttttcccccctcctgacccccactatttcctcttcccatctctcactacccactgggcttcccatttgtggcccagtctcaacactgacccctggcccccttcctactgccaggcactagcgctccctcacctctcctggctgagctttcagagaaagagctgccagggtgggttcccttcttagcttcccagaccccagcaggacccttttgctcccgagtcagcagagccagaacttggttgtgctctcaggaccactggaggtcctgtcactgagggaacatagatgttggcacataaactagcaacacttgttttgccagttttctcctgcatgtgaatttggccctctgagttccatgcagagggacatcactgcttttggttgaaagttccagtcaagtgtgatagttttattgacaccgtgggctcagttcactggcccctcccattcacagcaccctccccacccacaggaggccccacctctaccttctcagtaaggaactgtgctctgtcagctacggaggggccagctcccctagcctggcactgaatcccaactcaactgcgttgggaccttccaagactcaagggtctaacctggctacccagccctatcctgatgtagagtcactggtgtagagcactggaaagaagtgtcaggggaggaaggggcagccgtggtaaagtggagggtcctggcagaggcagccctgtggccggctctgtgggtctggtcaataagctagtgcggtgggcccaggacccggccaaccttgggaaggtggcctcatggcgggaaatctccgtctgttaaattggctttctttttccccttctccagcattagcgctcgtgcgctctttctctttttctctcccctcctctctcttccctgcccatctcccctcattcccagtgtagcctgtgtagtgctagccctgagtatggcctggcactgtcaagggccaagctgggggagccctcccaactctcgacagtcgttggtcaaccaagtactatgtgcctgattgtgtttgtgtgtgtgcgtgcgcgtgtgtgtgtgtgtgtgtgtgtgtgtgtgtgtgtgtgagtgcgttcgtgcgtgcgtgcgtgcgcacgtgcctgtgagtaaacagcaaacagatgcgccctgagagctgtggcgctttccttccctcatccccatcccgtccctccgttccttcttccctccatcagttctccaaactcccttcattccctgtccctcatccatccagctgaagggctcgctcactcttttctcctttgctgaaacggtatgtggggcactgctacctgggtcttgattgtgctctgctttttcccacagcactccctcaacatcctgggccagaaggtatccatgcattacagcgaccccaagcccaagatcaatgaggactggctgtgtaataaggtacaggggtggatgggtatctggtgctggggagaaagtcagttccagcaggagcagcagcagcagcagcttacttagtcggagaaggcgtagtcttagagatatgttgtctagccccagtcagtaggctctgtcctcatcaaacacagccttgcctaaaggtccagtagagttgaaagaaataatagcatataagtgactaatcggtgacaacacaagcctactatagtatataggacatgggcttcagagccacactgcttgcagtctgtctcaggtctgccttgatgctggtcaaggtgcttatcctacctctgtatcacttttctcatctttatgtgagtgagcactaatacagtgttgaaagaatgaaactgttggtgggagaataataaaggcttctggctcacattcaactctgtaagtggctgctgttccctttaaaaagaagcagagtgttctgaggtaactcagctgtgtctaccttgaaggtccctgtaggttatgtgatcacgctatattccctaagagaaagctaaggctcaggtggaaccatgcatgagcttttagctcgcagggccacctcctgttccctacgtggccttaggtctgccctgaggccagcattgtgattctgcaaccccatctcctggggctctctgtagtcctaaaacctaaggaaagctgagagctagtggaggaccctgacttttccctgaggagtctgcttagtgggagagtgctatctgtcatctttacataggtgatcaacctttctggagagagagggacaacatgatactggcacttcatcttttttttttcatattttccttgaagctggtgtttgctttgtgttcttctcctcctttttgtcctgcatgtctttcagttaccagatcctgtcccatccatctcagaatagtcaccttcctttgctcttcttacagttcatgccagttcctacaccttcccatcgagttcccatagagccctttttgttgttagcctcactcctctttctccacccttacctgtaatgttgcagctgaaacctagctctgaccatgccttaccttctctgcccaaaacatgagtctctcctttaactgtcaccatcttcccttgccagccttgactttctctctctgcatgccccccccccaacttcatcagctatagaaagtctcttagcccctccagcaagactaaaacctctggatttcccagctctaactgccctgcttctgtgaagcccagctcagtgagctgaggccctttcagcccattctctgctcctaactcctatcagtgcagtctaagcagactgtcctgaacacatgatgttgggccttacacaggagcactgtttagtatctgaccggaacagagatagagttgtgatggaagccgaacaaggtagctggaatatctaagaaaaaagtcaaaagtagcagaattcaatctaggcctagcaataaggaaggaaatgaatctgactaaaagattgtggcttccagtaggaaacagtgaaagtttctgttaggtaagcaagtctcaggaagaagggaccatgagatacagtgctgagagttgatagtcccaagaagatagggaagggacacaactgctgtaatgtgtgagagttgctgattgctgaagtaagagggttggtgctgggaaccagttgtcagatttataggattgaagataataaagttccaaaaaactcgtgctacccctgaccctcaaagttcccttctgcgggattatgttgttctgtgggtcgatatttggaggatatcatggaaagtcttgaccccctggcctgtgcctcacagtgtggtgtccagaacttcaagcgccgagagaagtgcttcaaatgtggtgtgcccaaatcaggtgagctgtactaactgggagtggtgagaggcgttgaaggccagtgtgtaggggctggtgaggggtggggagtatggtcaaccatggagcctctaccttcatcatcatcatatttcccaccattcctgacagaggcagagcagaagctgcccctgggcactcggctggatcagcaggcactgccactgggtgggcgggagctaagccagggcttactcccactgccgcagccctaccaggcccagggagtgctaacctcacaagccctgtcacagggctcagagccaagctccgagaacgccaatgacagtgagtcagttgttctttctccttactttataccctagggtatctggtgtgggacctctgagggccaaagaaatggtaatgaacaatacttggtccttattaagggagagtgtttctacctggtgtggggataactatatgatagagagcagagggagaagctgcccacaaactaatttggggggtagatgagagggttcctgatagttgagacactgttgacacctggactgacaagccgagtttcttcaagagaagagtaaaaggaagcaaggccgagtttcttcaagagaagagtaaaaggaagcaagaaaacagggagccgtggggatctttaatgggggccctgaacagactgtcagaggtgcttcctaacactgggccctctcccgcagccattattttacgaaacctgaacccacacagcactatggactccatcctcggggccctagcaccctatgcggtgctgtcctcttccaatgtgcgtgttatcaaggacaaacagactcagctgaaccgaggcttcgccttcatccagctctccaccatcgtggtgagggcggcacaggggggggtccgggcaaccacggtcccggcccccagggtagggaggggggaacctttaccccatcctcaccgcggtcccagtctggaaatggggcaatggagccggggggcctccccgggcctgacccttccgtccctgctacccctctacccataggaagcagcccagctgctacagatcctgcaggccctgcaccctccgctcaccatcgatggcaagaccatcaacgtggagtttgccaagggttctaagaggtcagagccccacctaagctccctcacagcttgccccaccctcctaccttggggatccctgtttcatttccagtttctactatcctccccagggatatggcctccaatgaaggcagtcgcatcaatgctgcctctgtggccagtactgccattgctgctgcccagtgggcaatctcacaggtacttggcctcctctgaccccatcaccctggcatctgactttcttaaaacgagtgttataggccttcctacctttactccttttcttctgcctttatagatagttatccattcccgctccatcctttctatcatccccagtcaccttttggacttctttcttttttaagactggttactactttatttttatgtgtatgagtgttttgcctgtacctgtgcatgtgcaccatatgtgtgctcagtgcctgcagaagtcagaagagggtgatctgaacctagaattttgaggtcttgtgaacaaccatgtgggtgctaggaaccaaacctgcccctttgcaagagcaacaagtgttcttatctgctgagtcatctctccattcctgtcttggtagttggtgctctatgctgttgaacttttttagattgttctgagttagtataatgtgttgcatattgtttgggtgtgtgtgtgtgttgtactgtttttaagtatatgtgccatgaataaaaaggaatttataaatatttgtttaaaaagtctctgggagccaggtatagtggtaagcacctgtaatccccgttcttatgagtgaaggcaagaggatgaggtgttgaaggccagtctttggttctctaatgaatttgaagtcctgtctcaaaaaaaaaagtaaaaattttggtagaagagaattaagagtaagaggacagcaagatatgataatgcctgcctatatttctagcaatgatgtggggagtggtggcaaagtcaggatttctacgagttccaggccagcatgggctacatagttgtaggtgggagagaggaaagaggaaaacaaaagggaaaagagtgagggtgtcttgcttggtatggacctcatcagtatcagcctaggatgtatttgggcatgtagcctttttctagtctctcttttcttccctgttctcttgtgaccaggacaccttgattgtcacttaagactacatgctttctgtcaagtagaaatcctagctccagcagggcaatggtggcgcacgcctttaatcccagcacttgggaggcagaggcaagcggatttctgagttcaaagtcagcctggtctacagaatgagttccaggacagccagggatacacagagaaaccctgtctcgaaaaacttaaaaaaaaaaaaaaaaggaaatcctagctccacatatagggacaggtgcatctagcagatttcttcatttatgtcccctcctgatctaatgatctctcatctgcctctcaggcctcccagggtggagagagtgcctgggctgcccccgaggagccaccagttgactacagctactaccaacaggatgagggctatggcagcagccagggaacagattccctctatgcccatggctacctgaagaacagcaagggccctggcatgactgggaccaaaggggacccagctggaacaggtgagcctcatactctctagctgagcctaattatggggcctagaggcctatggccgtatgctctgacatttgtgggcattcattctccatggtttctcttttcaggtcctgaggcctcccttgaggctggagcagactctgtgtcactgcaggctttctctcgagcccagcctggtgctgcccctgggctctatcagcaatcagctgaggggagcagtggccagagcactgctaccaacagccaggtgaggatgccgctggtcctctggggaggttggtaggctggcaaggtgccccctgagtgggcagggtgccattacgagacactgagtcctgttcccttctgtgacccatgagcagtcatacaccatcatatcacctgctgtgctcaaggctgagcttcagagccctactcagcccagcagctctgccttcccaccggctaccagtcccactgcccccgaggcctacagccagtaccgtgagtatctgagtatcgacagcccgtggggaagggtgtgcacttctctaaacagagaggaattccacaaccttgtctttgctccctccccacagctgttcctgatgtctctacttaccaatatgatgagacatctggctactactatgacccccagactggtctatactatgatcccaattcccaggtaagcgaaaggtagcctagggaaactggagtgtggttttgtggcagctacccctatacatcctccctcattctttccatcagtattactacaatgctcagagtcagcagtacctatactgggatggggagcggcggacctacatacctgccttggagcagtctgctgatggacataaggacacgggggcatcatcaaaggagggaaaagagaagaaagagaagcataagacaaagacagcccaacaggtgaactgccggccatcatctggttgtttgaagtctatgttctctcacctcttgctctttcctgctataggaaatggggtggtgggtgggcatggacagggataggaactacttcagatagacagtactcctgaattaggtctattttgggggttccagtactcctgaattaggtctattttgggggttctgtagcaagaccacctaccaccatgaagtggcttgtactgtctgcgtgagctcttgacagcttttctctgtcctacaaagggaaccttcatgctggtggtgggtgtgtattgatcccagagaaattgtcgtaagctcacgaggggttgagaaggaaaaaaaaaacattgcagggttttctagtagggaaaagttagcaggaaccttagtctctgtggagaaaaggtatggcattgaagcaagcaataaatattctctccgcaacctgagggattctcaaaatgtttcatgccccaggaaaaccacaagacattaacgtggcatgatatcacatgccttagttaggtttctgttgctgtgataatcgttgaccaaaagcactatgggtatgaaagtatttcatgatgaagggaagccaagggaggtacagatacgaagctacagagcaggaagagctgctgctgcaggggcagtgggtgagaaagtagagacccaagcttcaagaaccttcaacctcaaccctcaaaccccagattgccaaggacatggagcggtgggcacgcagtctcaataagcaaaaagaaaacttcaaaaacagcttccagcctattagtgctctacgagatgatgaaaggcgggaatcggccactgcagatgcaggctatgccatccttgagaagaaggtgtgttgtaactgtccatctgtaccccaccttcaatgttgtcactctttagggtcctctatggagctctgaatttctgtttcttctacctcagggagcgctagctgaaagacagcacaccagcatggatctcccaaagctggccagtgatgaccgcccagtaagtttcagggcaaaagggggcgggggtccctgatcttagcaagtgtgactgactgcccacattcactctctacagagcccacctcgagggctggtggcagcctatagtggggagagtgacagtgaggaggaacaggagcgaggaggtcctgaacgggaagaaaagctcacagactggcagaagctagcctgtctgctctgccgccgccagtttcccagcaaggaggcactcatccggcaccagcagctctctgggctccacaaggtaattgagcagagagttggtaggatatcctgtgtctagcccagtccagctgctttacactatcctgcccctctttacagcaaaaccttgagattcatcggcgagcccacttgtcagaaaacgaattggaagcactagagaaaaatgacatggaggtaaggcgtgacccactcgttggctccatcccatctgccccctccaagtctctgtcctgccaggccgtgggacttgaaagttccttagccaggtatagcctgacaaccgtgtgttgtctccatcgctatgaggctttttcctagttcccatttcatcatgccctgaccctcgggaccaaggaccaggccagagagagacttacattgccccttaccccatccatgcttatgtttgctgaaagaaaataacagccaactccagcatgttcacacacatacatttgtagcaaatgaagtatcgagaccgtgcagctgaacgcagggagaagtatggtatccctgagccaccagagcccaaacggaggaagtatggtggcatatctacagcctctgtgtaagtgcaggaccgggcaccaggcgaggggaggttgctgctggcagaccactaacactatgcactgtcccctgcagggactttgaacaacccactcgggatggattaggcagtgacaacattggcagtcgaatgctccaggccatgggctggaaagaaggcagtggtctgggccgcaagaaacagggcattgtgacacccattgaggtgagtctctataagccattcttgtccccaacactcccagtgcacctctaccagcctgaaaaaccctccttcccttacacaggcccaaacacgagttcgaggttctggcctgggtgccaggggcagttcctatggggtcacctcaacagaatcctataaggagacactgcacaagacaatggtgacccgcttcaatgaggcccagtgaacagctttgaaagcagtttctacagacatggggtatccatcgagggacagagaagatgaactgtggaatggtctaaggaaggctcttctatctaccagcctcctccccaaccagagaagccaaattagacttggagttggtgacttttgctgggaaattgggctcaaatcatgttccttttgtaataaaatctaaaaagcctgcatcttccatttct

SEQ ID NO: 28 - DNA, 33399 bp, mus musculus; identical to SEQ ID NO: 27

SEQ ID NO: 29 - DNA, 31412 bp, mus musculus
aggtggatggtggtcggatcgccggctctcttctcgtcgccattttgtgttggtgactgtggccggctaggaggaggtggcaccgagtttccttgggagggcaacgcgtcggtcgcgtctcccctccccctttcctcctttttgctcccagtcttggacttggtagttgcatgcattggctcccatttgaactaacagttctgaaggaggtggtggcgggcggaggtgatgcctgggagccctcccttgacagcccgggccgagaaggtgagcgccgttgcgggtcgtgggatcggaggtaaaggagctgggcgcgtgggagggggagagggccggtgtgcatagaagaggcgcggggacggactgtaccctcggagttcgcacagagctgagggatgcctgcacagcctgcacctgaagagggggtatggtcccccaccccagcttttttcttatgaaagcaaaagcgcgtgcgcgattgggacgcgggatgggtgcacgcgggttgggggaagggagagacagatgggagtggggtactgtgacttactgtatttgcccaccgaactttttatcttttgaaacgcgcgtgtttgcgactttgcggggggtgttcttagaggagggttgtgctgactgcccttgttacttaactatccacggggaaatactctggctgcggcctctattcatttatgtggtgggaatgagggtgacaagcgcggagaaagaaagtgaatatggtttttatccttggggtctgtatctgacctctgatccttatcaggaagcaggcttgttactgatcgaccccaacttagttagtttggggagggggtgcagagaatatatatatccggcgtttcttcttttgggagttgtatctgtaacagtgaggtctatatattcaaagggaaatccgtttaattgtgtctcttataggtatcctgtgatcctggcccttggctattttgggggcttgtctgtaactttgtttcttttctgtgctgtgtatgcaacaaaattagactcattcttttgccattgagcattttgtgtcaggttctcatccactggggttcctgcctgtgattcttttccccatctgggggaagttaactgatccttgagttggaagagaaaataggtacttaagagaaaaggtgttgtggcaacctaccgttgggcaagtactatacccgcctagctttacttggttcctgtacaaatgggtggcagctaaagattcaggggtaattttgatctctggttgggtcatgacactctcagatcttgtacttctcaaggcagtcccaaaagttggatgaagtagctgtccctgtcactcagtagaacaagatgttttggaaccacttgggaaagaggccccttttgcctctggaaagcttagcctaagctccctggggagagattcacctggggacctggctgcacattagggcggaactacttgctgtgttgaggatcagagctgtgttggccaaaaagcccagggaggtggcagctgtcttgttgccatgttagccgcctcccccctccaaaagcctttcagggtttctgactgccttgttgggggtatagttggcatcttgttgggaggttgaaataataccctgacccatggaaaggagtctgagattccttctgttgtgaagtcttttgctactgtattgtcttttggagttttgctagtttttgtgatgggacctcagggccttgaatgtgctgggcaagtgttctaccctcaactataccccatccaattattgtaaaagtcttatttttgtgactaatgtgcctaatctaggcaaatcatttagcacttgcccttcccttcccagcaaccagccatgggcttacatttgtctaccagtctaagaatgcaaaaccttggtcataaatagcctgtggccccaccaaatctttatgagatatctttgtttgatgagggctttgctattttctagggtagtggaatatgggggaagaaaaggagagagagccaagtaggggttgtcttcctgaactgttgcacggaagcacgaggaaatggaaaacaatgtccttgggttataggacagtagggaatcttgacaatgactgtctcctcaaggaggccctctctgctccaactgccttgacccctttcttccttccattctctgtagagtctctgcaggaggtatcacccagacgggcagatcatgctggcagcaacaggggtggctgagaagtgaaaggagccagctactgaggaggggccccagcagcccctaaaactcctatcaggacatggagtatgaaagacggtgagttatcccctccctcccctcccagtgtgagcactggtttaggatgaagggcgctctaggcaggagaaacaacacagcaaagaaatggactcttttcagcacatgtgcatctgtgctctgagaatgcacaggtgaatgacacaatgactgtaggtctcccctgtaagagactgtcttgctatgtatagcattacatggaagagcacatagtttacaggtgataccaaacagcctgatgagtaccatgactggacgtgaaggtggggtttttgttaatatgggtgtggaggccagagagtggtgccaggtgtccacccaattgctcctccatcttagtttttgagactgggtctttcattgaacccagagctcacagatttagctatactggctggccagcaagcctgagggagtctctttttttctacctcttcatcactgggattgaaggcatgtgctacacctggtgtttttatatggacactggataatcaagcttatgccctcatataccacaagaagtttactgattaaggcatcttccaggcctgcttttcttttttttttttttttttgtcttgagacagtttctctttatagtccatactggccaacttgtggttttcctaagacctggggtgacaggtgttccaccacacccagtttatacacaaagtgctttggtttggttttgagatggatcttgttctgttaactaagttggtctcaaaatcttgagctccagttctacttcatcttccttagtagctgagaaaacggggtgtgacatctcatggtatatatagttttgttttgcttttcagctagttgtgttttgctcttcagctctgataaaaaaaaaagtagtatacttggtaaaatttagaaacattgagtgtaagtataagatcctttagcactctggtagattcctgccccaggtgattctgaaatcagcgacttagctaccatattttaagagagcccagggggaataaaaagccgggcagtggtggcgcacgcctttaatcccagcactttgatcccagaggcaggcagatttctgagttcaaggccagcctgctctacagagtgagttccaggacagccagggctacagaaaaaccctgtctcaaaaaaccaaaaaaaaaaaaaaaaaaggcgcccagaaaggcaaaccaaactcttacagaaaagtcataataaatttgctggacatggtacttgtaatcctggcatttggaggtggaggcaggaggatcaggaattcaaagtccacttgtgctacttgagatcccagcttgaaaaagcagtcaataaacgtataaaacactggagagaaagcaggtttgggaatgtctttgttggcccaaggagcaaggtcctagaggttaaacctagggcttgcactactcagcaagtgctgtacccttgtgagcaagtgctctgctactctgtacctttacattttgctcggagatagactctccattttccaggttgttcttgtacttgatctgtagcccagaccagatttgcaactgtcctacatcagtttcttgagtatctaggtttacaggcctatctatgccactggacccagcttatagatgccattttacttacttattttattttatgtatttgaatgaatgtctttgcatcacacatgttattggtacctaccattggatcccctggaactggagttacggatggatagttttgagtgagccaccatgtagacgcgagaaatcaaacctgttctctgaaagagcagtccagtattcttaactgctaagccacctctccaaccatatttacttatttttgagataacgtttcactgtgtagtctatgtctcccctaccccatctcaaccttccaggtatgggactagcatatgctatcatggctggcattgacttccttttaaaactgtcttttgaaaggcaggcgttagggtcaatacagtactccctttgggaaagatttgattgtagaccataagtataagtaataagtatcactataagtaatgtgtgattgagcttcaagtagttatgctttgaaatttgttgccaaataaagacttctttttaaagatttatttattttatgtgtatgagtacactgttactctcttcagacacaccagaagaggacatcggatcccattacagatggttgtgagccaccatgtggttactgagatttgaactcaggacctctggaagagcagtcagtgctcttaaccgctgagccatctcttcagcccaagacattgtttttttgtttgtctttaaataatgcataggtttaagttaatcccactttccagttctgcaaaggtcttatcacaggaggcctcctcttgccttgtttatttgtttccatttattcccaatttccatctctgtaggcagcagctctgttgtacttaatttgtatccttgtaaatattgttgtctcaagtatctgttttcagttctcataaacaacagagtgctgcagtctttcttttgtttcctgaattccacattactcagcactggatattttgggtgtctctattgccatttggatagtaatgtttcatctcttaactgttgccaagggcaccatgagctatgtctgttatgttttacttaatagtatgtgactaccaagctgggcggtggtggcgcacacctttgatcccagcacttgggaggtgagttccaggacagccaggactatacggagaaaccctgtctcgaaaaacaaacaaacaaacaaacaaacaaacaaaacaaaagaataaataatgctcttttgttattgttgagacaggatctcacactataattcatgctggtctgaaactcaccatagcctaccctgacctgagtcttgtggcaattttcctgcttcggcctcctcactacctgtttttaacaagttcttagcttccttgttttgttttttgttttttgtttttttttgagatagtcttaccttgatcctctcactgtcatggaacttgttatgttacgtagaccagactggcctctaactcacacacagccacctctcaagtgctgagattaaaggcatgtgcctccatgtccagctcttcctgtatttgtgtttttagaatcttttctttttcctatgcagaatcacataagagttttggtattaccataaagtttcaccttttgcattcacatctttaattcacttagagtccagttttgaatatggtgtaagataggttttaggttttttccttcacatagtaggcagtttgctgggtaccatctcctaactagtagttcattcttgctcaagttccctccttgacttagccttataccatgaccttactgttttcattcctatggattaatacatggtcttaatagctccctcttcgttcttattttttaaagtcgatgtaaccatttatggcgattaattacatgtaaaaatgaatcaaggggcttagtgggagagcatttgcttagtatatgtgagccctaggttttatccccaacattccaaaaaagaaaaaagatcaagtctctcaaaacaagactttttctttttttggtttttcaagacagggtttctctgtatagccctggctgtcctggacctcactttttagaccaggctggccttgaactcagaaatccgcctgcctctgcctcccgagtgctgggattaaaggcaaaacaagacttttgattgagattacatcaaatttctgtatttggtgaggggggaaatttgtcatctttctaagtagtcatctttttctaggaactttagtgaaacaaacttaaatggcataaaaaactactgatttaatatcctattctgttaaagtgcagttccctaggaaactggaaagatagttagttggcttagcttttaagagcactctttcagttcccagcatccatgtccactaattgctctttacctcagagccatctcttcaaccccaatttattttatttttatttatgtgtatgtatttatgtgtgagtgtagatgtatgttcccatgtcagcctatgtgtttacatgtgaggggctgtgcatgtatatgtacatatatataggtcagaggacagccttaagtaccatacatacttgagcacttgtgtttgagataaggtctctcgttggcctggaacttcaccaagtaggctagcttagctagccactgagctccagggatccacctatctcctaggcttgacgtcactggattacaagcacatactacttactatatctgactttgtatctggattccggggatctgaactcagggccttatgctttagaggcaagagctttactgacagctttaccatctctcgagccatatacacatgggtgtttggtttttgagacagtttctcagtgtaatacacctggctgtcctggaactcactttgtagaataggctcacctgaaactcagctcttgcctgcctctgtttcccgagtgctgggattaaaggcatgtgccaccacatctggctcacgcatggcatttttataattaaggatattaggtgtggtagcacatggcctgtaatcctagccctcaggagatggaaacagaatgaatcgttattcaagttactacataatgagttccaagcttgctgaagaccctgcttcctataaaacagaacaaggcaaaagaatattgagggctgactgtgggtataactcagaggtagaatgtatgcttagcatgtaccatgccctggcttccatcaacagtaaaatgtggagggtaaggagagaagagagatgagagtggtgggtgtcatatgcaataaatagaccactgtccctagtcctaaaaggacatgttcaaaatgcctccattttttcccttttttccttttctttgcttttaaaaaaaatttaagacaaggtctcaggctgaagagatggctcagccattaaaggctaggctcacaaccaaaaatataagacaaggtctcactgtataggccaggctgacctcaacatagaaatctgcctgccggggctggtgagatggctcagtgggtaagagcacccgactgctcttccgaaggtccagagttcaaatcccagcaaccacatggtggctcacaaccatctgtaacaagatctgacaccctcttctggagtgtctgaagacagctacagtgtacttacatataataaataaataaatcttaaaaaaaaaaaaaaaaaaaaagaaatctgcctgcctttgcttctcaagtgctgagattaaaggtgtgtgccaccctgcccagtcagaatttttctattgagtataatgtatgaaggaatttttgaaatacagcttttaataaatcaagaaaacttgggctggaagtaatgaatcctattatcccactgtctagacgctgaggcaggaggatccagagtttcagaacagtttgggctatgttgtgagaattgtctcaagaggaccaactaaagagaattgagcagtacattgagctaatatgtattttcagtcttctttaaatctgaaatattcagtgtttgtcttctatctttttaatgtttattagtatatattttatgtaacagtgggctttgtgtacttttatacttcatattcactccccttcctactctattcctgctaatctcctgcctttgctcaactgtactgtcttatattttcacatatttaaaaaactatatttatcttgggggggccataagtgtgtggaggtcagaggacaacttgggagactcagttcttccttggcaataagtgtctttacccactgaaccatcttgtgccttcccccagtacttttcattagggttgtttacaggagcattggcaccttgccagtgactataccactgaaaaaaatctctctccctccatcaactattaactgcctataaccttcttggagggataggaacccatgagtacctccactcctgtagcaggatgtgatgggcccaatcatgagatgttgctcaagtgatcacagctgtaagttaaaaaaaaaaatacaacagccatttcattccctgctccccctcaaccaacccacaccttcctctactgagtattgttttgttttttgttttttttggttttttgggtttttttttgagacagggtctctttttaactctaagctgtctttggaactcagagatatccacccacctctgcctccagaacgcccacctgacctggtttttttattcttaaaaacaaaattattgtgtgtattcattgtttatggtactattacataagggcaatatatgttgagcatattctctgccctccccacttttcatctttgtgttagtctattttattcccttagacagttttgcttctactttcttgttaaatacatacgcttttatgtatctataaaaagtttaggaaccacagaaaaagcatgatgtctatcattctgaaattggctcgattcacttaatatgactatacccaattgcatccattttttgaaaaaggtctaattccattctttgcagctggataaaaatgtcattatgtttatatagcacaatttccttatccattcctttgttgttggacaactagattggtttcataagttagttgctgtaaatggtctgcaataaatattgatgtctctgtgatttgttgacttggagtcctttaggtaatgataaagctagacctcgggagagatctatttttagtttttgtgaggagcctccatacagtgttgcattgtagctagtctattacattcccagatacaatctaggaagacttcctgtcgtccacgctctcaccagcattattgttattttaaaactgctaagttagccgggcatggtggcccatgcctttaatcccagcactcaggaggcagaggcaggaggatttctgagttcgaggccggcctggtctacaaagtgagttccaggacagccagggctatacacagagaaaccctgtctcaaaaaaccaaaaaaaaaaaaaaaaaaaaaaaaaactgctaagtttagttggtaattgtattagtttggttattttgtatctttgttatatttatctggaattggatcaagatggcctcatggtataaattagacagcttttgctgtttttgaagaagtttgtagaaaagtcactgttgtggtagtgcatgcctttaatcctagcacttctgaaacagaggcaaggcagatctctgagttccaggctagctcaagttagatgatgagatcttgccttttatcccagcacttgggaggcagaggcaggcaggtttctgagttcaagaccagcctcgtctacagagtgagttccaggacagccagagctatacaagaaaccctgtgtaaaaaacaagaaaaacaaaaaaaaaaagccaggcatggtggcgcatgcctttaatcccagcactttgggaggcagaggcaggcggatttctgagttcaaggccagcctggtctacaaagtgagttccaggacaaccagggctatacagagaaaccctgtctcaaaaaaccaaacaaaacaaaacaaaacaaaaccaaaaagttatggggctggagagatggctcagtggttgagagcactggctgctctccgggaggaccagggttaaatcccatcacccacatgatagctcacagctgtctgggatctgacaccctcacccatgaatgcagacaaaaacatcaatgcacataaaattaaatgaattatttcttaaaagttattctaaccttaaaacttagtggaacttactttccgagggatctgtggtccttgtttgttctggggcgagaacccagagagctctaccacttgctatgctccagcctttggtgcatgtttacatgtgtacatgggcaattgtatgtgcacatacatatgtgtgtatgtggaagctagaggtcaactttgaacattatttctcaggaatctcctaccttgtttttgttggtaatatttgtgtgtgcatgtgccatgacacacaggtccagaaacaacttgcaggaatctcttctctcctaccatatgggttctgaagattgaactcgggtcctctggcttggtggcaggtgcctttactttttttgggttggttggttatatgttatattatattataggttggttggttgcttgcttgcttggtttgttcatttgttggagcagggcctctctccacatacctctggctgtcttggaactcactatgtagaccaggctaccctcaactcacagatagtcctgcctctgctaccacacccagcagatagctagaggtccttttatatctgcctcacctgcctggcttgttatattggtgttggacatcaaacacaggtccgtaggcttattcagtaaaccctttactgactgagttctttcctcgaatacacatacatcataagcatgcaccatgcccagcggattctttgttttttcagcattttattatgaaaatttaagcatataacaagttaaaagaattttacagtcagtacctctctatcaattaattaggttctatcatttaccacactcatcacgtgttttttttttttttacatgttagctctttttaactttcacaaaatcatatagtcccattggggtttgttgttgtgctgttttgtttttcattttacaatttctgggttctctttttcaaaaaacagttaatgtgtatgagttttttacctgcatacatgtctttgcaccatgtatgtgcctggtacctgtagacactggatgtggacataaaatcccttggaattggagttacaaatggttatgaccctccgtgtagtactaggaatcgatcctaggtcctctgaaagggcagcgggtgctattaactgctcagtcattttttttagctctcaaggatttggtctctttgccataggagacttcgttttattttatttttaaagatttatgtatttactacatgtaagtacattgtagctgtcatcagacaccccagaagagggagtcagatctcattacagatggttgtgagccaccatgtagttgctgggaattgagctcaggaccttcagaagagcagtcagtgctcttaaaaccactgagccatctctccagccagagacttcattttattgttgtttctttgtttttgttttttgaagcagagactatgtagcagtggctgtcctggtctcctctatacagagatctgcccgcctctgtcttcaaagttttaggattaaaagtgtgctctaccaccacctggcaaacacagagttttaaaatcttctgtgttaaaaatgtcctggcttggggttagccgaggaactattgacagttgaagagtctgttttccttaaaggtgtggcctctgattggttgaccactttccagtggatggccctacacctatataagtatataggcagtacaaattggaatcgatgggctatttaaacaacaaaaacgaggacatgaaattgggaaggattatgtggatctgggaggagttacagagaagtggaggatgaatatgatcaaaatgcattgtatatatgtatgaaattattttttaaaaaccacaaaagtgttatcaaaagtctgccacagatcttccttatagaaggccagacatgatggcatatgcctttcattctagcacttaggagacagagttatgtaaatctctgagtttgaggccaacctggttggcatagtgaattccaggtcagttgggactgcatagtaagaccctgtctcaaaagaaggaaaacaaaggaagggcgggggaagggtagaaacattccaaataggatagatatttcttctcatcagggaacagcttaattcttctcttgagtgtgaggtagttttagtgattttcctctaaattaaatggtagagtatggagaaaagaaaaatagaaatttctttttgagatatggtctctagcccaggatagcctcaaactccctatgtagcttaggatcatcttctggttgtctgcctcccaattgctgagcttacagacaagtaccaccatgcctggttctgacacggggatcaaactgagggcttcatacctgcatacacgtaccctaccgtaaactgagctacattccctagcccccgaaatcacatgtgggtgagaaaaataaccacatgatgaaggtctacatcaccagagataagtcataccactgctacttgataatcagaagaacgtctcacttttgttattgcttctcaaccaaacaaaccccaaaacttttaagcctaatcaaaagatcacatcaaataaaaccactacaatccttaaaaagagaaaataactataaagagaagattctatatattaaaaaccttaaacagggtaggtgttggtggtgtggtgttgcatgccttgagtcccagcacttgagaagcagaagcagacagctctaagttcaagtatagctatggctacacagagaaacactgtctcaaaaaaatatatatatatacaaccaacctttcacaggccaaagatgactttggcatccttcaagtaagacatactacaaatggctcaatgattaagaacagttcctgctgctgggcatggtggctttatgcctttaattaaagcacttgggaggcagaggcagaggcaggcagatttctgagttcaagaccagcctggtctacagagtgagttcccgggcagccagggctatacagaaaaatcctgtcttgaaaaaccaaaaacgggctggtgagatggctcagcagttaagaacactgactgctcttctgaaggtcctgagttcaaatcccagcaaccacatggtggctcacaaccatctgtaatgagattagactccctattctggagtgtctgaagacagcaacagtgtacttacatataataaataaataaatcttaacaagaaaaaagaaaaaacaaaaacaaaacacgtcctgcttttccagaggtcgagtccatgttgggtggctcacaactgccctttacaccaactgtaaggaaatctcgtgcttctggcctccaccggcaactctactcacctgtacacatgcatgtacacacacttaaaaactaataatgaaaataaagtttgcaagataacatacttatatgagaaaattggtgaaatcccaataaaacctgttatctagttgacataatgccatggtcctctaagtattaggggaaactgggcagaggggtatgcgtgggtttttttatctttcaactttcctgtaagtcaaaacatacttcaaaataagtttaactttatcaagattagaaacttccagatcaatggacactcaagatgaaaagaaattccccagaataggagaacatatctatgtatatctggaaaggggttcctatctagaacatgtaaagtacttttatagcaagaaaacaaaacaatcccaattgaaaagtggtaagggctaaggatagatatagctcagccactgagctatgtccttaaacctttagttattaaattccccaggctggccttaaatttgtgatcctcctgttttggctttcttgaatgctatgattacagatatgagtcactgggctatattttctttattttatatttatttacttgtttgtttgaaatttttataatttgagtcatggtctccctctgtagttgaaaatagcctcggcatttccctctttctgcctcagcctcctaaattctgagattacagcatgtaccactactcccagtttgcttgcttgcacaagttcattttctttattttcagtgctgggcacaggacctaggcctttgtgcaagctagtcaacatagagctgcacatctagctctttgggtttttttggttggttggttggttggttagttggttggtggttttttgttggttttttttgttggtttttttgttgttgttgttggttttttgtttttgtttttgttttttttgtttttgttttttgtttttgtttttcgagacagggtttctctgtgtagccctggctgtcccggaacccactctgtagaccaggctggcctcaaactcagaaatctgctggtctctgcctcccaagtgctgggattaaaggcgtgcgccaccaccgcccagcgtgtattttgtttttaaatataactcatgattgtttctgggtaatcttaaatatttttatatagttcaattaaatgattttttctatgccttgggatttgggttattgctttttcccatttaagagtagggctaagggctcagtgggtagaacatataaaagattatgaagaattgttttcccagtttacttttttctttttctgatttgagccagggctttgtacatagcaccatggtgcatgctccaccatggagctttagtcatttgtttgttactggtgtaaggtggtcagaggacagctttgtggcattggttctatccatctaccttcttctagattctgggaatccaactcaaattgttaggcttacattggtgagcagtaagcacttttacctgctaagccatctttctcttactccaccttacccctgtgcttttttttttttaaacatagcccaacctggcatcaaaattaggatcctcctgccttaacctgggattataggcatgtgacactacatctggcccttgaactttttctattatggcttaatgtccttccatttacatctttgatccaagctggcatgatagtccaggccataatcccagaatttaagaggcaaaagctagtcttggctacataatgagttcaaggtcagcctgaaataaataccaaaaaactgtctcaagaaaaagtaaatcaggttgtagtagttcatgcctttaatcccagcacttaggagatagaggcagtcaaatgtctgagatcaaggccagcctgatctacagaatgggttctgtctcaaaaaaagaaaaccccaaaacaaaggaaaaggtaagtaagtgaatcttcatatatgtgaagaatagtcaaaagatcttacatgtgcatagatattaataatttatttaaagatttcttttcatttttgtgtatatgtttgcatgtgtgcacactgatcccaaaggagctgaagttacaggctgtcgtgaaccactttgtgggtaataggaatcaaaccagggtcctgtggaagaatagtcagtgctcttaactgctgaaccatctctttagcccaatatttaaccttttagatgtaatcataggtagttgtcttcctgttttccaaacaatggctatttgaatgtaagcaaaatatatattttgtatattaattttatagccagaatctttattaaatttatttgtgtgtgtctttacgagtgtatgcttacatgtgtgcatctggaagccagaagtgtgcatcacacctgctggagctagagttacttgtgagtgagctgactgacatggatacagggaattgaacttgagtcctctagaagagcaaaaagtactcttaacctctgaggcatctctctagcccctgatgttttgtttttttgtttttaatcatcagcattgctgttagtattttgggagtactgaagttagcgcaggccttgaatgtgttgtcattgaactatatacccacagctcctaatttattacttgtattctttcttcccttttttttaaaaaacatgattcatttaggctttgcagggttattctcattggccacaaataatggtgattttacctttacaggtttttttgttttgcttgtttggattttgttttttagcttttcaagatagcttctctgtattaccctggacatcctgggactcacctttatggttcttaatgcttttttttttctttcttccacttacttaattgttttagttagtgtcagaataatatagtctaagagtggtgtcaataacagactctaatgtattacttttcatgagtggactcttaccgcattcttctaatgggcctgattcttcttgcttgaccatgttcttttttacatctttatttttttttctccaatactagatattaaacccagggtctcataggtggtctgccactgagttaaatagccatagcagcatatttcctttttaaataaacacgtattgtttaaaaaaacaaaaaaaaaaaaaaaccagggtctcatataaccttaaactcattttgtactttggctgaccttgaattcctgatcttcctacctccacctctcaagtgctgtgattataggtatacactgctacacctgccatacgatactcgattatcatcacccactgactcccatatactatgttaagctttgagaaataaggtagtaagcccagcagtcatgttccatcatttcctagaactcacctttaagtaatgttgtttgtttttttgttttgacgtgtgaagagcccagtaccttctacataaagggcttgtgcactgccactttactacacgcacaaccccaattttcttaaaatgtgtgtggtgggggaatctcactatattgccttgggcttaaacctcttgtctcagcaccttgagcaactgagactacagacctggtaatttttctcagtctgagatggaaaccagcaattttcatatattagccaagcactctactattgagctatatccataagattaaaagattactatcgagccgggcatggtggcgcgcacctttaatctcagcacttgggaggcagaggcaaacggatttcagagtttgaggccagcctggtgtacaaagtgagttccagccaaggctatacagcgaaaccctgtctcaaaaaacacaaaacaaaacaaaaagattactatcttttaactcatcgaagatttacaatttaaattaactttgaagtaattgttttatagttaactatagttagagaatttttaaatttttaattatgtgtatgtgtccctatgtgggtatgtgcgtatgaatacaaaagccagaagaagacgctgaagttggatttataggcagttatgagcatctgcccaatctgagtgccaagaactcgggtcctttacaagagttccacagttggagaaattttacctgaagaactaccaattctagcaatatggctttgaaataggtagagtgacttcgtagggcagacagagatagagctgcagagaccttaccctgtagggttggtgggatcttgatgaacatttgggtgttcttatgtgtttatttaggtgaaattactaaagcaaatggcatggttgggttgatgaactttatttagagagcactcatgtttggaatttgaggtgaagaattcagtcaggaaaccgtacctgatgtacatgtggactagaggttaggaaggagcggagatagtgggttggctttaagagcctgtgctaattagcccatgcagtgaagcgagacttttcagagtcctagtctaggaaatgggactgaagccctagagagggggttgtaggttagctttcatatcttgagccttttggaaaatctggtattctaactcccatccttcttctagaggtggtcgtggtgacaggactggccgctatggagccactgatcgttcacaggatgatagtggagagaaccgcagccgggaccatgattatagagacatggactaccgctcatacccacgagagtatggcagtcaggagggcaagcatgagtatgacgactcatctgaagagcaaagtgcagaggtgagggcaaggccaggccttgggggcagtgctcctgaaaggcctgtgtgtctggctgcagcaccaggtgtaggtagctctccgctcctgtgcttttggactacttggttgctttgcgtcacctaggggagggtctgtccctgctcccttctctgaggactcttctgagttgagtctccctggctttcacactgcttgactctgtatttctcagggctcctagccactacttctttcccttcttccctgttgttcagttttggcctttggttcactgcaagttctatactgcttactcccaccaatttagggaactcaaaaggatctcttctatgggacccagcatctagggttgggaggacaacctgagagcaaaattatcaaccaatccatacaactctgggaggctaacactgactgtttctggtcttgacagaaaggaaggaaagaagctttggggaagtcagtcccatgtaggtagttacctccagcctaacgggtacaatgctcactatgagagagcacatctgagggctagggaatttcagtctgagagggccagggagatctaatggaagcatataggcagatagctctctgtctagtaggatggaaagggtacacttttgtaagcccagccctgtggagaaattatatttaaaatatcttctaccctctgggtatttgaagggactatcaagggattccactgataaactacaagctttgtttggttagccagggcttacaggcatccaggcttctccattgcctgctactgtgcagtatctcttagtgtctccatgggtacagtggaccttgtgaatggaccattgacaagtgtggaacatggcatccagttgtctggacctgtcccctgcaggtttggggggcggtgtagggtcatgcctgacctgcttagtattgaaattagtaggttggacaattaagaactcaacaaccacactctttgtgaaggagactgatagtgaacagagacttttccaggcctgaggactaaggaccaagggggagtataatggcccatgaactcctgctggctgcctctggcccatatctgaaactatttctgaactgatggcttggttccagggcccaatcttaagcagggaactataggagacgggtgtttttcagtgccacagtaaacaattgtacacataccagctgagctggcaaaagaagacattgaaagcaaagtctagtttgcttaccccaggctagtttatcccaaggaggtttaagcagtgtttctgtcggcctgcctttgggagttcctcctccacaccaatattgctgttcttgaaggcagctcctagaaataccctgtggaacatttgcagccttaaaaagcctgagcctttaaccggagcccgcctgcccacccctggctttcagagcctgcctgtctcagagagccagtggccagccactaggcccacccagactgactacccgtctggtgtctctcatctcattctgtcggccaggattcctacgaggcctccccgggctccgagactcagcgtaggcggcggcggcggcacaggcacagtcccactggcccgccaggcttccccagagacggcgactatcgggaccaggactatcggaccgagcaaggggaggaggaggaggaggaggatgaggaggaggaggaggagaaggccagtaacatcgtcatgctgaggatgctgccacaggcagccactgaggatgacgtacgtgcccccccaatggccctgggcaggaggcaaagcaggaggccaggctgggtctcctccagggccctcagcttctctccacccatcttttgccaccaaccacagcacctttcctctcttctcccccaccagctcctgtcccccagtactgtccatcctccaggatggccccatcagttcctggtctggaagggagaaggcagcagacaggctgacttgacccaggggcagtagccatgggtgtccggtgctggtgggtgtgagagaagaacatctctcctgcacattccattggctttcacccttttgtatatgtggatggagaaccaggcccactgttgggtattcttggtgtcagaaacccatgagagtgagatattagggtccatgggcttttctgaacttccatattcctccccttttgtcagcagtgacagcctggccgcagctacccataaggtggctctttgatagcttctcaacctgtttgcctttgtgacattctctgccttccatcttcctctcttcactcattcccttctcgcgcagatgtcttatggcaagccacaatcaaaacccaagagtattactaaagtagaattttgactagcttccctggactttgtacctctctaccctcagccccagtcagttctctacacagtgcttccctggaagcctgccagctacccattttctaacagtagtaatcccacctaagaaatgtgagggcttctagaatcaggctgatagctgacattacctgttgttttatggcagggtgggccacatgccaggctgattgaatcctcacagagcctctttctggaaggtatacattgtagtcagtcccacatagccccaatcagcaaagtgacttgcttcatgttccagcaaatggcagagcagagttggggtttaaacctggactgctggactccagagtccaagttcttgatatttcctaagtcctccctgattgtttggaatcttgataagatttgtgtatcttgacttttcatcttctgaatacctgtgtgcttaagacttaatttcttgtcttgtaccctgatggggagcagatgcccagaagcacagagacttttactgaagtatctggcataaactccccattcacttaaagaggtactgccagcctagagaatgcctcacctgggctcttaagttgcctctctagtgtccctcaaactcctttcactcaggaagctttccagatcaagcatcatgcctatttgtcttcacatttctcctgacatggctggaatggctccggctcctgtccttccctgtttactctttgtgccctaggtagctttagtgcaagtcaaggagagggagcagttccttcgtgatgggcacaagttgtattccagcttctatgcttcatggctgctactaagcctcttgtcagatcaccctgcctaccattcctgatttgctgcctcacttgctctcctgttgtctttgtgcccctggaggtcatcttgctgccatccttattccgtactgttttctgtctttgtttgactcactttctgcaagtccaaagctggaagcgagactgaatactagtgtaggctgcagttgttgttactggggaaagctttgaaagaggtagaggacgcaggtgtgtgtgggctgtgtgtatgtgtttctttcatgaccccttggggctcagaggccttgagctggcctcacatactcagccgctttctttgctgaacatagcctgcttctgtatttcctgaacagatccgtggacagctgcagtcccatggtgtccaagcacgggaggtccggctgatgcggaacaaatcctcaggtgagctttcgttcccagtgccctccccttttgctggccagcctgagcctccgatctccctctgcctctccctctctcttcccttccctgctcctctcctgccacagctgggaatgggcagcttgcggggggtgccctctcctttctcccatcctctactctcacagctccagccagcagcctcagggttgctgtcctgaaggggatgcagctctgggctgagctgactactcccaggagcaaggccagagtcaggctctggaaaaccttttctttgggactttgagtatctgaggtggtgacccttcccaggacatacatttttttctccttcctctgccccttggtgtcctccaccctgacaacagcttctaatgaaaagtaggtgtgacatggacccacccatatatcccaagaagggaggcagggatggctttcatcgaaagggtatcctaaggagcagccagaactttttggccttacctgttccctccctccctccctccctctttcaggctgcttggagctggcctggggttttagcagggtggagggctgttgtctctgcaggactactgcccaggctccccaaggcagacacagtggggcctcactctgcctgggcttctctttcaatctcagtctctcctccttccacctcctccatctctccatcgtcccttgtctgtttccctatactcttccatccttccatgcatcctggtgatgattcttttggagatcaagcatgcccctccagacccgccacagccaaaacttcctttcatgactacctctgaaggaccttaagcctcaagcccctttctcagtcctggccaggcctggagactatgtcaatgacatgtaggtcttgctctgctttactctacttatatcactcactgacagaatctctgtatctttccctaaggaggcatcctaggtatggcctctcagtgacttcggtcatttctcctaggcacctgctgactcttacctataacatcctcttggccggctccagccaccatctgcctatttaggagaacctcgactgtcagtggctatagtctccctactgtggcactgaagtgactccctagtgatcatcatcccctttcccacaccaaggttaagctgacattacgttcctaaccacctctgctttcctgtgtgctgcctggaaacccccagtagcctcatagaccagcttagcctggcttctcttttgctcttttgattaaacacccgttccaggactcctcctgggcttgctctaggcttgcccatgagttgtttgctctggactatgtgaagtcaaagcaacctcctcttctagagacagatctctccttgtatcccttccatctcaggtctccatctgtcaccccaagttagctaggcaagactaccagagacccatttcactacagttatgctgatctgactcatgctttcattttcttccctccccttttccctctttcctgcccttcccaaccatctaccttgactcctgccttccctgttctttctctgatcactttttctcttcctttctcctctccccctttccctctctgcccctggtccactcccctcgggttctgcccccgggaacaccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccctccccccaaaacaaatactactttataatcgagcgctccccatcgcctgaatcttatggacacagttccctgccctgtgaccctgtgtcccatatccctgcccctttttcccccctcctgacccccactatttcctcttcccatctctcactacccactgggcttcccatttgtggcccagtctcaacactgacccctggcccccttcctactgccaggcactagcgctccctcacctctcctggctgagctttcagagaaagagctgccagggtgggttcccttcttagcttcccagaccccagcaggacccttttgctcccgagtcagcagagccagaacttggttgtgctctcaggaccactggaggtcctgtcactgagggaacatagatgttggcacataaactagcaacacttgttttgccagttttctcctgcatgtgaatttggccctctgagttccatgcagagggacatcactgcttttggttgaaagttccagtcaagtgtgatagttttattgacaccgtgggctcagttcactggcccctcccattcacagcaccctccccacccacaggaggccccacctctaccttctcagtaaggaactgtgctctgtcagctacggaggggccagctcccctagcctggcactgaatcccaactcaactgcgttgggaccttccaagactcaagggtctaacctggctacccagccctatcctgatgtagagtcactggtgtagagcactggaaagaagtgtcaggggaggaaggggcagccgtggtaaagtggagggtcctggcagaggcagccctgtggccggctctgtgggtctggtcaataagctagtgcggtgggcccaggacccggccaaccttgggaaggtggcctcatggcgggaaatctccgtctgttaaattggctttctttttccccttctccagcattagcgctcgtgcgctctttctctttttctctcccctcctctctcttccctgcccatctcccctcattcccagtgtagcctgtgtagtgctagccctgagtatggcctggcactgtcaagggccaagctgggggagccctcccaactctcgacagtcgttggtcaaccaagtactatgtgcctgattgtgtttgtgtgtgtgcgtgcgcgtgtgtgtgtgtgtgtgtgtgtgtgtgtgtgtgtgtgagtgcgttcgtgcgtgcgtgcgtgcgcacgtgcctgtgagtaaacagcaaacagatgcgccctgagagctgtggcgctttccttccctcatccccatcccgtccctccgttccttcttccctccatcagttctccaaactcccttcattccctgtccctcatccatccagctgaagggctcgctcactcttttctcctttgctgaaacggtatgtggggcactgctacctgggtcttgattgtgctctgctttttcccacagcactccctcaacatcctgggccagaaggtatccatgcattacagcgaccccaagcccaagatcaatgaggactggctgtgtaataaggtacaggggtggatgggtatctggtgctggggagaaagtcagttccagcaggagcagcagcagcagcagcttacttagtcggagaaggcgtagtcttagagatatgttgtctagccccagtcagtaggctctgtcctcatcaaacacagccttgcctaaaggtccagtagagttgaaagaaataatagcatataagtgactaatcggtgacaacacaagcctactatagtatataggacatgggcttcagagccacactgcttgcagtctgtctcaggtctgccttgatgctggtcaaggtgcttatcctacctctgtatcacttttctcatctttatgtgagtgagcactaatacagtgttgaaagaatgaaactgttggtgggagaataataaaggcttctggctcacattcaactctgtaagtggctgctgttccctttaaaaagaagcagagtgttctgaggtaactcagctgtgtctaccttgaaggtccctgtaggttatgtgatcacgctatattccctaagagaaagctaaggctcaggtggaaccatgcatgagcttttagctcgcagggccacctcctgttccctacgtggccttaggtctgccctgaggccagcattgtgattctgcaaccccatctcctggggctctctgtagtcctaaaacctaaggaaagctgagagctagtggaggaccctgacttttccctgaggagtctgcttagtgggagagtgctatctgtcatctttacataggtgatcaacctttctggagagagagggacaacatgatactggcacttcatcttttttttttcatattttccttgaagctggtgtttgctttgtgttcttctcctcctttttgtcctgcatgtctttcagttaccagatcctgtcccatccatctcagaatagtcaccttcctttgctcttcttacagttcatgccagttcctacaccttcccatcgagttcccatagagccctttttgttgttagcctcactcctctttctccacccttacctgtaatgttgcagctgaaacctagctctgaccatgccttaccttctctgcccaaaacatgagtctctcctttaactgtcaccatcttcccttgccagccttgactttctctctctgcatgccccccccccaacttcatcagctatagaaagtctcttagcccctccagcaagactaaaacctctggatttcccagctctaactgccctgcttctgtgaagcccagctcagtgagctgaggccctttcagcccattctctgctcctaactcctatcagtgcagtctaagcagactgtcctgaacacatgatgttgggccttacacaggagcactgtttagtatctgaccggaacagagatagagttgtgatggaagccgaacaaggtagctggaatatctaagaaaaaagtcaaaagtagcagaattcaatctaggcctagcaataaggaaggaaatgaatctgactaaaagattgtggcttccagtaggaaacagtgaaagtttctgttaggtaagcaagtctcaggaagaagggaccatgagatacagtgctgagagttgatagtcccaagaagatagggaagggacacaactgctgtaatgtgtgagagttgctgattgctgaagtaagagggttggtgctgggaaccagttgtcagatttataggattgaagataataaagttccaaaaaactcgtgctacccctgaccctcaaagttcccttctgcgggattatgttgttctgtgggtcgatatttggaggatatcatggaaagtcttgaccccctggcctgtgcctcacagtgtggtgtccagaacttcaagcgccgagagaagtgcttcaaatgtggtgtgcccaaatcaggtgagctgtactaactgggagtggtgagaggcgttgaaggccagtgtgtaggggctggtgaggggtggggagtatggtcaaccatggagcctctaccttcatcatcatcatatttcccaccattcctgacagaggcagagcagaagctgcccctgggcactcggctggatcagcaggcactgccactgggtgggcgggagctaagccagggcttactcccactgccgcagccctaccaggcccagggagtgctaacctcacaagccctgtcacagggctcagagccaagctccgagaacgccaatgacagtgagtcagttgttctttctccttactttataccctagggtatctggtgtgggacctctgagggccaaagaaatggtaatgaacaatacttggtccttattaagggagagtgtttctacctggtgtggggataactatatgatagagagcagagggagaagctgcccacaaactaatttggggggtagatgagagggttcctgatagttgagacactgttgacacctggactgacaagccgagtttcttcaagagaagagtaaaaggaagcaaggccgagtttcttcaagagaagagtaaaaggaagcaagaaaacagggagccgtggggatctttaatgggggccctgaacagactgtcagaggtgcttcctaacactgggccctctcccgcagccattattttacgaaacctgaacccacacagcactatggactccatcctcggggccctagcaccctatgcggtgctgtcctcttccaatgtgcgtgttatcaaggacaaacagactcagctgaaccgaggcttcgccttcatccagctctccaccatcgtggtgagggcggcacaggggggggtccgggcaaccacggtcccggcccccagggtagggaggggggaacctttaccccatcctcaccgcggtcccagtctggaaatggggcaatggagccggggggcctccccgggcctgacccttccgtccctgctacccctctacccataggaagcagcccagctgctacagatcctgcaggccctgcaccctccgctcaccatcgatggcaagaccatcaacgtggagtttgccaagggttctaagaggtcagagccccacctaagctccctcacagcttgccccaccctcctaccttggggatccctgtttcatttccagtttctactatcctccccagggatatggcctccaatgaaggcagtcgcatcaatgctgcctctgtggccagtactgccattgctgctgcccagtgggcaatctcacaggtacttggcctcctctgaccccatcaccctggcatctgactttcttaaaacgagtgttataggccttcctacctttactccttttcttctgcctttatagatagttatccattcccgctccatcctttctatcatccccagtcaccttttggacttctttcttttttaagactggttactactttatttttatgtgtatgagtgttttgcctgtacctgtgcatgtgcaccatatgtgtgctcagtgcctgcagaagtcagaagagggtgatctgaacctagaattttgaggtcttgtgaacaaccatgtgggtgctaggaaccaaacctgcccctttgcaagagcaacaagtgttcttatctgctgagtcatctctccattcctgtcttggtagttggtgctctatgctgttgaacttttttagattgttctgagttagtataatgtgttgcatattgtttgggtgtgtgtgtgtgttgtactgtttttaagtatatgtgccatgaataaaaaggaatttataaatatttgtttaaaaagtctctgggagccaggtatagtggtaagcacctgtaatccccgttcttatgagtgaaggcaagaggatgaggtgttgaaggccagtctttggttctctaatgaatttgaagtcctgtctcaaaaaaaaaagtaaaaattttggtagaagagaattaagagtaagaggacagcaagatatgataatgcctgcctatatttctagcaatgatgtggggagtggtggcaaagtcaggatttctacgagttccaggccagcatgggctacatagttgtaggtgggagagaggaaagaggaaaacaaaagggaaaagagtgagggtgtcttgcttggtatggacctcatcagtatcagcctaggatgtatttgggcatgtagcctttttctagtctctcttttcttccctgttctcttgtgaccaggacaccttgattgtcacttaagactacatgctttctgtcaagtagaaatcctagctccagcagggcaatggtggcgcacgcctttaatcccagcacttgggaggcagaggcaagcggatttctgagttcaaagtcagcctggtctacagaatgagttccaggacagccagggatacacagagaaaccctgtctcgaaaaacttaaaaaaaaaaaaaaaaggaaatcctagctccacatatagggacaggtgcatctagcagatttcttcatttatgtcccctcctgatctaatgatctctcatctgcctctcaggcctcccagggtggagagagtgcctgggctgcccccgaggagccaccagttgactacagctactaccaacaggatgagggctatggcagcagccagggaacagattccctctatgcccatggctacctgaagaacagcaagggccctggcatgactgggaccaaaggggacccagctggaacaggtgagcctcatactctctagctgagcctaattatggggcctagaggcctatggccgtatgctctgacatttgtgggcattcattctccatggtttctcttttcaggtcctgaggcctcccttgaggctggagcagactctgtgtcactgcaggctttctctcgagcccagcctggtgctgcccctgggctctatcagcaatcagctgaggggagcagtggccagagcactgctaccaacagccaggtgaggatgccgctggtcctctggggaggttggtaggctggcaaggtgccccctgagtgggcagggtgccattacgagacactgagtcctgttcccttctgtgacccatgagcagtcatacaccatcatatcacctgctgtgctcaaggctgagcttcagagccctactcagcccagcagctctgccttcccaccggctaccagtcccactgcccccgaggcctacagccagtaccgtgagtatctgagtatcgacagcccgtggggaagggtgtgcacttctctaaacagagaggaattccacaaccttgtctttgctccctccccacagctgttcctgatgtctctacttaccaatatgatgagacatctggctactactatgacccccagactggtctatactatgatcccaattcccaggtaagcgaaaggtagcctagggaaactggagtgtggttttgtggcagctacccctatacatcctccctcattctttccatcagtattactacaatgctcagagtcagcagtacctatactgggatggggagcggcggacctacatacctgccttggagcagtctgctgatggacataaggacacgggggcatcatcaaaggagggaaaagagaagaaagagaagcataagacaaagacagcccaacaggtgaactgccggccatcatctggttgtttgaagtctatgttctctcacctcttgctctttcctgctataggaaatggggtggtgggtgggcatggacagggataggaactacttcagatagacagtactcctgaattaggtctattttgggggttccagtactcctgaattaggtctattttgggggttctgtagcaagaccacctaccaccatgaagtggcttgtactgtctgcgtgagctcttgacagcttttctctgtcctacaaagggaaccttcatgctggtggtgggtgtgtattgatcccagagaaattgtcgtaagctcacgaggggttgagaaggaaaaaaaaaacattgcagggttttctagtagggaaaagttagcaggaaccttagtctctgtggagaaaaggtatggcattgaagcaagcaataaatattctctccgcaacctgagggattctcaaaatgtttcatgccccaggaaaaccacaagacattaacgtggcatgatatcacatgccttagttaggtttctgttgctgtgataatcgttgaccaaaagcactatgggtatgaaagtatttcatgatgaagggaagccaagggaggtacagatacgaagctacagagcaggaagagctgctgctgcaggggcagtgggtgagaaagtagagacccaagcttcaagaaccttcaacctcaaccctcaaaccccagattgccaaggacatggagcggtgggcacgcagtctcaataagcaaaaagaaaa

SEQ ID NO: 30 - DNA, 31412 bp, mus musculus; identical to SEQ ID NO: 29

SEQ ID NO: 31 - DNA, 31412 bp, mus musculus; identical to SEQ ID NO: 29

SEQ ID NO: 32 - DNA, 31412 bp, mus musculus; identical to SEQ ID NO: 29

SEQ ID NO: 33 - DNA, 13913 bp, mus musculus
gccagttgagggtcgtcttcctatcttcagttgcgtcggcagttggaggaggacagacggtgatggcggcggtcgcagcggacccagctgcagctgccgtcccggcctctgctgaggaccgagacacacagcccgaggcaatgccagacctggatgaacagtggcgccaaatcgggaatgggcgagagcgtccactgcgagctggcgaaagctggtgaggctgggcttcaatgaagccttggccaaggggaccttgggggcgttagtatcgcggggtacttagaaatcaaattctgaggatgaagcggtgcgaggctgggaaggggcttgggccggcgggagagagggggcgtggaagtgctaagtgaatgaatctcaacgtttgggggaaaaggcggggcccgagtggggcagtcagccgcctaaggacaaaatggggtttgtgataggggtggggcgtgaaggggatggccgtgggagtcaggggactgcatcgtttggggagggggtgagaggggactgcgtcttggaacctggagcctggaaaggaggctggctccgtacttaacgcgggggcgtggcgtgtgttacaaaacgttgcgtcggttgcaaggaacggcctacaagtactcgaagcgcctgtgaacccgacgagcttggtggcgtccgctgaagagcaactccatagcctatagctgtgggccgaggggcggaatagtgtggtatggggagggtgcctggctcctgggaacaaggcgaagggctggggaggggcaaactgtggaggaggggcagtgcctggggcagaaaatggcgcctgcaaaagagcaaagattgtgacgcggtatttttttttgttgtttttgttatttttttaatacccctctagttaaggtctccttcctagaacaggagaaagtgcaggtggtttacaaaagattatttggggagtttttttttccacgtgataatatttttgtaatcagaaatggctatttaaaagggatccacagcttttaacaaattgtcttgttagaccatttttttttaaatgctaatcaatgcctcttaaaatttactgctccccgggttcctatttctctcttgagttgctgctcatttttaattgtgaaaatcgtaagacctacaaagattatagtataaaacgttttacataaatggacatcctgctgaaagaaatggtttgtatgcttcaaaaatggcaaggtcatgaaaggcatacgctgaagaactgttccagattgaaggaattaatgcagtttaacaagtctatgcaacacgtgatcctcatttggatctagcacaggaaaaataaattatttttaaaaatgagggttctttctcataatttatttctctttcactgtaaattttattggaaaaaaaatcggtgaaatttgacaaaggccagtagataaaatactggtactgataatttcttgtgataattgtaatgtggttatgaaagaatatcctttggtgaaaaaatacatactgaaatttcatagataaggagccatcgtgtaaacaacttaccaaataattatattaaaaatgcacatgggagggagaagattatggaaatattggtcataggatgtaaaatttagttagacaaaagggaacaaattcaagagctcccttgtacaaaatggtgattatagctaataacactctattctatacatgaaaattgcttaatagattttacatgttcttacccaaacaaactgtgtgacataattggtttgttaactagtttgatttagtgttttacaatgtatatatcaaaacatgctgtatactatcaatgcacacttttttttgtctagtttaagataaatgaaaataccccaaagatgatatggggaaaaaaagaatagaacaaatggataaggtgtgttagatttggggactctaagggcatacagagaagtctttatattattctgccctctctttttagaggcagggtctctattatgtggtcctggctgtcagggaagtaactatatcaggctggctttaaacttagaaatctggctgagattacaggcatactccaccatgcctggctttttaaaaacccattttcagtgagtttacttcaaagaaaatttagtaaattttatatgtggattaatcactcatgtgaagattcagaacattaccttaaaactcgtatgcttttcccctccatcttcataggaaactgttatcctaaattttgaattaaagggctcttttcacatttcattatcataataaacttccaatattcatatatatgtgaatatacacatatatatgaacatgagtgtttgtgaaatagactgtgagcccttatattccatggtaaatagtatctgtatgatgtaatttgatacattaaccttgacctgttggtctgccaggtttctcaagtgttaagatgctgctgttcccttaagcagtagtttcttaaatacatatttaaattttatttatattttctgtccatctgtacctcaggatatccaacagcttcttgtttcatgcagtataaatggtaaagtcctcagtgacctgcaaggcttttggagactggtaccccttctccattctaacatttctctgatctgattatcagcccccaggcccttcctctctccatcagggacacccacattagactattgctgttctttacatttagggccttttccaggttttcccactttacaaagttcctaaacaacactgccagtgaaatgtgtatacattactggggagataaattacaattcccatactagaggatatagtgacatctttctgccattatatcatagttctccagcaaagactggcctcaatccgtcctgaaaacaaacagtaaccagactgtttgtataactcatttggagatgtccaacagttctcaaagctttggttcattcctctttcctaccttgacagatgtgtcattatttttgctattggtagataacacatgatcctgtcatccttaccaatggccttttaaattagcctgccaggagaggaccttctttggggtaaggaaaatattttggaagtaagtagaggtgggtacacaacattgtgaatgtactaaatgttaatgaattgttcactttaaaatgggttaattttatgttaacttcacctcattaaaaaaaattaccacaccagtgttggttgagtattaaagccaatttgtttctcctgttggaattgttatgaagcattttgccaagctccactttttgttgctcatttaaattaggtaagagcaaaggatctcaaagtttgctgccatagttgagaaatacgtatttataaagcatttgaattcaaggactagcttcaaatcatacatctgtcagtattagctgtacctcccatccttagcttaatagcagattaaaacaattccagttaagtaactcactcatctttactgattaaatttcttagatgcatttgtttgggggtggggtggagtacaccatgtgactctgtgctggaggaggccagacaaccacttgcaggagtccgttccctctctgtatttcctgggggatcaaattcaggccagcagacttggtggcaagcacctttacctactgtaccatcttacccaccttccaccttattttttgatacagggctttttgaacccagagctctgttttagactggccagcaaacctttagtattttgtctccatggccccctcaagtgttgagattatcactatgccaaatgttaagtttttttaagacaatgtttcccctgtaactttggctgtcctagaacacactttgtacaccaggctggcctcgaactcacagagatctacctgcctctggctccttagtgctgggactaaaggtgtgtaccactgccacctgtcttgtgccaaattttttgctcagctttttttctgtagctgtgaggatccaaacacagcaggcacttgacccagcccctaaagagcttatgttttgaggccacattccaatctctgaaaagacagcttccttagaaagtttcagttcttgtgacagtgaattgtctacacgtttaaatcaaggatatttgagagactttggttacttctgtatagggtacagaaacttcctaacagtaaacaactgtggagttcttaaggaagaagggtggctaggttcagagaggtgcactgacactacatgaagagaaaccagtttcataggaccttaagaaggtgttggtgaaagatattttacagtagtgtattcttttgtttgaagatttatttatttattatgtgagtacactgtagctgtcttcagacactccagaagagggcatcaggtttcgttacagatggttgtgagctaccatgtggttgctgggatttgaacttgggacctttggaagagcagtcggcactcttaaccactgagccatctcgccagccccagtagtgtattctacacaactaactgaggacgtttttatttttctttgaggtctcacacagttaacccaggctggacttgtgagagttctgccctagcctctaaagtgcattttttgatttctcatttccttttttttctttctttttttttttttttggacttatttattttatgaatgagtacactgtcttcagacacaccagaagagggcatcagatcccattatagatggtcgtgagctaccatgtagttgctgggaactgaactcaggacctcaggaagagcagccagtgctcttaatcgctgagccatctctccagccctgatttctcattttcaaaaatatttcataggaagaactgggcatgaaccccagctcttaatcccagcactagggaggtagtggcatagaaccagaaagccaaagccagtgtaggccacatgagaacttgtttcaaagaaagttggaaaagtgaaagccattttaaaagcttcccggtgttaccagtgtggtaacacatggctttaatgccagtactctggaggcaaagggattcctggtcatctacatagtgagttttagaccatacagtgagtgctgtttcaaacaactggagacttttagatctatatgattattcttgttgccctttaatgggaggaaaacaaccttatgttatctcccagagataattatggcattttcccagtgtcattgtcttaagtttggaaagacagatcaacagtgcttagatgtgggcatgatgactcatttgtcagatttcagcatttaagagacggccagccgtggaagaatatttagaaaacaagatgagcatggtaacacacatctgaagtcttacctcttgggaggctaaagcgggaagattgtgagttcaaggccatccaggtcaacatgagtcctaatctaacctgtctcaaaagaaaaatgttaaagtcaagacaacaagtagagttagttttataagaacatagtggtaagggttattaggttcttacagtcatcttttatatagttcaaatcagcctgtgctacatagaccttgtctcaacaacaaaagagattgaatatgcagtcattcatggtgtatccttttaatcccaacactctggagccaaaggtaggtgagttctaggtcagcctgggatatgtaatgagttccaggacagcccgggatacatagtgggaccctgtcttaaatgaaagtaaaaaggtggactggagaaatggcccagcagttaagaatacatactgcttccagaggcccaaacacccagttcggttcccaacacattagatggctgacaaacacctgtaactccagccccagggaatctcatgccttctggcctccaagggcctttgtaattacatgcacatgcttgcacacaggtacacacacacatacattttaaaaaatataaaaaagaactaagaattggcaataatttggtgacaaacaagtgattatagtaattttatatagaagatctaactcctgttcatctttgggtatattgaccacaggataatgggcaataaagaactcactagtatgcctttatgtgtatttaaccttatttaaataaacttcatagagcaatgttatatttatcacctataagatttttttagttgtgcaggatggcggggatatgaataatgaaagaattcaagacataaaaagccacaagaagagggtttattatgcaagaaataacttttgttgaggcaggggtgttttgtgcaggtagtgaagcagtgtttcaatgatgcagtgccctggaacatttgtagttggggcttatgataggtaaagttaactctttctgaccaggtaacagtcattagtggccttgctttgaaaagcccatcctgtcctgagtcaataactgaataactgccttattctgaggctgtcccagagtgttctctacatttattttctcctgcttgtatgagattaagtctctagccctggctgtgctcacagtcaaagtaattttcctgcctcccaagtgcatgtgtgtgtgtgtgaattcaatgtaagacctcttaagtgctaggtaagtggtctaccactaagctgtagccccatcctaaactagctgaagttttgttagagtgattttaatattaattttctttcaaaatatgctttgaggaaggtgaggggctagagagatggttcagtggttaaaagggtgtcctactaatcttgccgacactcaagtcagatagctcacaattgcttgtagtaactccagctccagggaagatctgaagcctttggcttctgggagtacatgtactcacgtacacatttctatccacagacacataagtatacacataattaaataaaatcttagctgggtgtggtggtgagcccagcacttgggaggcagaggcaggcagatctccgagttcgcggccagcctggtctacagaggaagttccaggacagccagggctacacagagaaaccctgtcttggaggaaacagaaactaataagatatttttaagtgagccgtgcctccctttgtattgaaaatactattaactaacttagctttattaagtgaacttcataaactgtagaggccagtaaagctggaaggaggaatgtcaatgtaggagctgataggttgaatgatagattttatggcatgagcccctaggtgggaatgtgtattttcctggaataaagtgatatgctagggtctggagagtagggagggcaatgtatagacaaatcacacacacacacacaaatacaaagccaagtgtgatttgtagttgggggcttatgataggtaaagttaactctttctgaccaggtaacagtcattagtggccttgctttgaaaagcccatcctgccttattctgaggcatggaggcagggggcaacgagttcactgccagccaagactatagtgaaaccctgtctcaaaagagaccccaaacaaaatccacagcatagctgagccatgtacacacctttcaatcccagcattcaggaggctgaagcagaaggaaccagggagcttgaggccagcttgggctacatacttagtatgttccgggccttaccagatggtacaagacatcaattttaaaaacaggaatgaatgaaaaaaaatcaagtaatccaatattcaaatgtgcatttcactgaataaattttgctttttacttatatttacatagtgctggaaaatttctgcttaaattacagtggattaatagtaactgcacatgatgaaaagttgtattgctagcccctgaatgatcatatgacaccctgttgtctgtctgggttccaggttccttgtggagaaacactggtataaacagtgggaggtgtacgtgaagggaggggatcaagatgctagcacctttcctggctgtatcaacaatgctgggctctttgaaggtaccaagcctctgcctctctccattaaccttgccctggagttctgatcccttctgttcctacaaggggccatattcccattctctatgcttagtcattagtagggtggccagaattgacagttcctttcttaattcatgttttgcctcatccgtacccctatacctacagatcagataagctggcatctcagggagagactgctagaaggagatgattatgtgctgctcccagcgcctgcttggaactacatggtcagctggtatggcttaatggatggccagccacctattgagcgcaaggtatatgggtggggtagatgctaagggtgtgagttagatttctctgggaagttggggaggagaaaggccatgtaggctcagggtaggtccagaattgtatatacctatattcctttgtcagttgggtgggtctttgagtgttggtgctcctctctgccttcacaggtaatagaacttcctggcattcggaaggtggaagtgtacccactagagctactgctcgttcagcacagtgatatggaaacagctctcaccattcagtttagctatactgattctgtgggtgagtctcagggcctctgggataaattccttttcctaatcatgggtcatatctcagtgacccaaggatgtgtggggaacagcttacagcctcctgagaaggcactagtcaaactgtggaggaaggtggtggtggctaagttgagcatagacactgggtgtctactggagtctacaaaaaatgagctatattccagttgcttgggtgagagttgaaaagagtgtttgtttattgggaaggtctcaaattctgagtttctaagtgtgaagaatgatctgaggacacaatgtattggccatgtaagcaaattttatgagaatgagctaacactatcacatgggtgagtattctggggtcccagaagatatggtcatgttcgatcaccctccacagaactagtcttgcaaacagctcgggagcagtttctggtagagcctcaggaagacacgcgcctctggaccaagaactcagagggctctttggatcgactgtgtaatacacagatcacgctgcttgatgcctgccttgagactgggcaggtaaagaggattcctttgtgctggtagccaggtggatggattcctggcactagtcagaccagggaagggcagggtgccattgagcccttccattaatacattccttttttcctttctttaccttatacccagttggtcatcatggagactcgaaacaaagatggcacttggcccagtgctcagctgtgtggcatgtgagcctttggggtgtaatgcagtgtgggatcaccccagagtaggcagacagaacctatgagtacagatcacccacttgtagtgggccttagctcataaggtttctcatccaactccaggaacaacataccggacgaggatgaggacttccaggggcaaccgggcatctgtggccttaccaatctgggcaacacatgcttcatgaactcggccctacaggttgggctattaggtctatgtctggcaaactatagtggttaggtattggggacagagctagggggtgggggtagggcaaagaagactacagtacaggggatcaggtggaaagccaaggctccatgaatctgatctgctgtgcccacatttgctccccattctcccttctttcttttggtgctaccatcttcctcctccagagatactgatatttttcctgatactgcattcacaatgccaaccttttccccttctctctctcatttccttttcttcccatcttccttttctgttctcacctgcaccacctcacctctcctctacctctttcactggatcctactaccacagtgcctgagcaatgtgccacagctgacagagtactttctcaacaatcgctacctagaggagctcaacttccggaaccctctaggcatgaagggtgagcttgctgaggcctatgcagatctggtaaagcagacttggtctggctaccaccgctccattgtgccaaatgtgttcaaggtgtgtctcaaccccatgggctctctcccaccatctttttttctcttgcttctcttatctcatgctcactctcccatctactgtctccttagaacaaggttggccattttgcatcccagtttctgggctaccagcagcatgactcacaggaactactgtcattcctcctggatgggctacatgaggatctcaatcgggtcaaaaagaaagaatatgttgagctatgcaatggtgctgggcggcctgatctggtaggctacccattaaagctacatggccactgccttaggatgtctctgctttccccagtctatcaccttagcatcttctcagttcccctaccttgacctttacctcaaccccaggtattgcactacatctgtccccatacctatcttagagttaaccccacttaggctcccgtcctacattcaaaatgccagctctgacagggaacatgggttccagacagacctagctgtaaccctgccactaggcttcaacagtgtcctttacctcaaacccctatgaatctatttccaaaccttgccccctgccccaaactcaccattacactgtcaacaggaagtggctcaggaagcctggcagaaccataaacgacgaaatgattctgtgatcgtggacactttccatggcctcttcaagtccaccctggtgtgccctgattgtggcaatgtttctgtgacctttgaccccttctgctacctcagtgtcccactgcctgtctgctccaggagggtcttggaagtcttctttgtccccatggatccccgccgcaagccagaacaggtgaggttgtgggaacacaatgaggggcaggcaatcagcctttgattacttccctcacgcttttctacattaacctacgataagctcctttgatcttttgtaaatgttctttccccctcagcaccgggttgtagtccccaagaagggcaatatctcagatctgtgtgtggctctgtccacgcatacaagtgttgcaccagacaaggtgagacttttgcagatggagactgggtaggtaggttttaaaggaagaaccttgcacactgactttccctatgtccctgtactattcacagatgatagtagctgatgtcttcagtcaccgattctataagctttaccagctggaggatcctctgagtggcatcttggatcgtgatgatatctttgtgtgagtgaggaaacggatgggaatggatagacgatgctccccccaccttttgttttgtcctactgggaatagaacccagaacgcatgagcatgttagataagtactcttttttgtttgtttgtttgtttgcttgctttttttgttttgtttttttgtattttgtttttcaagacagggtttctctggctctatcctggaactcactctgtagaccaggctggcctcgaactcagaaatccacctgcctctgcctcccatgtgctgggattaaaggcatgtgctaccactaccgggctagataagtactcttaacacttgagctacacttacagttcaatacatatactcagaagtatgatatatatatatatatatatatatatatatacatatatatatatatatataataaacatgaatatatatgcataagtatatataatatttataactatgtatatatgtgtgtatatatattctgagagagagagagatggtctctctgtgtagccctggctatcctcaaacatagagatccaccttgcctctccgtcctatatgctgggattaaaggtgtatgccagtatgtccagcaacatgctccatttaaaatgtacttattatttatttatttttttaagattcttttttttttttaagatttatttattggttatatgtaagtacactgtagctgtcttcagacactccagaagagggagtcagatctcgatacggatggttgtgagccaccatgtggttgctgggatttgaactccagacctttggaagagcagtcgggtgctcttacccactgagccatctcaccagccccttgttatttatttagagcccaagcttcctacatggtaggcaagtgcttcccacatttttaaatttggggcaactaaatacgatgtttgtgaaaagaaatgttctttgtaaacaagtgttttccacagggaaaaaaaatgtttcaatccttgtttttattacctcccccctagtattcccatgttaccaaggctcttcctcaaacagcatataaacaaactgctatggaaattatctgatagtttataaaataccaaatccttcatgggttttcagaccctttaaaataatttgggacaagtgctagctagctactcttcagaggatctaggttcaattcccagcaaccacatagaagctcacaaccatctgtaactccagccccagggcatccagatgccctcttttggtctttgcagtcaccaggcatacatgggatacatagacatacatacaggcaaaacacccatacacataaaataatgataaaatattaaggggaagcaggtaagatgactcagtgggtaaaaacactttcacaaaccttgacaacctgaatccatgatggaaggaggaaaactgactcctgaaagatgtatttattctgacatccacatgtgtgtcatagcgtgtgtatacccatacaaatacaaacatacactaataataaaaatgaaaaataactcatagttttggactgagctgaataaatggagcaactgaggggtaatctttcttgggatgcctcaattaaggaaaaactaacccctgtcccttgcacacatacagatatgaggtgactggtcggattgagccggttgagggttcaagagatgatattgtggtacctgtttacttgcgggagcgcaccccatccagagactacaacaactcctactatggtctgatactttttgggcaccctctcctggtgtcagtgccccgggaccggttctcctgggagggcctatataacatcttgatgtaccgactttcgtaagtaccgttgtcctagggtcagggggagtgcatttgagggaggggaccaaggtcagtacttagactcgggttctgagttgctgtttggtacatccaaaggatagttcaaactgaacatggcagtagactttgcagggctttttttttttttagacctctggcttctccagtacttctctttggtcctgggaatacagaggtgtacaagaaaaactagagacaacttcattttgtatgtaattgtctctacagagagacttgtatatagttttatccttacacctaaaatccagagttcttaccatggaaggcaagcaaagctaaattatctggattaatctctccttcattctaattcaaaaggcttctctgacattaatttgtagctgattgtatatctgcttacctgtggctttagagcgcaggccactgatggtgttcttaaccttttcatgcatcactgcttcaccactttccaggttcatgattaagaactgccaggtgtgttggcgcatgcctagaaacccagctacttggtcagctgtggcaggaaaagccacatatgaccagcttgagtaacttaccaaaactgtctgaagaatttttttgtttcagaaaagtgttgggagtgtagctcggagatgaagcattcacataacattttgagagagagagagacagagactgactctttcatgtgtgtttaccactaacttctccaccatacccaaataaaactttgggatggccctctatccttgtggccctcccttgggagtcttctctgctctgttacagacgatatgtgaccaaacccacctcagatgaggatgatggggatgagaaaggtgagtcgccaagg

SEQ ID NO: 34 - DNA, 83183 bp, mus musculus
ggttatttaaagaaggtggggggcgagcgaaggggttggaagctagtattctccacccctgctctagcaagctctttccagcgcagccaccgctgtcgcacaggaacctcccttctccccttcctcgtcccacctcgtctttcccgctccaacgccatggagccggacacggccacagaggcagccaccgtggcagtttcggatgccagagccacagtcgtggttgtagaggatgagcagcccgggccgtccacctttaaagaggagggagcggctgctgccgccaccgaaggcaccacggccactgagaagggcgagaagaaggaggtaaataggaaaggggtgtgtgcgcgcgctctgtgtgtgctggacacatcccgtgcctggcccctcacaggggcccaaaccctgaccttttggcgccgacaggtaccaaaatcactgcagggatgggggcagcggggcggcagaaccatctagcattccctcccctccccctttcctgctggccgcctgctgagcgggggcggggcagggcgggggcgcggccgggtagcggggtatcccgatcctgagccccgagtctctcctagactcgggcctccctctaccttcccggaactgggggaaccttgtgggggatgggactgtgcaggaaaatgcctccgcctctctctctctctctctctctctctctctctctctctctctctctctctctctctctcgttgctcgctcttctacccccctcttcccgtcggcctctgcctgggaaatctgggcccttcagtcccaccatcaggctgatggggatttggctcgggcttatttttgtaatttaaatttcaaggtgctactggtggtggtggtggcggcgggcaggagggggaagagggagaatggttggaagataatgcttgctgtgattggcagtgtctgtctttgggattacagaaataaaaaaaaataataatctctcatgttcctttgatccttgcctcatggtgaggagggggtgttatgtcaagaaaacatcctctctgcgctttatcttacaaccctcacactgaggaaccatgctgtcttaggaaaatgtccaacctttgcaccctctccctctcctgccccgcccctgatggtatagtgtttcactctgggacacccagatgattccccttatctggcctttggccttccagccttttgcttcccttgcctagtggggaaccattcactcctggacacgtttattttaaacgttgtaaagtcctactctgtaggatgaacacaggagagaagaccactgtcacacctattacagacaaatccaggaagtaggtattatctcccatgaatatacaagtaaaattatacaatgctttgaaaaatcgatgttaaagaatagggtggaacataagaagttttgatatataataaaattgcagaacagatcgtttataggtggatttccccccatttaacaatatacacgatgatttaaaaatggtgggtaattgaaattatgctttaagaatctcaagtgactttgtataaatcattatacaatggcatatgactaaatgaatagctttttgggggaaattaacacattttgccttgaattagaagaatgatgctaaatccattagttagttaagttgattaaacagaaagtgctaagtgaaaatcatgggaaacactgggtgtaagatgtgtgtggtacttagatcattaagacggcacagatcattaaagctgggccagataccaagtatttggttaagaaatttaaaatgcatctagtgtcttttattctctggactaggcaaatataagtgttaattatttcttcttcttcacatgggactcaatgttgaattttgaaattgtataagtttttggatttccattttgaaaagatcaataaaaatacatgtaataagcatggagtgtattgctgtatgttcatgaactctgtatgctattatgaaggaacttcatttatccgctcagaatagaagctgcatttcctggatctctaaacattcttattttggtcaatctttttttttttttaatttaatttttaattgtccttaaaagctaagtttgggatgggatgggagaaaaggttaagagctcttgatatataatcatgaaaagtagagtttggattctaccaaccacataacgcagcagcacacatctgaagacctcatctttgagagtgacagagataggatagggcaatttctggggcttggttgctgcaagcctagtgaagaaaaggcagttcttggttgagggacagactctgactcaaggaataagtggaaatgatagaagatacctggtgctctcttctgtccctccacactgtacatggggtcatcacacccacatgtgcgtacacccacacagatacatagaaatgcacataatgaatcctttaaaatattaagtatattttgtactacctgaatctgtaaggagttcacatttatcctgtctataaccttaggttagtgtactttgacaatgttacaaagccagttgacattaagcatgctgatttccctcaactaaataaccatttctcagactctttttttttagtaataataacttctaattatttgtttctaataattctttctgtctcctcgctagccagctattcacttacaacttttaaagacctcatctactttcatcagaagaaatttatctaccataaaatcatgaaaataccagtgaagcccaaccccaaggataaaggatgctactatacaagaagaagcattttagttttggagttctgccatctattcctggtgtccatgataaacctttttttggtggtctttactatgttgtttgctactgctttcatttcttggggcatgcaaagttagattatcaaatgcggtagaactggatagaaataagtgtaaatacacttttgaatgaagagtgctttcatgctgaatcaagtagatgagctatcagtgaactgattgtgatggttagcccacacaggggtattttcttcttaccttccagttcttgaacttacttggctaagtgacagttggattacttaggaatgtagaaatagatagtattttgcaggagttaaaacaccaaagtcatggtctttaaggcaaacgtttttggtaagcttgtgctacattctcttggaatcaatactatatgatctacacataaaaaaaaaggcaggaacataggggtgcattaactgggacaaagaagagttcaccagaagttggaggggataaggagaagaggtgtgaaaatgaccaaatgtattatacacatttatgaaatggtcaaaaaatatattaaagactgcaagatggtaaaatctacaagtattccattagccaaatcttatttaccctttatcttttcttgtatgagaaatttattttgggacacatactcaaatagaaataagaaggttgaaaaggtaggtttttgaaaaaattaaggaatttgttgtggagagtcgtgtcaatgaagtggttacctattgcttttaatagtactcctcaagatgagggattcaattagtgtgtgattagatttttaagcacagaagtaatgaatacatattttcctgagatgtaattctctgaaagtgaagttttcctcacaccacacacacacacacacacacacacacacacacacacacacacacacacacacacaaaggtgaagtaactgttactattttaaaacttgaaaactccacctcattgatcttttaagataaagatgttaattttgatatctaagagtcagttgctttgaaaatgagacttgtactatatgtggcattttacatttgcttaagacagggtttctctacatagcttttgctgttctggaactctctatgcagaccaggctgtcctctaattcacatagatctacttgcctctgtttcccaagtgctgatattaaaggcatgtaccacgattcacagcatatgtgacatgtggaaagtatggtcttgaaagtgtctttctcagtttctattccaatacaccaagaattacatttaagtcatctcatgaagttgatcataacacatgagacgctgtaaatcataatggttggtatgtgattagtgctccaaagtagggctctgaccaaggtcaaggtccataatttttgtttgaatttcgtcaaaataaaacgtctaacaaatgttggaagacagtcattaattattggaagcattctttttcttgcttaaggccctattccgatgctgaattattctgtaagattttaacagcacgttgacaaaagttgtgacgaatgtgaactcacttcttttgtttttcctttaatttctgaaaagtgtgtgtttaaactcaaatattcttggtattgatctggatggataggttcttgcttttgttacgttatcttttgatttctcctagagaaggctatttactctgtctgtcctgatatttaaatcaataggtttgtttttttttttttttttacaaaatgtaaaaatacataggatattaacatacataggatacataggatattaaccctgaacttctaggttgttttagacttttcaagttactaattgatgctagtgttcactaaattacaactttaaaagtatcaacagttaatagaggatagctctgatgaatccctcctataaaatattcttgtaacacgaatatgcagaattgttttctttacagaggaaataaagtgaccagtttgaagctgtactattgggttattttaagagtatgagatcgtgttgcactgtataaaaatatacatgctttaattagtctaggaaaacaaattttaaaagtgtcatttcaggaacagaagccagagtcttttattttgaaagcctggcttgtttccagtacataaagaactgtttgggagagttatcatttacatttcttgaattctttggtttgtggttgaacattagcctgttccggatttctaagtctcttatattatggttatacatttcttttgctttaattaaaaaaaatagatgtaaaggcccagtgttttatttttggtttttattctaattaatgccatctctctgatattttagtttttttttaattggatctcaggtacacagaactggattaatcataagacttgcttcataactttcatcgttgctacaatgtgtgtccctcagtgatttatttatcaagttatttaattatttttgtcttccttcaagggagaatatctaccagcttaaagaccttgctttccaactggctgatatttatttcctttgaaattctagaaaatcacttctccatttcaactcaaacttgctgctaaagcttccaaatctgaaaaggaaatggatccagaatatgaagagaaaatggtaaatatgcccttggtaaggtggtaaacagcatgtttctcttcgtttgtttgtttgtttgtgaaatagttctaatttctgtgattattgatgtaccctaccatacacagctttttgataacttttacagaaatatcagagatgaaaagacttgtctgtttatgatgcataattcgatctcagagtacaaatgcaatttacttattaaattgtcgcaaccattttctctgtgcatgtgtgtgtctgtgcatgcctatatgtgtgagtgcatgtgtgcgtgtgtgtatgtgtgtgtatgtgtgtgtgtaggccagaaatgcctgtcaggtatatttctcagtcactgctcaccttagtttttgatcttggatccctctgacttatcttgaggaagggtttggataaggtccttttttttttttttctgagacagggtttctctgtgtagccctggctgtcctggacctcactctgtagaccaggctggcctcgaactcagaaatccgcctgcctctgcctcccgagtgctgggattacaggcgtgcgccaccactgcccggctggataaggtccttcttaattacacttcaccttaactaattttttttttcactgacttaactaagagtttacagatttgataaggctagatggccactgaagtctagagatccatgcatttcctttgttgatgctgggaatacaggtgtatgccactatacctagctttttatgtgggtgttagggatttgaactcagggtgttatacctttgtgacaagcactttactcatggaaccttctccccagccaaccattacattttattgaataaaataatctcattttcaaaggagaaaattaaagatatcagaaactatgtggaatagttgggatgagaactcatgtctcactttttcttgatgttctttatccaatactaaggtgctgtaaggcaaagacattttgtgtactcagtggtgaagggatcggtggatggcagtatcagtgtggcattgtaccctgagggaaatgcagtcacaataccagatcagcacttttcctttttaaattatatataagcaaatgctattcattaccgaaatatatagtatggtaatacaacattagaggcatattcagacttattaacccaatgcattacatactatgtattacatagttaactagtgtaatcttagttgagccccatatattgcttttgtgacttgtttaattttcagacaccaaggaccaaatagctagttgaaactgattccccacccccagaaggactacttttgcagttttgaaactaaatagagaggaaatatgtgttttagttgctgatagctatttttacaggagtctgtgccttaatgtttaagaccacatctaaggagacagttaatgttttaacaattctaagaacaacattccagagaggataacatgaattggggaagctttggcctccttccagcgtgtgatctgcatgtacttttctaagtcttgtatctatgctaatgaagtctgtaagtttctggtgttattaatttttcaccggtaatcaagtattctttgctgaatagtcagagagtgactattaagtaaaaggaaaaaaatatctttatttcttcctttgtttaggatgaagtaaactcttgatcttttaacgttttgttgtgaaccagtttatttttatttttctatttttcttatatagaaaatagttattttactatattctgattatgtttttccttcctctaatacctcagattctccctacctcgcctcccatctaaatccacaccttttttccttttattagaaaacaaataggcatctaagaataaaaataaaataaaacaacctatttattttgatggtgtagattatatgtaatgcttaggtacttattgaaattatgactacacatcagcattaagtgttggaaatacttaatatatatatatatgaactacttcacatatatgtgtgaatatatttttctctaagttctgtttcttcgtgtagaaatcttacatactaatagcataaaatataaattttcagattgatgtaattcaaagaagtgttattacattattgtaccatgacattgaaaatatttttgagagcagctggtagtctttgcctagatttcagttatttctaaatgcagcttggtaatttgcaaactttgtagtatgtatggattataacatatgtattttattcattcatttataattatttttgagataaggtctctctttgtagtcctagctgtactgtaacttgctctgtgaaccaggttggctttgaactcgtagagatttttctgcctctgcagagcaatgctaggattaaagttgtgtaccaccatgcctggttccaatatatatgtgtttctatctttagaacatacataattgatgcaattttttagttagagaaaaagaaagatcatgttttagaaagagaattaattttctaattttgactttcggatctttctgtcatattgggcactgagaattgaactgtcggccttggaaatactgcgctatacttccaatcccaagggtatacttcttttgggagcatttactaaatctgtcaggtcatttttcttctgttcaaactacttgacatagcattttaaaatttgattacttacaatctggggaagcttggaaatgttcctgtatctccaatttatcatctgtaaaatgggtatgaccagagcgatcacctcatggatttcaaagggaattcagtagattaatatgttaaaagtgccaaggatgttgcataatgaagcagaatataaatgtttaataactaactttgaatgaacataaaaagcaactctttccctttccctctcctttgtaaattagaaagcagaccgcgcaaagagatttgagtttttactgaagcagacggaactttttgcacatttcattcagccttcagcacagaagtctccaacatctcctctcaacatgaaactggctcgtcctcgagtaaagaaagatgacaagcagagcttgatttccgttggagagtatgcagtcttctttccactttcttccctttccctttttctctcccccttcgccattccatttgctcagtataactttctatgaataacatggttattgacaatgtaaatatgttttggagataatgatctttgttattgatttttccttaccagaacttaattagttaaaaaaccaaccgaccaaacaaacaaacaaaaaaacccaaccaaccaaccaaacaaacaaaaaaaccatgtagactgcttctaccacattctatgccagacactagatatcacattcctttttaaataaagacttggtgtctcagccttggctgtgactgtgaaatctcttgggtttgtcttttcacctagctatcgccacaggcgtacagaacaagaagaggatgaggagcttctctcagagagtaggaaaacatcgaatgtgtgtgtcagattcgaggtctccccttcctgtgagtacttcatcacactcatggtttgcctttgcagttcagtgggagaaaaccaaatttcctttagtatactaataaaagtctgagaggttcttcgttttttttttttgttttgttttgttttcagatgtgaaaggaggaccgctgagagattatcagatccgaggactaaactggttgatttctttgtatgaaaatggagtcaatggtattttagctgatgaaatggtaaggcactggtattcaaaggatgtcctgagttactacaagtttttcatgtaaatttgaactacatgtgttgaattttcctcaagcccgatgcccaaaaagctttatttagtggcaaaataatgtactttctaaggtttatatattttactttatgtgtggcactcatataggcttgcctgcctatatgagtgccatgtgtttgcagtgcccggggaggagagaagagtgcataggatcccctggatctggatttatgggtggttgtgagtcaccgcatgagtgccactaattgaacccaggtcctccgtgagagtaacaagtgctcttaacctctgaactatgtctccagcctgcaaaagaatgtttgtcgcctacaactgttcaaataacctgtagaatataaccttttgcatggctcaaagatcgtatggagatttcctgaagtggtacaatacctcactttgctctcgtttttgtttgaactttggcttccaagaagcccagagaaaagtacaatggcaaaagggagcatctcttcatcctctaagtctgcccttgatggctctcctctcctctcctctcctctcctctcctctcttttcttttcttctcttctcttctttttcttttctcttttcttatgctttatcttctagtctaattttccctgataagttttcatttctgttttaccattaatttttgtcccatgtttttataacgggcaaactggcatcttcttgggaatgaagtgggttatataaaccaaacaataagtaaataaatgaacaaattcatacataaatgaatgtagacccagttgttctgtaacttgccattattatatgtccacagactactgggtttcaatcctcttgccttagccttctgagtgttcagattataggcatagacacaatgttcagcttcagcgttgagcttccataacaatagagtgccaagtctcagtcttttgataagctaatgaatcatgggcttgtaaaataactgaagaaaaactaaggtcatataagatgctaattgagtacatgaggggattgtataaggcccagagttgtatattaagataaaattcctaaaatttgacttaagagaggatagagggacttatatatctatttaatccaataatataatatctatgagacttgggaggcatattttcaattactattatccagaaggccaagccatgaaatacatattatgacatctagtatagtctattccatagacactcatctatggctgagcagctgtttggtatatggctgagcatttttttttgaaagctaggatttgtagccccttatactctcattattttgttgagggcaattttctgctcatagtaggagggccttggtttatctgtcaagagaaggacaaggattatttaccccaagaacttcttgtctaagacaaatgatctaaagatccttcaagaatctgctgatgccgtataagttttagttctatcttatcttttagtatctttccccctttcctttccttttcctttccagaactggagcttaaaactaaggccttgtgtgtgctaggcgagtgcttgattaccaggctacacaccagtcccttttatatgttttgtcttgagataaggtcccagtatgttgctcaagttttaaacttgtcattctcttgcttcagcctccccttaagctgagattgcatatgtatgccatcatgtttaacttgttttaagtactaaaagagaggaaggcattttagagaatatatgtaatttagaaaaaaaaagaaattaagtaatagtaattaatagcaattctgccattgagaaataactacagttgacattttgctatgtttctttgacatttttctcttttttaatctttaaaaaattttatttaatctttttttacagtccagattttatcccccttccttgtccaccctctgactgttccacataccacacctcctctctgagtctccactcccttaccagacctccccactccttggggtctccagtctcttgagggttaggtgcatcttctccgactgagtcctctgctatatatgtgttgggggcctcatatcagctggtgtatgctgcttggttggtgttccagtatctgagagatctcgggggtccagattgaggctgctggtcctcctacaggattgcccttctcctcagcttcttccaggctttcctaatttaaccacaggggtcagctgcttatgtccattggttgggtgcaaataactgcatctgactctttcagctgcttgttgggtcttttggagggcagtcatgataagtccctttttgtgagccttccttagcctcagtaatagtgtcaggccttgggacctccccttgagctggatcccactttgggcctgtcagtggacgtccttttcctcaggctcttctccatttttgtccctgcagttctttcagacaggaacaactggttttgttttttgttttgttttgtttttagatgtataattgagatcatgtggtatgtgtaatttggcattgtgaccttttcacattcatatgtatttttcatatctctaacattttgtcaaagtaagcttttaccatcgcctagtcctcaggaggccccactgattccttccacttctctcctgacattgcccatttggattgctagcagtgcagtataatagtgctactatgacaattttattgctagtttctctgtgcttctcacgttgcaatcataaaattcctggaagtagaatcagtttcttaagcattttaaggttttggtggatcttgtccacaacaatccaccctaagtgacttatcagataagatgtagcccataaaagtggcacttagcctagattcatggagtgaagttttgtgctctgcttagagattaagcaaaagctgcttaattatttagtgtttacttttactctggaggctgggatcaaacccagggcttcatactaaacatgtgctccccactgagccacaccctaactcttattttaaagtgctgactcttatttttaaaggctgaacagcatactgcatagttcccgttcccgctggctaggtgccaggctcatgggtgtttgatatactactttaaaaaaagcacactgagctagtggtctctaaggtctcttcacactgctgtgctctgtgactttctgattcctaaggtctttaagagtgtggggtatcaatagacagctatgagcctcttgaaaggcatagtgtgaatatttaatgcctgggctggaaccatgatcagaacaataggaaagaaaggtcactatctcaaaaggctctagaaagacgtctatttttgtgaaacatgcacccccaaattcctaggtttgtatctactagaaaagattacagatcattttgcttgttcctcaacagaatcagcattccctaaatggaaaagtgatttattaagcaatatcttggctgcaggtttttggttcttttcttctcctctcacaacaaataatgaattgaaatggttttgtgtttttcttctttttaaaaagtccctcttccttttcattgctggaaacctaatcactaatgtgagataattggcaagaacttttttgtaatgttgtttctaaaaaagtgtttcattaaaaaagcgtatttacatgtttttccccccttgtgatgataaatacagggtcttgggaagactttacaaaccattgccttgcttggttacctgaagcactacagaaacattcctggaccccacatggttttagttcccaagtctactttacataactggatgaatgaatttaaacgatgggttccatctctccgtgttatttgtttcgttggagacaaagatgtgagagtaagtgagaaactacttttaaaaagacggtcaagaatattatttctagactgcagttgcataacgatcctgttaaacacatttacatcagctatgactactaccactaaatgacccttcagatggactgactcctagctaggctctgttgtactgtccatatactaactcatttacttaccacatttatgaattctgtttactttttttgtttgtttgggttttttttttttttttttcgagacagggtttctgtgtagccctggctgtcctggaactcactttgtagaccaggctggcctcgaactcagaaattcgcctgcctctgcctcccaattgctgggattaaaggcatgtactaccacacccggcgtgtttactttttagtatgtactgttagtcactttatcatttgtgtacttaggagacagaaatgtggaaatcggaatgacttaagttttgctatttaaagttttggcttcacacacttgtccatacatagaaatcttcacacacttgtccatacatagaaatcttcacacacttgtccatacatagaaatcttcacacacttgtccatacatagaaatcttctgtgactgcaaagagcctcaccattttgtatatgcaaggcttgtaacatgcctgtatatattcgcagataatactagaaacttggattttggccatggaggaagaggtatttatattaactatttgtccagttagtaggctataattattttaggattgtagagtcaatcaaaaagtaataaattatgcaaaaatcacaaaaataatttgcttagaaagagtattattgaaaattgtctttattttgcccccagagaacagagtttaaaataaaagtttgtattattttacatatttagatagatgaattatcaagagatactctcagtggaatagtcccataatgaattatgtaattttatcattatccttttgcttgaagaaaaattacttaaatttatttaaatttaacttataaataatttaagtattgaaatactgagttcataaatttagaatcataaggttgattcctcctgaaggctactatttttccatagcaaattggtcacttaaaattctgttctggtcattgctactatttaatattcacttcttagagattgatgttgatgtatctaaaattcaagatgatcattggcaaacccatttgactttggtatcatttggggtagatatgtttatcctcccattttttctggcttttagtaaatattttaggaggctagtatttattaatgaaaaattcgatactataaaagacattttagttgtgacattagagatattcttgatcctgtctctataaaaagagattctcttgatcctagttggaataaagtcatcttgcaatttcttgcagtattgtttttctttatctatcacagagaaatccatatccagtggacacggaaacagatatggtttaatttcccatataattactgtttgtgtaatgaattagtttcaatgtgtacaattttaagagcctttgggtcatgtggtcttcaatattttatcaagatacttaaccctaaatcttgtcaatagtttcaaaattctaaaagagagttaaattaaatataaaacaagtctcaattccatgaagttctcaaggaagcatgatgctgaacctttcaatgagtgaaacaaggataaggtggtactaggggtcaatgagatctggtacccaatccttcccaccactgtaacagtcctctacaattttaattgccttttaaatgtgacaatttctcagcatataactaaggtggctacagaggtatttttctgtccactgtgtcagtctaggaaatcctttaatacataccggatacttataaatattgttgaatgaatcaacaatgcatttggtgcatgtttgtgaattataaagtagaggctttgtaacaacccattggttttgtttatttgccataactctgaaattataataccaagtagttcctttttatacaaatttttctgcttcctttaaaattttgtggttttactttggcccataatatctggaatgaaattcataccagctacagatgttttcagtcaagttggctaccatgttggctactgcctgtgaagattaaaaagtagttgtaaatattatgtctctttttaaaaatgagatttatttatttaatgtgagcatactgttgctgtcttcagataccccagaagagggcatttgatcccattacagatggttgtgagccaccatgtggttgctgggaattgaactcaggacctccggaagagcagtcagtgctctttaccactgggtgatctcaccagcatatctctgtttttaatagcttcctttactacacagagaagaagccacatccatagccttataataacattaagaacctcacaaaaatattaaggagcttctgggactccttaccaaaatacataattattatctgttggcaaatgaaggaaaatataagatgtctccaaaggcaggaaatgtcactatgtgttaaatattatatgcttgttaaatgagactatgatagtgcttggatctttgtgacactaagatcctatgtcatcccatgttcttttgggcctctcatgacatgaagtgttcttctagttcatgtaaggtgagattttgttttgttgataagtatattctcaacacagctagaccattggccacaaagttatctttgagccttttcctgagattttcctatctctcaaatggatgagacagagtggtctatgatgttccatatagctcttaatatttttccgacagtttcttttcagtaattcccttgtcaacataatctaatatacacaatttattttgcattaggcagcttttattcgtgatgaaatgatgccaggagagtgggatgtttgcgtgacttcttatgagatggtaattaaagaaaaatctgtgtttaaaaagtttcactggcgatacttagtcatcgatgaagctcacagaataaaaaatgaaaaatctaaggtaagttctcagtcccattatcttgcttgcttgttcacttttctgtgtttaaaataaaaattaagtagcagagattgggcttttattcacagaatgcgaatgataattagttttgaaagtgcccataaaggctaaattattcaatacagaaccaataaaagttaagtactagctttaatgcaaattagatattatttgcagtttgtcctgttggcagcctaactctgtcatgctacattattttaacatcactgagaatatttgatgtacaaatatcatttgcattgacttatttttttatcaaggagctacttcccttatgtgtatgtattcctatggattagaaaagggagttttctgatttatgtgaattagagtctggtattaatattgaaaattataaattatttgttgccattcaacttcatcaacagtaggaaaaacttcacttgtaatgatgaacctctctttggatcactgggctacttttgggagaaacagggacagaactggagcaaaaccaccaggtggagcatactaatttcacattggaactaatacttgataaaaggacgcatgttaaagattcgcttcattaagaacattatgaaaataggattttttttgtaaaattactgattttatgtttttgtcattttttttggtggtcttaaaacttgaaatcttaatacataggatcaaggaaaatgagatcaattctggtgctaagtaattgtgaaaaggccagagttggagcttaactatgcatgtagatgaagatggctgttggggagaagatgctgttatagaaagtgatagcttggatctaatggaagaaatttgattttctgaaaccccaaaatggagaaactaaaaattttcacgatgggggagggatctcagatgtaaatatgatttgaattctttcaggtgtggacatgtctaggatagtagtgttcggttgtgctttgttgtggcaatgcctactgaaatcggttattctttccatagaaaattaattttaatgacgtatataactgaatttcaagagccagaacaatgcttatataaattttatttttattttagctttcagagattgttcgtgagttcaagtcaactaatcgcttacttctaactgggacacctttgcagaataacttgcatgagctctgggcattacttaattttttattgccggatgtctttaattctgcagatgtaagtttaaaacaaagtatttgtgtgagagggagtggtgctcagggttgaagccagggtgcttagctaatgctttactattgatctcccatcccagcctaaagccatccatcttaatatatattcctaatgttcagaatcatctatgctctccctccttccacctttccccctctcctttattgttattattattatttatacatatgtgaatgtgtggagatcagaggaaaactcgatctagtcaattctcttgtagcatctttatgtgggttttggggaatcgaactcatgttattatgctgaccctgagagccatcttgctggcctgagacatctgttttcaaagtatagaaaataggttaaattttacacattttccatttgtgattctttcatttgcttattttagttttctcaagcatattttgggaaattgtatgtttctcctcttgtgataattctgtctgttattttgtatatagcacattgttaccacactgataagagagactcagttcatagtggtgtatccaaccttttcattaaatttgagagactaattatttttcttcattaccagcacagttttgtgagattagaaaaatcacatggaatgatttaggggttttaaggcttgatttttatatcctattcttcttaactagctataacattatgtgatatacattatgtgatataggaaaacctaatattttctaaggtgatggtgttactttacattgccattaaaattttgtcaatggttgcagtattttcacatattataaaagtaaaacattatgactatcacaataaagtgttttaaaagtacatttaaagtggattatttgtatactagttgtatatgaatgtatagaatatcgagtttattttaaaaatcttgtgcacttactgtagaatttttacccctccataggactttgattcttggtttgacactaaaaattgccttggtgatcaaaagcttgtggaaagactccatgcagtaagtaatagtggtcataagcatcaataatcaatttaatggaatataattgagcaagaaaacaaacatacatagaatttgaaattttgggcttcctccttgtctcagactcattgtttctcccaagtagccttagtaataactctatgttgaacaaagctattatatccttgacctctccagaggtctcaataattctgtggtccttccttgtgaaggctcttcactctcatatcctacaaattctttagatagtatcagtgttctccttgttgctaagtaacctttcggagctactgctcttccacggtatgtttaagcctctgttttagaaccaagagacctcttttggttccatctcccacccactgtcttctgtatcatctggtaatgaacaggtaatgccctcacatttactggtcaacatttttcttttttttttttttttttttttttttttttttttttattttatttttttttatttttttttattttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctagatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgagacctgatttgtgacctattatgtggtcaattttggagaaggtaccatgaggtgctgagaagaaggtatatccttttgttttagggtaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagtctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctcccctgccgggtgggcacctgtcctccggtccggaaggtggccggctgtccccggcccacacagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctctggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccgctgctgctgtggcttaggccgcctccccagccgggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctacggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctctggtccagaaggtggccggctgtccccggcccacacagggtgctgcctcagcgcctctgtgcttccgcctgttccagaagctgtcaggttctctggcgcaccctctcacctgttcagactaatttcctaagttcggcgggtcccggaccaagatggcgaccgctgctaacatttttcatcctttgataaatatttacatctatatatactcctatttcttttgtaacatggaagagacctccaatacctagagccctgcttcaatctgaaacaatattttccatacttagatcacactttgctcctactgttgaaactttttgcacccgtgttcttctgttacacctgccctgacaactccaaattggaaaaatgtaatggtatttccttgtatgagtatagagatcttctttgtactgagactgctcaatactaagacaattctacaactctccacatgggaaccactatggtttcatgttctctaggataagctggaatttcatagtattgactccttcaacatgatcttctatagtcttctttcttttttattctaacagctgatttaggtattgctcaagacttctatgtcaggcatttcttgctccccaccatgctcagtatatagcactactctcttctgaatgaccaaacagaactcactaggtataaattccttcatgtggtcctgtcttccaaagcattgtacattttggttagtcagttgcctgagtgaaagcattattttttctttgctcaatggcgaattcttccacacaaactctgaatttcatcatttctggtttccttagggactttattccatggtttagtcctacaactaacaacaatttttactcatccttctctattgtctcatttccctcaatacataagcatgctcaagtagcttctctggggtccttgagaagtatctgagttataagttggactctgacattagcttgtttattttattttatttttttttttggcatatttaagcatagcacaattttggaaaaacagatcttctgttaacgatttactcaaccctgtgaatacaacaatgcttaagacatgtttacattgaagctctttataaagtccatgtggcttcatgtctaagacgggttctctggacttagaaactatgcttaagatgagggtctgtgggaaatgactgaggtaaacataatcccgtgggaatcaggatttggccttccccgaagctaaaacagaagtcacataggcttttacaaactacaaatgctatctctcacaaggatgcattttatggcctagaagtaatgctcaatgttttagggggaaaggggctgagatagtaaaacataaactctgcaagatatgggagcagatcctggcttatcagacagcaaaggattaacgggttgtaaactatgtccattcccagcattcctcgaggatggtatgctaaacatccctttcctttgaaggatgcctgtgaatttaactttcctgggttctccagtgcttaactgtatgcacaagcactttctcccctattgatcgactgatcgattgatccatccatccatccacccatccatccacccatccatccatccatccatccatccatccatccatccatccatccattcatccatccttctacctatctatcattgcttcttcaactttggatccttaactgtgattttctcttcatgacagctaaccttcttgaaagtagtttttctctacattttcactatctaacctcctatttactcataaacccactaatggctgatggttctccatttcatatgagtgaaacctacgcacatagttttcaatgactttccagttgctaaaatcagagtatactagcagtaatatatgtgttaatcattattagaaactatttcttggtttcactggagagccactcttatggtttcccctacatttgcctatgtatttctaacttaagttcacgtctcataagcatcttataaatctatatagtacctctcctttttctacaattttgctttctatcattccagttactcatgattaattatagcccccaaatatagaaaatcaaagaactaaaaacaatgattaatctctatgcattaaataccatcaatttccataccagtcattatccttagtataaaatacttcctgctgttgaaagaaaatacattcatataatttataattatgttgtattataacatgtttgttctattttattattatcattgactatatttctgtgctgggtttataaattaaatttatcataggtatatactatgagacatcatattatatgtaggattgtaaatattttgctattttgagcatcttatagagatcttggactctgttttcaatgactaatcgttaactttctactgccttcagagcatttttgcctttatgtctttttttttctttttcagattgggtttctatgtatagccctggctgtcctggaactcactttgtagaccaggctggcctcaaactcagaaatccgcctacctctgtctcctgagtgctgggattaaaggcgtgcaccaccactgcccagttgcctctaagtcttaaagacagcttgcttaataaacttttcgataagtttaagatgctcacgccagaaaccaacagtcttattatctcttacagatctctaataataatggctacagttaattgtatatctatcatgaataacctctgtatgaactactacaaatttctctagcagccttgaaaataggtattattttcaatgcaaaatatgttaaatatgctgaatgaaatatttttagaagaatgaagaagcaaattaaaaaaattaaagtctgagtctttaaatctccttctacttattagtatagtggccagtgaatttactgaagttgaaataatcatgtttagctaggtgtggtggcacatacctttaatctaatcactcatggatctgtgagtttgaggctagcctggtctacaaagtgaagttcatgacagctagggctacatagagaaacactgtttcaaaaaatacccaaaccaaaaccaaaccaaccaaccacccaaccaactactactcaaaagcacaacaaaaaaagaaatactcatattcagagctggatagacaattcagcagtttaagagggttgttgctcctgtatagagaagattcaggcttgattcctggcacctatatagtagctcacagcattcataactctagttccaggggatataacactctattcaggccttcaggggtaccaggtacacatgtagcacaaacatacacacaggaaaaactgtaataaacaaacaaacaaacaaacaaacaaactctgaactagtaagtaaaataagtcagaaaaaatgaaaaaagtaataattacatttattttgatgatttattctgaggactaactcctacctataatgctaatggagcagtatgtggcatactgctggtgggtactcaatgaggaacacaaaatctctctttcaggtacatagtaataaccattcattgtttctctattcattgtttttttttcccatttttcccccatttttattaggtatttagctcatttacatttccaatgctataccaaaagtcccccatacccacccacccccactcccctgcccacccactccccctttttggccctggcgttcccctgtactggggcatataaagtttgcaagtccaatgggcctctctttccagtgatggctgactaggccatcttttgatatatatgcagctagagtcaagagctcctgggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtccttttaataaaatcttgctagtgtatgcaatggtgtcagcatttggatgctgattatggggtggatccctggatatggcagtctctacatggtccatcctttcatctcagctccaaactttgtctctgtaactccttccatgggtgttttgttcccaattctaaggaggggcatagtgtccactcttcagtcttcattcttcttgagtttcatatgtttagcaaattgtatcttatatcttgggtatcctaggtttggggctaatatccacttatgagtgagtacatattgtgtgagtttctttgtgaatgtgttacctcactcaggatgatgccctccaggtccatccatttggctaggaatttcataaattcattctttttaatagctgagtagtattccattgtgtctaaacaatgtctaaactttttttgggtttttttttttttttttttttttttttggtttttcgagacagggtttctctgtagccctggctgtcctggaactcactctgtagaccaggctggcctcgaactcagaaatccgcctgcctctgcctcccaagtgctgggattaaaggcatgcgccaccacgcccggctaaactaattttttttaaattgaatttttctcctcattcatttattgtattattttaaatgactgaattttaaatttattttgagagaatttaaactgaatctctcatgtcatattttccccatgttataaaaccttgtattaagagtagtacgtaaaacaagacttcttccacgattagtcagtagccaatagccttgtcttatattttagcatattttgtcctgtaagtcatgagtgtttactttcctccctcacttctagaggacccgggaattgaacctggagtcccgtgaatgatgaacagtcactctctcttgtgaacatcaccacggcctccattctcactctttaaggggtcatgatttggtggttatttactgagagattaggaagctcttgcttctggttactcttggtgtttgttagattatacatcaggatgaaagttttaactgttaaaaactgtaatattagtaaaacataccatctggaatcctacgtgctttatatgcttttataagaaacattgcttttttaggttttaaaaccatttttgttacgccggataaaaaccgatgtagagaagagtctgcctcctaagaaggaaataaagatttacttgggcctgagtaaaatgcaacgagaatggtgagcaattttacatctggcaacgtttattcatatataggagtttattcatatataaaaatcacgtttgttgattgttcagctatgataatttacttaagtggcaagttatgttgttcaagtattctattagaaaatcaatgtgttccatttagaagggaaaaattagattgctattagctcaaatgtgaatatagctcaaataagtaaaagttggctgtaaacttttggcaagtattgtagttagtaggtaattctcagatgtaggttctggaaaaatcgttagctgatgacagtttctagtaatggcaatagtatagggacacaggtccataagcaacatggaagtaagtaacatacaaaacaaaatgttcaaatctttaattccttgtttttttcagatcatattttctttcaaatcaaaaagattttttctttttgtgattgaacccagggtacttgtgaatattaagcatgcaatctactactgactgatacttctagcactcaactcaaatctgcctttatctactttatttgtacttactaggaatccagccatgttgctagtggaacctttctttatggcatttcgttcttaaaagtgattaattatagtttaacattttaggtatacaaaaattctgatgaaagatattgatgtcttaaactcttctggcaagatggacaagatgcgactcttgaatattctgatgcagctccgaaagtgttgtaatcatccttatctgtttgatggagcagagcctggtccaccttatacgacagatgagcacattgtcggcaatagtggtaaaatggtcgctctggataagctattggcgagaattaaagaacagggtgagtgaggaatttttttcttagttagcatggaataaactcataatgatttgtatgtgaataaaatgtcttagattcattcaaccactaggttagaagacattgttgagtacttacttactctttgccaggaattctcctctagtctaggaatgcaaagattacaatgatggctttgctttggagaagctcacagtgtagtgaggaagaagagttgcagttcgatgtgctaagtgcacttcatcatgctgttgagaaaatgggaattgggatcgtctttacagtgatgatattggaagtgaagactggagtttgaaagcaggagtgagccatcaaaaatgcaacaggtgtgcttgtctagggcagtgaaacagggaccacagcgcaggcatttatgggatgtaatgtagtgtggcatttcgtgaatttggtaaggatagatactgccatattatgcaccattatgcaccaaattatggaaggtctttaaaaccatacttcaaagacttttattttggatatagaggagttaaagaagacttgatgataggaagtaacattattagatgtcaggaggataacgctggaagcactctgtgggaatgagagagtaaaaccagaagccaaggtgaagatagttgcagtaataatccagagagagatcatatggaccattgtagatccttgggacaaagaaaaggcagaatataagtcatggtagtatatgtataagatttaaaaaaaacattatttatttgtttatatcccaaacgctgctcctcttccaggtccctccctcaccaagtcccctcccctgatccctccttcccttctctgagcattaggttcccccctgggtatcctctcaccctggtacatcacgtctctgccagattaggtgcatcctttcccactgaagctagacagggcagccatgaagactgagctacctgtctgctacctatgtgccagggggcctcatttccagccagtgtatgttctaccaacagagttcagattctgagagctcccgggagttcaggtttgttgtcttagttggtcttcctgtggagtttccctctacttcaggggcttcaatccttcccccaactcttccataggtgtccacaacctctgtctaatgtttggctgagggtctctatatctgtttcagtcagacgctgggtagagcccctcagaggacagttatgctagggttctgtctgcaagcataacagagtatcactaaaaatgtcagggattgcccatgggatgggttttgagttgggctgtatattagttggccccaggggcccagcctgactacaggaaatggcctctacaggtttcacatccgtaatgttagtcttcttggcaatgactcctgggaaactcccccatccctggtctctgggccttcctagcgattctccattttccctcaccccagtcagctgtagatttccattaattctcctgggcctctccccataactaatcttgaccccccatttcccaacctctccactctcccacccagttcccttcctccctttcctcccatgaccattttgtttctctgaagtgtgatttaagtatcctcacttgggtcttccttcttgtttagcttctttgggtctgtgggagtgtactgtgggaatcctgcactttatggttaatgtccacttataagtgtatacattccatgcatttctttttgggtctgggttatatcactcaggataacattttctagttccatctatttgcctgcaagattcatgatgtctgcaagattttttttaagacctaaagaaaaccttttagtttaacaaatgataattttgcgtaacattctttgtttgtgttggcatgtttatatgccatattatttagattgtttatgatgctttattttctttttggctttcaaggtacctgaaatcatttgcctatcttaactgcacacagataatgtatttcattatataattttcatactttacacatgttgtgtaactattttctggtgaactattttaggatcaagagttctcatctttagccagatgactcgactgttagacattttggaggattattgtatgtggcgtggttatgagtattctcgactggatggacaaaccccacatgaagaaagagaggtgaggacaggacaagaaagtgaagcaagacgtcaaaaattagcactcagttgcacaatgtttctttactgttgttttcaattttggtctgctctactgctcagtgatactgacttcctcactgccaccatgatctttcttctatcatcactcttccatacttagtttccattccactgatttttccccccaaatcatcctagactcttcagagatatgcttttctaagaatattatctctattggccactaccccagttgattactgtctctcaaactgacaccccgacttctgattatatgtttcttttctttctgaatttgtgtaccatggtagaccctggccatttgtggagtttagtagtggtcatttggatgatttatgattaaccaactctagtattgaaggaacagtcttgactgtggagggcttttgtaaaaatgaagtatgacaaaataagtgtagatacttatgagtttgggattttaggtggtaaaatgttggtttgtaagtatgaataagtacacctacctagcacccagtgtgttcttcatattttgaaattcttgtaagtctttagggtatctatcacaaaagtcatgattgaaaggcactttaaacccattaaatcactttgtggatggctttgctatttctttctctcttttctatgatcctttagctctctttctctctctctctctctctctctctctctctctctctctctctctctctctctctctctctctctctctcctcacattataggcaaatgaagaagattttacagtatagtggaagtacccagaacttggtttgaagacctgatttttagcactaacaccaccactttctagtggccatttaattctataaacctcagtatctttgatagtatcacaaagataaaattggtactaatacttcttcctgatgacagtgtgagggttggtggctataataggtacaaacagtttatatccatgcagtgcactgagttctgtgtgacaggacattgcacacaggtctttctgtttgtttcaggacacgttctcaggccacaggaatctcagcttatgttcctctacttccacagttccttccattgacaagactttctgtctcttatgaacacccttattgaagcctggctatcgcattcttcagctttgccaacagcacacagacttttatgttaaggcttttctgctacctattaaaggaaacagttatggtaacttttgtacataaccgaatgcttaaaaacttcaattatttcccaccttatagctagaagttctctgagacagttctttcttgaaatttttgttgacttagtactgagaacccatttcttcataaagcataacacttattactgttcaagatgaatgcccttttttgctattatgaaaaggataccaaggcaatatttagtaggtattatctggcctcaaaatgcctgttgtcactcctgacctatttccctattcattacctagctatatggaaattcttgtgtttttaattttttttaatttttaaatttttctgttgtttcttttattaattaattatttattttatttcatttatttatatcccaaatgttgccccaccccccctcacagagttcttgaatcctcctctttgtgcatgtgtgtttttcttttttaatcttcaagtattattcttcgttcaaagattttgaattacaggcatcacatttgagtacagagatgtcagacccattctttcctctgggagatgtcttgtttatattgctattcatataatcatttcatgtcttttttacatttgattctttgctctgtgtataagcagtggagatttttcctctcctctatagttcagacatttaacctttccctatgggaaactaactcagctagttctgcctctgaccatcattggacttaattggtttcacttttatagggaaaggacttaacagttagcaagaagctaatataggctaggcacccagtggttctcaatgattctcccaataatctgagtcaaggtactgataaacttgtgccacattaaattgtgtctcagaggagtcaaaggcttgtgtttcagatgtggatatatggctgagttgtacttcacttccaggtttttgcaattttctttacaccagggtgcctgtcatcaaacctttttgtgttctgtactccacggtatcatgttctactgactatagtaatgctaggcaccaagtctcactagaacttagaccatctttttctattgcattaaaaaataactgagcattttgtgactatatatttaatatacgagtactgagagatttacaaaatcaattatctctggaaaatctttatgagaaataatatgtaacaagttggtaccaaactttatatatgtgctatatataaagttcagaatattagtacttttagtcaggattatattgctttttatcactatagttttaggaaaatatttagccttaatgatgtactgtacataatatgtcccgttattgctgatgatttaggttgcttccaatttttcactgttataaataatagtacagtgaaagtcattatacatatatcttgtgcacatctctgatatttttccttaggataagttcctggaagtggaattattgggtcaaagggtatgaacagtattaaggctctcagtgcatgttgtcaagttgctttctagcaaggttgtttcaatgtacactctcagaagcaatgtccctctgctccctcatcagctttgagcattaatattttgatttagctttaacatgtcattatattgtctgtttgcatctgtttgataactagtgagaatttaacattattcttgtagcagtttttgtatatttgtatttattctgtgagtagaaattcttctcctttcaggttcattgttttattggagacagcattttcctaattaatttctacatgaactttgtatagaggatattgacaatgtattaattttaaagattcattactaaatattcctggacatgtcattccgattttctcaattatttttcctttgtcattacactgatacagattatcttactctcatttgtatttctcaacttttctgtcttgtttatcagtcctcagaatgatattgacattctgatatgtttcccaaatatacatttcagcttttaattaattggaatagttttactattattttcaaaggatgcaaacgaatgatttgcttaattaaatttatttgtatgattgttttatgtttgtctctattggttaacccttgcaaatttcatgtataaagacatattttctccagcaacttacacagtaagtatagataaacagtgtggaagatggaagaatattataaactgttaggttatgaagaattttatatacaagtataaaagtattttctgtgagcatgctaacttttctctttcttaaaatttggaatttaattcaatttttctctttttatatttctttattaattaaaaaaaggaagcgatagatgccttcaatgctccaaatagcagcaaattcatctttatgctgagtactagggctggaggactcggaattaacttggcaagtgctgatgtggtcatcctatatgattcagactggaatccacaggttgatttacaagctatggttagtaacatttaatgctatcaggaaatcattgaaccacagaatgttattgtttacatagaacaaagataatgcgttattacagtataacagttttggagtgatttttgtaaaggttagatagagttaaagttgctgaattaattgtgaaaacaaataaaaaaataaacgctaacagatatgcttcaaataaaagtgtaaaacttacctatctatatctaatctatacctatatctatatgtatatctaatttgtatataacctatatctatatcagctatatctatatctaatttatatctaatctatatgtatgtcaactttttcctatcttgagtattgaggaggctttctgagtttattttaatgagaaggataaacaatctcattattttgcttaacaagtgcctattaaaatctttaggtcaggcatgatggcttttagtcctagcactcagaaacagaggcagggggctctctgtgagtttgaggtctactaatgagttccaagtcagctggggctgtatggctggatcctgtttaaaaaacaaacaaacaaacaaacaaacaaactttagtactgaaattcgaaaacgttagattttaacgtctgtaataaaataattgcgatgaataggtaaaaatggaagaagagaaagtttgctgtctgtgtgtgaatgtgcatgttgcgtacatttgtgtgggcgtgtattcctgagagagcacatgtggaagcccgagattgacatgaggatgtgttccccaactgcgtctctctcttatgcttgagacagattcttttcctgaagctggagtttgccactttggcttgacaggttggtgagtgcccccagccctgccccaactcccagcctcagtgctggagttgtaaatgaagggcaccatgcctagctttgatgtgggtgttagagacctcaacttaggtcctaatacttgaacagtaagcactttacccacagaaccatcgagttgtgtgtgtatgtgtgtgtgtgtgtgtgtgtgtgtgtgtgtgtgtgtatttaaaagaatgttttattttaccttttatcacaatctggtcactcagagattactggttggagtttaaagttttacatatttgtacagtattgaatcctctctgaaagattattgccacttggttattggattggattgttttcccatttactatagggactgttttcaagcctgtttctttgattctccccacctcctctctgttctcatttgctctgtcagtttttgcattttaaacacactctccacatgcttatattttgccagaagttgccacctttgctaattgtaaaccattggagcaattctagaatcttaaaattatgaagatctcattaatatttatgagcttttactatgtatctcagaattgccttggtaagcagaaagaactgcttgatggtgagataaagcagactttggtagcatagcagcccttgctaacttctttgttcctttagaaactccttgctcatctggagatgtttgcatttagtgaattaacgttgcccagtaactcagtgcagaagccttagctgctgtttgtcctcatctcaaagaggctttgccttatgacattctggaagtttcccagtagcagcacagcacgcttcaagatttctttgttcccagaaatctttggaaatccttaacatttatcatcctcctttcagaagtgataggtttagagagattgaagtctgaattttattttcagatatttatagcattgtagttatatgtctaattcttgtctacagtctctagcatattacagttggactttttctgttaggatcgggcacatcgcattggtcagaagaagccagtacgagtcttccgtctcattacagacaacacagtggaagagaggattgtagaaagagctgagataaaactgagacttgattcaattgttatacagcaaggtatttctatgtagaagcttctttaatttgaagaggtgcaaaaaacatttagtttccttcaaaagatactgcttttcaagaaaggttgactgaaagttacaaacagtgaaaataaacttttttccttttatttttagctcatattattataattcagtcatttctttcccttcttccctccaaacccatatatatatatgtatatatatatgtatatatatatacatggatatgtgtatatatgcacacacatatatttctcctatctctttcaaattaatggcctcttttaactgattattattacatgcatatatatgcatattcctaaatataatatgctcagtctatataatgttacatgtctgtaaataatctttgaaaagatgtttgcaattttttgtaatttaggcctatgccctcagtacatgaaataaattcactgtgttatacttgaatgtcaatgacatgacttttgtagtatcgtatactattatttagcagaaaaatatttgcttctgaaaaatttaaacaaatatacatacatcagagcatcttttccatacagaaaatttatctgaaaaatgaaactggaacacaaaaaagtattaacaaaatagtgaataggaaatgcagtagaagaaaaacttctagttacttattaagcagataatattaagcttaccagttttctcataaagcttctttaagtatgatttagtccaatgtgcctgatcagaaccgttatactgtactttctttgaaatataatttaacatattccattttgatcgtttttaggaagactcattgaccaacaatctaacaagctggcaaaagaggaaatgctacaaatgatccgtcatggagctacacatgtttttgcctgtaaagaaagtgagctgacagatgaggacattgtaactattctggaaagaggagaaaagaaggtcagttgaaaatagcactgtatttccataatgtaggttatttacaacaaaacaaaacaccccccaaaaaccacacagctttgtttcacctggaacttccttggcatttttaatgacatcagatatttaatatccagtaatgactcaaacttttaagtgtttcgtagctagttagttgtacttaaagaaatatttccccctttacaaaagtgcaggtaaagcacgtacagtgcaatgggtaatatgttgcccataagctcaccctctctttgtgtattttcctccaatctacttggtaaacaaccagggttgtttgccttttgccttaatcattgtataggttttgtggattggacatcaatggctcttttaaacatgttcaggattgtcttggttcttttgctctttctataacaaaatacctgaggctgactactttgtagggaaagaaggtgtttgaaagtgcaagagcctggtgctagctttggcttccagtggggcctcgtggaggatagcattgtttggtgggagtgagtgcacaagagagaggaagtaagagaactttggaagacgatttcctggctttataacaacccattgtcatagtaattaacccagtcacacaagagctagagagcaggcctctgagatctaactcacttttgagggaaaacccttaatatctcttaaagacataatcaacatttctttgatgttccaccaattcaataccattatggtggggaccaaacttgcagtttataacctttggaaaacaaaaataaaattatcaaaaatgtagtaaatgtatatcttgcaaaggttcaatttgattctcaaaatgcttttgttttaaaggtcatagaacaatcttgtgttactacattttatatcaatatgcaaaaatattttagtttaactttacctttatgatagtactagtgatttctctcattaaaattatacaatggaaattataatatgacaacatttttagtgataaatgtcctataaagaaaccctgagtgaaaatatttgggaatgaaacatttgatttttttcaaacacttgagagaagttaaaattttaggtgtgtgtgtgtgtgtgtgtgtgtgtgtgtatgactggagatagcatgtagggccttgcatgttgtactctaccatcatgattttaccatcatgtcaagaaaaaatatattcttgccccctcttctctctcagcactgcattatttttatcttattattttattttattttattttattttattttattttattttacgtgtatggatattttcctgcatgtatgcacatgatgtgcatgcctggtgtccctggaggacagaagaggatttcaaataaacttggattggagttatgagttagctgccatgtaggtgctgggaattgaacttgagcctctacaagaacaacaagtgcttaaactgctgggatatgtctccagctctagtatttcattcttctcgtgtaacttagcagaacagatatttcatgacaaacctggattccagataaatagaaagttcacattttgtaagttgattcattgataattttctcatttcaatacattcaacgttagactgcagagatgaatgaacgcatgcagaaaatgggagagtcatctctaagaaattttagaatggaccttgaacaaagtttgtacaagtttgaaggagaagattacagagaaaaacaaaaggtaacaatactttcagccattagtctgtcaagttttcgtttttccttgtaaaatttattaaaataacatagacatttatgtagtgctttaatataatttgatttaatatgatagtcatatttgcttttgtcattgccagtggaatagtcttgtcccaagttttggatcaaaagcatttcatgttttggagggtttttgttgttgttttctttgtttggtttggtttgtttctttggtcttgtttttggcatatttgcagagacattactggtctgacaatttgaagcctgaagtattccacaaatttcctcaaaacttggaatttgggtgcattttggaggtcagatggttttgtttagatggggatcctcaagctgcaccactacctttgttagtgaaagggagtacaggagatctcatctctatcactaggtaatacctttgggtactcagctttttcatgtaccaaaggtagattctagtagttatacagagtgactttcatagggaatgggttaatatttgtaaagtaattagcaatatgcctacaagtgagtgtcttagttacttttcctgttgctgtgattaaaaaaaaaacttacatggggctggagagatggttcaatggttaagaacatgcactgctctttcaaagaacctgagttcaattcacagcatccatgccaggtgacctataatctcttagctccagaaaatctgttgcctctctctctctctctctctctctctctctctctctctctctctctctctcacacacacacacacacacccctaatttgaatacaaaaatgtctgttaaagaacttgaagaaggggtggttgtttattggtgtacagtgaaaggttcaaaaattacatcatggcaggggtatcaaggcagaaggagcttaaagcagttgatcacattgcatccattatcaggaagaaaacaataaatgcctttgtcagctctcaaaaaatactacagagtttaatgttaatatatgtgttactttaattattgaaatgttaacaaattaccatcagatttccccttaatgtttttttgctgttccagtgtcttcattttaggattccacattgcatcattcaacaaacaaacaaatacgactttagcactgtgtagtggtattctactttaatctcagcatgaggcagaggcagaggcagaggcagaggcagaggcagaggcagaggcagaggcagaggcagaggcagaggcagaggcagaggcagaggcagaggcagaggcagaggcagaggcagaggcagaggagcagaggggcagaggcaatttctgtgaggctagccaggactacagagtaagttctaagacagccaaggctacataatagagagaccctgtctcaaaaaactaaaaccaaaccaaaccaaaccaaaatggaaccaaaaacaaactagactttattttaagctcccaacaaaatcaaatgggaagaacatataccccttgtctctgacatacaccacccactctacaatcaacatcctatgctaaagtggtacatgcgttacaatcatgaacatacattaacacattgccaccacttcatttacaacggggttctctctttcagggtggtgtattctatggcttttaacaaatgcataggcatctactacttaatatcatcaagtattttcactgcattaaaaatactttgagctttactcgtctctgcctgtttttctcttgggtcatgacaagtgctcatctattttatttattgtttccttagtttcgcattcttcagaatgtcataccattaaatgaagcctttttaggttgactttcttcatttagcaatacatgtttcagtttcctttgtctttcttcatgggtcaatagcccgatttctttttagcaccaagagagattccacattctgaatgcgttgctgtttatttattcatccacctactaaggaacatttttgttgtttccaagtttaggtggttatgaataaatctactgtacacatctgtatgtaggatgtcttaaaaatacaagagtttgattcctttgggaatatcagagaatatgcttgttgagtcctatgacaaaagtaggtttagatttataaatctaattaaatctaatttttccaaagtggctatgggatttcacattttcccagtaccaaaagaaaactcagtacacctctttgccagcattttggtgctgtcaaaatattgggtttcacctttataataggtatataggggtttttcctaattttttcctcaattttaatttttgagattgtaatataattacatcattcgcccttccccttttatctctcagtaagctgtatcctattctctttaaaatcaatttcttaaatatataaatacaacctgctcagtctgtatgatgttacttgtatgtatgctttcagggcggactatttggtactgtataactaacccatttgctcttgcctgaggaagactatttctcctgctgtcagcagtcctttgttacctgtagttctttgtgtagggtttaggacatatgagcttccctcctgcttacactagcatgcctattggtgttgttcttcttcagcttgtatttaggcatttatgtgagtgaaacttcattagcgtagttttttagacatttctaggagacaccacctcacagcaaactttctcttcttcttgctgttagaaatttttatctttctgccttagttggggtttcccttgctatgaagagacaccatgaccaaggcaattcttataaaggacaattggtgctagcttacaggtgcagaggtttagttcattatcatcaaggcaggaagcatggcagcatccaggtaggcatggcactggaggagaagcttagagttctataacatgatcctaaggcttctacatcataattgcaagacttgcttcttcaggaggccaggagcaggctctctcttcagcagtgggtggagcttgagcactaggatccctcaaagccctcctatacagtgacacacttcctccaactgggccacacctattcaaacaaggccattatctcctaatagtgccacttctcatgggccaagaatattcaaaccaccacactcctcttctgaaatgatcctggagcctcaggtgtagtagttgtgttatagatgtatcagttgggactgggacctacaactgtgcagtttgattggttatagttttctatgatgatctctgttgtaaagagaaatctccccaatatagggtgatagctacattgtatctgcgaatataaggattaatactcagaatccagttagaacttatgttggtttagtaaagtggtggttgtaggttctctgcaaataataatggcctcactagccctgggtagttggctaggtttctagtctaaccaggcatgatttccctcctcttgcatgtgttttaagtccaattaaaaagctgttggttgcttccaacaccctcagggctattgtgccatgctggtcatcattgtggtttataagtatcatcactatgtaggactgttggttgtcttcctcttttggaaatttgcatggcaccttcttgtcttcctcttttggaaatttgcatggcaccatgatagctagtcctcaaggaggctagtcttcaaggaggagacatctggataaggaactgtgtctgaaatgcatggtatcgtcagcaatagggacgttcctttcacttctaggggcaacgaaggttaatagcaataccctgaagtattttgggagtgtcttgggcccctctgaccaacaactcaaaagaggaatcctcatgcctgatattggggcttttattggataagtctgtgcctctttaggagaacattgccagctgagatgggaagatttcacttaagctgtctatgtctatttatacacaggtgtagtatgtcttataggtatttttagatagttactgtatgatttccttgtgacttttccagacatccttactgttactgtggatgggaaggcatctgatgagtttctttcctacaaatttagtatttgtacgtttgtgattggtaactatcttgttaaggatgttttcaagcttgtgtgcaatgatcttagcatctgttgggagaattactgtcttggtgtttgcctgagggaaatttccttattccatctctatttcctacttgggaatttctgtaagaagaagctaccccttctctgtcaattatttctgtccttgtttacttatatcactatagattcatgtctgtgtatttctgatgtacaatagtttttattgttgttgtagctaaaaattggtctataaaacacagttttgaacagatagaaataatgttttattaaagaagaactcctttttagatcttgattttactgaaaagtgagagctaagcccttttacgtggcataacactcactatactgacaaagctttcttactgtggtctgcctctgataggttttgttttttgacttatatttgtctgttttatttgcaattttaactcagactgctttgtgctttatcctgcttagatggaggtgatggcctttctgcacagggtggaaattgcctgcctaatatgttttttagatctaattatatgatatgacttttatttattcttcaattattcctatgggttagtagtactaagactgttttataaagtagaaaaaaatatctgtagaacctaaatatcactggaacaacttctttttttttttcagtcctgggacccctttatgctcagcacatcctatactactgaactgcatccatagcttcattcacagttttagaataagattagtgttagtaaaataattgtgcatgtgtaatataataggcatttccatgctttgatgtctaacaaacgtcataatttacagataagatatataatttatttatttttattttatgtatattggtgttctgctgacatgtatgtctgtgtgagggtgtcagatcctatggaactggagtctcagacaattgtgagctgccatgtggttgctgggaattgaacccgagtcccttggaagaacagccagtgttcttaacagctgtgccacctctccagtcccagataagatatattttaatgattttgatgacttttataattgaatatctaacattaacagtagtagccaaaaataaggatttttgaatattctcatttgaggttacatattatttctgtacattcatgttttctagataggatcataaattaagttgaccttgtttctaaagagaattaagaatctgaaggtattgtttataaatcttagaaattatatgttaaggtagacttccatttatgatttgttgaatcagttacattattttactagcatgcctagtaagttaaatcatggtagctgacattaatccccctataaatcgacttgaatatgttagtattaatatactttctttcatctaaaacaagccaattcagtataatttattctgttttgaaggttcaagaagtggcctttaacatttatttcaaaattcaacatccagactttcaaacaaacactgattagacggccaaatatattactttttaaaaagttagtttcaagtataaagttttacttttgaaaggttaaatcgtatgctatttataaaacctttttttacaagcatgtatatgtgtgtatgtatgtacacattaatgttggtgtacatgtatgttcacacatgtgtggagaccagaggttggtatctgatgccttatatatggaggtagtgtttctctcttgaaaccatagttcactgatcaggtttgctagattgccagcttcctccggggaatcctctgttgccatctcctgagctatttataaaatctttttgtccccattactgtcacctaatacgtgaacttatttggtacaaaagcataattcatcccctcctttaccttagtccttccctccctctcttccactgttctttccttcctttgtttggtgttgaaccctgggcttcttacatgctagccacgttctctactactgacatacatctctagccctagatgtggatattatttgatttagtcaccacattataagttcttataatcttttagagacattaaaggccatttactctaacctttcttgtaattaagaaatctcactttatagggtgagcaagatggctcagtgaaagcctgacaacctgagttcagtccttggaatccgtatggtggagagaaccgactcctaaaagttgttctctgatcttcgcaggtgcgacatggcatgaacatgcatgcacacatacacacacgtgcacccacaaataagtaaacagatatgattaaaaacaaaaatctcatttacagcttctccaattgatgacagcttgtgtttcaatactgaagtgctgggattcctccctctctcagggtagttcctttcactgtttgtcatcttgtctttgtgtattctaggcaaacagtctaccattgagctacacccctagctgtgttaaattatattgcacaatggtgttgtttcttgtaactttgcacattgctttgaatcttagaaatcaataataataataatgatgatgataataataataataataataataataataataataataataatccctaatctttgttattgcccagactttgacttatccaccctaactttgggattatcttcttgggaccatgtgaaagcatgtagatccctaaccaccctcattatccatagtttattatccacagttttcttaactggttttggggattgaaccaagggccttgtgcatgataagcaattgttctaccactgagtcataggcagccttgccatccactttttgcctatggtgccatattgaagccaaccttaaggtaagagataggacaattcatgatacatgagtggccttttaaaggtctcatggttcattatatttaaagtcactaggctacaaactatgaaattgagaaaaacaggaatgagaaaaattttccttggactccagaactgtgtgttgtcagttttgtttgttgactattaaaatgcactttctagctgacaatggggtatgtttttataatgctgcaagccaatggtaatattaattttcatgtgtaataataccttctatttaactgttgaagttactgtgtttggtgttgtggctccaacccaaggccttgtacaagttaatcatatactgtactactgagctagattcccagatcctttgtggttatatttaatcctccaggtaagtcttaagtattctcatttcatgaaaagcaaacagaatcctcaacggaatatgaccagcgaaatgctaggattccgattcagatctgaatctttctgattccagtgactttcctccactgcactacagcttacctttcttgaaagttccctttgagctttttttcttgctttgaagaggtgactgacatgctgcttctcgtcattttctagtctgacctactgtgtgtttagagttaccagaatcaatattacttttcttttttatgagagttactccttatttacttaaattggcattagatgctaaatgggttgtacagatcattctcaattaaggagggaaggatttaaaaattatcttcaaaaatgcaaaacaacaataacaaaaatgtcttcgctcttaaacttgatcttcaacagtgttgtggaactttgcaggtagaagtaggatttatgaagcaggttttaattgcttctagttactgccttattgcatgtggtgctgaggaaatagtctgcagtaattaaaccccttgttcttgcttgttgtgtgtagctgggtacagtggaatggattgaacctcctaaacgagaacgcaaagccaactatgcagtggatgcctactttagagaggctttacgtgtcagcgagccaaagatcccaaaggtaaaactgtctaaggccacttcttatgtgctgttgtagaattttctgataacatggtttgtgattcagattttcttattacttcctaaaatataacaacatagcaaaaacttaatgggaagcagctatatgaatggattctattgtatttaattttccaaatgtaaaaaaaatcaccagcatgacttatattagctgtacttcatgagaacaaattcctatgtatgtaatagtatgtaatatatttttctctctcaggctcctcggcctccaaaacagccaaatgttcaagattttcaattttttccaccgcgcttatttgagctcctggaaaaggaaattctttattatcggaagactataggttacaaggtaatttttcaaattcatgtgttataatactttaaaattattttgtttgttatgagtgttttgcttgcatgtttttctgtgcaccatacatgtgcatggtgtccatacaggccagaagagggtattaggttccctagaacaaaagttacaggtcgcagtgagccactgtgtgggtgctggggaatgaaactggaaaagcatcaacgtaccctcaactgctgaatcatttcttctagtctcaataatctttagcatactggtgttgtagaattctcttataacatggttgttattctgattttcttatattattgctaaatcataggtcctaaaatataacaacacagcaagcactggttaaaatagacaatggactctattctatttactattaaacaatataagagcacagaacattttgaactagaagtaatgattcaactttcaaatcactcaaaagggacagcaatgaaagtaattggtctcccagtatttcaacagtaacatctgtaatgttattttaatagatttagtatttggattgtcaaagaatatgtagaaagaacttgcatgtgattggaaatgaattttgatatatgattaatttttaaatgatttctttaatagaactaagaaagagtatttttatgtttattgctcataagttaataaaagctctgttggtaattagtggtcacttagatgccaaagataacaaatcatatgagaatgattcatataattttaaaataaaatgatctttagaatttaaaattcctttttgcatatacagaggcaaattttaatgaataaaatttaggggttgtaatagtatatctatatccttgaaagattaagaaaacaaggttgtttctgtatgtgaaagttggcttcctagtcaatgagcacaggaaaaattttaaagtatcagcagaattgtaatcttttttttttccattttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagttccctttagctccttggctactttctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttaacaaattatatcttatatcttgggtatcctaggtttggggctaatatccacttatcagtgaatacatattgtgtgagtttctttgtgaatgtgttacctcactcaggatgatgccctccaggtccatccatttggctaggaacttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatccatgccagcatctgctgtcacctgaatttttgatcttagccattctgactggtgtgaggtggaatctcagggttgttttgatttgcatttccctgatgattaaggatgttgaacattttttcaagtgcttctctgccatttggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttatgtgaagttccttgatccacttagatttgaccttagtacaaggagatacgtatggatcgattcgcattcttctacacgataacaaccagttgtgccagcaccaattgttgaaaatgctgtctttcttccactggatggttttagctcccttgtcgaagatcaagtaaccataggtgtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttccttaatttctttcttcagagatttgaagtttttatcatacagatctttcacttccttagttagagtcacgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggcagaattgtaatcttaagaaaatttctgttttatgaattggaacttatgttttaacatttattttgttccaccttagagttggaactatgataaattattttgattagtagcttgaatgtacctagaaaaactctatatattttgaaaattaattttatttccgaactagagtgggcctctagaatatttacagtatttttgtatactgggagtattgtatttgaatcagagcaaaacagtcttcctcactctgtatgtgtgaaggtttaaaaaaaacatatacataccctagttctagtggtatttctttatgtaattctggcacttgggaagttgagacaggaagattgcaagtttgagtgcagtttagactgcatagtgattgtcttagggttttactgctgtgagcagagaccatgaccaaggcaactcttataaggacatttaattgggactggctaacaaggtcagaggatcagtccattatcatcatggcaggaacgcggcagtgtccaggcagtggtttaggacgaactgagagttctacatctttatctgaaagctgttaggggaagactgacttccaggaaactaggagaagagtctcaaagcctatgctcacagtgacacacttcctccaacaagaccacaccccactccaacaagaccacaactcataatagtgccactccctgggccaagtgtattcaaactaacacagtgacttcaaggacaatgagatcttgtttcagaaaactgatgaacttaaagagaatatacatgagttagttatgatattgttagagaaatgtggttaaattgaaaggaatcattttaggactgtagcagagtaaagcaaccatgtttgattgctcaaggtatacatacgaccactttcaaagtgtggacactttaccctttcttagaaatgggaacaaaacacccatggaaggagttacagagacaaaatttggagctgtgacgaaaggatggaccatctagtgattgccatatgcagggatccatcccataatcagcttccaagtgctgacaccattgcatacactagcaagattttgctgaaaggacccagatatagctctctcttgtgagactatgccggggcctagcaaacacagaagtggatgatcacagtcagctattggatgggtcacacggcccccaatggaggagctagagaaagtacccaagtagctaaagggaactgcaaccctataggtggaacaacattatgaactaaccagtacccgggagctcttgtctttagctgcatatgtatcaaaagatggcctattcagccatcactggaaagagaggcccattgggcttgcaaactttatatgccccagtacaggggaatgccagggccaaaaagggggagtgggtgggtaggggattgggggggtgggtatgggggaccttcaggatagcattgaaaatgtaaacgaggaaaatacctaattaaaaaaaattaaaaaagaaagtaagtgtaatatagagacaaaatgcaaaatgcaaactcttagttattaaatagttaatttcccagtataaacaggaatatagaaattcacctttgtttgtagttatccttgacataaacattattttcagtttcttttatcagctgttatcagtaagacttgaaaggagaattaattggaatactagatcttgactaccaaatgaaatatttgtgcagaacattgtctaatttacccagcgctttaacatatatttcacttgatcctaacagcctcattatatgggtttgattgtctgcttgtaattggtgaggaaactgaagttcagcaaggttcagttttgtacaaggtcacagagctaatgaggttgccctgctgtctcaaaccctcttactacactttaaatactgtgttctttctatccagacattctcagctacttctgcatgtgctataacgccattcttttctgtagtcctaaataaggattgtgtttattagtggtaatgacatgttatttgggaggtgggccaagtggcagtcaagtagcagcaataaaacaaaacaaaacaaaacaaaacaaaacaaaacaaaacaaaacacttcatcacagaatgatggaactattcatgcaccttctttggagatagtgtgattttgttccctgtgagaattccaatgccacagattcagttagaatgtaaacagtgcctttagtacacacagtttgtggttaggagtgaggtctcagaatgattatttgggtggtggccagctggaagaacacggaggagggaagaaaccttataagacagggcaatgaacagacagctgcaagggctaagagaaaggaagagggaaggggtagaagacgagaggaaaaccttgagtgcggaggtgcaagatgctatgtagttcagattcttgcactctgctgtttcatttccctcagctcacagaaagtggtagagaacagcaaagggtgaaagggggcctggctccgtttaatacaggttcactgagcactggtttgtgttaggtgctggaataggcacttgggagaaattgataaacaaacttgactgctggataactgccatgatgggacacagacacattcctggaaacgacctgttcttgttgacaatcccctttgctgtgtagtattgctgcttgaagggagttgacatctgcctgtgtgaggcagcatatttacaaactgacggaggagggccagactccatcaactcagtctgctctttagtatctgttgtgttgggtaatgtaatcatgggaattcataagtctaaaggactcccagccttcctgaagatcattactatttaactaaggaagtagttgctgtttgtaggcatcttcaggggaaattaaaggataaacatactaaattccatctgattctgaaagaaaaaattaccgattaacacaatactatcaagatcatccattagaaatatagtcacagcctctaccctggtggcataagcacacatatgtacttaagcaataaagtcctgacagtagtagtaacagtagtactactagtaataatgataataaagaaatgacagattctgagaatttagaatataatgccagagacagacataaacagacattacaatgaggtggtgttatcacttcatagtggtgcttatgaagggtgactgtcaggcagtttggtagatatacaaagtggtgcagaagatggagacaatgctctctagggaagaagagtcacttaagccaagatttataagatgatgggattgagtctgttaagtgtaggagagcagacatcaggtcaccatattctttgtgctaagcagagctctgaggtggggaagaggaggcagttttccagaggtagagtgagatcagaggtggagatatgtataggtcacaacaaggctgaaatttaacttcagagtaaaggaaactactcagattcctttaaagcagagacgtgggtggcaaaatgatactgatctaagctttcctagtgttttctaaaattccaagttctgtataaatattagcctggcatcctcattataagaactacatctttattttacaaatgaggatctgaggcatagttaactttttctcagagttataggatgtataggtggtaaaggctgatcagatttacattttcacaattatttaaactgtgtgtgtgcatgtgtgcatgttcctgtgcatgctatgcacaggaagtcagagcatgacatcattcgagagttgattctcccttcttaccatatgggaatccaggaactgaactcatgttgtcagacttttatggcaagagcccttacatgctaagccatctcattgacacttgacttatattttcaaattatcatcctggatgtaacatgaggaacagtacatttattaggaaaaccacccaggagactgttgaaatatgaaaacgagagacaggggtgaaaccttgggctgcagttgtgacaggcacggtattggcaatgacaggagagccattgctctgctgttctcttcctagctttgtgctctctttggttccaccttggactcccacggtgcatctaaagattcgatgggagtctcatttaggaatacctaggggaggatttagaagataaataccacattccagttgcttaaaactttctgaactttgtctctcccattctttcctaagaactatgggtctgagctcaggtgggttatctaattagaagggtctcatgattaagttcagagtacagacagatcagcatggcttgttaatcatctacagagtttcaaagataacattctatgtatcttaagaaattcttaggattgggctggagagatggctctgccagtaaagatcgtttgttgctaagcccaaggacccgagtttaagctctggaactcatatggtgggaggagggaagtgactctctcaagttgttctctggcccccacacacatgctgtaccatgtgctcacctgcacataaacacacacaacataaatgtaaacaaaaaagtcgaagataaatatttacttaatattgtctgataccttatgcatctagaaaactcattgaagttacaaaatacatgaagcaataatttatttttatgtgagcaaagctgctgtagtggagttacttgatgttttctatgtacatgttctcaaaaacttgagctctgtccccttttgatgtttgtagtagtaatcattcagggctgtccaatcttttgttatctcagcatgactctgtcatctctaatgttcaccctcaagacccatacaacataattataaaaaataaacaaagaatcttgtgttttaagtaagtttatggttttgtattggactgcattcatagcttcccttggtacgtaacgtcaggttaaaatatggggtaagaggaaatcggaatggtccatagttgggtacattgtaactaatgctgatttgcctgttttgaaacttcaaagtgttaccctacagtgattgaagaaagggctagtaagaggctcaatcgcttgcttatgtttttgttctgagacagggtctcactatgcagtgctggctggcctggaactctctatgtaaatcacagtaaactcaaactcccagaattctgcctgcctctgcctccagtcctgggattaaaggcatatacctgctgtgggctcactagttctgaagttgttgatacatgttctcgagagcctgcttattagctattaaatttttttgttttctctccttatacatttggtacaccgaggccacatcagtactgtgcctagtaagattttcagttaaaaggtttcattgggggctgggaggagtggttatttgctttagtgtaatcactttgtggctggcggggtcaattctcccccacccaagctttgaccttgttgtaagcgggacatcttcagaggctttcttactctctacaattaaaggagttgataattaatatacttatgtgttcactaaagtcttatcattggaagagggtgacaactgaaattttaacttgtagtcgatctaagagcttgaatgaaaagtgttttaccacatttaaagctgcacaaagcttcaagagattcctgtatctatctccaaaaagatttctttagggacagatataaacatttgacaaatggatgaggttccgtgcactttgtgagctttggtaatgtgtcattgtgggctgcctgttaagctatggagagctgatttcaggcgactgctctcattttctgtgctgccacgtttaatttagcaatccatatttctataaaatcttgctggactcctaagcaataagctttttttttactctcttgtggaatctagctcctttttattcatttatttatttgaggagatagagtccacaccactgtgtggccctggaggtcaaaggacaacttgtgggagtcaggtttgtccttccaccaccatctgggttacagggattgcctttatctgctgagctattcggaatgacactgccctttcttcagcctctacatttcatgtttggttaatgctttttctatttcttttgtcaccgtacttcatttccaagttataatgtctcagcagttctctgcctctggcctgggagccggaacagaacccagataccaaaatctcagcacaaaagaggtttattttacctcagagtattcaacttgggtggttgaatcctctgaggtaaaataactctggatctggcaaagacagcagcgggtgtctctgctggaatgtttttttttttttaatttttttcattttttattaggtgttatctttatttacatttcaaatgttatcccctttcctagtttcccctccaaaaatccccctatccctttccccctccccttgctcaccaacccacccaactcccattcctggtcctggcattctcctatactgaggcatagaaccttcacctctcctcccattgatgcccgactaggccatcctctgctacatatacagctagagccacaagttccaccatgtgttttctttgattggaatggtttttaaggagaaaaggaggaaagtctgagctaggacgagttcataagtcctgattggacatgttagtcagtgtagccaaataatgcatttcgataactggacctttgtgtcttgatagctggaccttggtgaccagcctcaggaatgtgtcaggcacaaggaagtaagccagataaaggagtggaccttggtggctaggtttggaatgtggaagtgcctgaatgagggaatctaatagtttagtaagggagagagaagggagggggcagggcgagatctgcctgtactatctttgcaatgtgctgggccggttagagagcccttcaggtagcttctctactttgctccatctactggaaggactatagtggaaatatgtcatcttggtactttactaccatgatcaaaagcccctcatggagtttgggaccctctgagtccatgtaccaaactctttgttcttgttgttgttcttttctcaatattagtcccaacactctttacagtgcttggaatagaactcaaagtttcacactcctcagcctaacccatgcctaatacaactcctgtgtaaccctgtgccttctgctttcatgcttttgcttatattgtgccagtctagaaaagcctttgcttcacatctccccagaactttagggttttagtcactgtcttgtcctttcatttctttttcttccatttattcttcctcttcttttctttcctcttcttttcctaccactgctccctctcttttactctcccctttcatctttcctctctcttcctccatcttactcatgagctgttctcctgcgtcagcctcccagctgctaagggaaatggctgtgtactaggacagtctatcctttctctttttatgagctagctcttgtcgtgtaacccagccattcttgaactcacaaggtagaccaagctggcctcaaacttacagtcttcctactttggttttctagtcctaagaccacagttgtgtgccagcacatctggtgaaactaggtcaaaatcacagaaggtttggaaatttcttgtgggcaagggttgtgtccagcaaatcaatccgtacttattttagtactaagcatataatatacagtcaatacatactgatttgattatctggtacttatggttacaaatgaatcggctttttaacatatccagtttttccttttaagtatctatttggtaagtttttaatccaaagaactactgggtatagcacttttaaagggcttacctttaagttataatgatacaattttaaatgctataaagtatgtataacaatgagaaaaaaatgtcctgtaatatatgccataattttattgtggtatgtctatttgacgtttctagggaatgagtcatttatattacgtgtgccttctaaacagtgaagacttactgccaagcttttcatttttcatgtttaatggaatgctataaaatgtactacacatgttctgtacctgctgtcttaaatcattgagctgtgtcatgtttccagatgttgcaataatgataggagacttcaagcctggaaaccagatttgtcctttcatgaaaggagtactgtccaaatgctgctgaactccagtggaccacgtgcaaactctgatgtaccgaggccttctgagctaccattattagttgcagaaatctcagcttttgtccccagtggttccggttcatgctttcttctcagttgtcaaagttctgtactttaaagagcactattattatctttattggtcactgccagtgcacaagttctctcccatgaatgatgggtccatcacagctgttggtgtgctctaccatacactccctctacacatacttcttaaatttgtcattgctttgtttccttctttatgttgccactctctctgaaatacctttcttatatcaaacactctgtctttacaacctctatcagggaataaaagcattctattgtttccatgacttaagacgaccagaacactggctgtcatctttaggtgtggtgcttctgcatataccctgctgtatactcctgggagtctttagacactaaataccaaaatgtgtgtttattctccacaatgccatatgatagggatgtattttgttacacagtataatgagatgtaaactacactgtgccattcatttatcaatgggctaccatcctcaaatattataccataataagaatggttttaattaggataaaaccatagtggtagaaatgcagagaagactgtgagccatctccttccgaggttctactgtctactgttgagacaactctccagattaatatgtgtatgtgtactttttctgattaatttttctcataggtttattcatttttcttttgatcttaggtcccaagaaatcctgagatccccaacccagctatagctcaaagagaagagcaaaaaaagattgatggagcggaacctcttacaccacaagagactgaagagaaggataaacttctcacacaagtaaactattttaagtagctgaactacttttagtcaactaatagaaaaaaaatctgctttttagtatatacagttttctggtctgatataaacacacattttgaccacatatctttactttttagaaaattctttgtaaaagatgctctcttggaaatattgggtgaatatatatatgtaaaacaaaactgtcagctattaaaaataagacatgcttttaccaattataataatgccagtgaatccagatttgaattttattaaataataatttccaacatatacctgaaaattaaatttcattgattgacttgatccctgaaactgtactatacaattttttctttgtttatgaaaaattccttttgaaggaagttaagagttctcaagaaagaacatgaatgcaataatgagaaattcctgaagcactttaatgtgatcattatgtaattaaaagctaatattaaatagggaaggtttccaccttaaagctttcaagtaattgttgctttaataaattttgtatcacatttctgaaatgagttctggtaggataaaacaaaatgtgaatttatgacactgccttagccagctaaatttatttcttgagctatttttggaacaatgtgcaagacacggtagtaggggtttctccactctatctgttagctgataatttgaaatgtttttcacacaaaggaaggattaatgcttgaggtggtatatatgcaaggtgtagaatgtgctttacaatatcacactatgtctcaggaatatgaattaattagaagtaaaataagaggttttttatattaatacagacctattgcttttaatatcatataattttattgaatgaattttgacaaaatactccaataagtttttgaacaaatgcctggaagtcgccaaaatttagctggtaatataattgcagttggcagagttctaagaacaaccacagaataaaatatttatatattaatgtttgcttttattttaatttcaaaacttatttcctgagcacaaaaataaagtgccttttgaatgctacactgcttataatatattctgaatatacagtataatgtgaatatgtaatctcaattgagataattgagtttataattagaagcataatcaagtttttttgtccctcagagttgaatttaagccatcttttcctgattctgcaactttaatgctcaatttttttaaaaaagagattcatgcttctcacgatggccttgagttcatcctgtagctgaggatggccttgaacttctgttcctcctgactccatagcatgcctgttggaattacaggcatgtgccaccatgtctgttttatgtgctgctctgaactgaactcagggcttcacccatgctaggcaaagtttctgccaactgacttagaataccattgatggaataatatttgaaaatgacctaaaacactggttgttccatactttagtaaaaacagttcagatgcctgagtatagtatttacagaggtcctatttatgaatatagtctttaaaaatcatgttatttattattattaaaagaggcatgtgcatggttagcatctacggaaaggtcataggacaacttttgagaatcagttctttccttccacactgggatctggggcttgcactcaggtttttgggctggtatgacaagcaccgtcaacttctgttccaacttgctggtccttatgaatgcaattttgaagagaaattatttatttattgtagttaggaatgctcgaacaaacatcttgcattcttcctggattttctttcagtgttctttcaattcaatacatccacatctatctctcttaatttacatgagaacagatctgtgggaaaagtcattgagacactgggatatcagaacttaagcatttacattagaatttatatcagaattgtagtttaatgtgggcatctggaaatatggaattaagaccatacaatatcttaagattataaatcaagttaaagtacttgaaaagtacattttctttaaagtaaaaaagcagttatttctctaacaactcaaactcatctttttgattccacattaaagaaatgaactttataaaagggcacatgttaagtattttaaactgcttttcatgcttcattgtgcagatataagtaggatagtaactgactttattaatttgccatctactgatgatgtttaaatttttattcatagggtttcacaaactggactaagcgagattttaaccagtttattaaagctaatgagaagtatgggagagatgacattgataatatagctcgagaggtggagggcaagtcccctgaggaggtcatggagtattcaggtttgtatgtcacttcaaataggatacttttatttaaatgtatgcatgtcttttgaaaaagagattcatttatttttctgtgtgcatttgtgtccatgtggatgtagcctatgtatgaacaggtgcctacagagaacagaagaaggcatcagatactctggagctggagttacaggttgtgagctgtcttgtgtgggtgccaggaaccacattttggtcctctagaagagcagcaagtgctcttaaccactgtgccatctctccaactcctgattctttgtcattaattcagttgcgtctttgttcagagatgttaaaacttttgtgaacgagatgtaagtaaagatgtaatatgattggctaggagtcaactaagattgccaagtaaagcataaacaaaagtggctactgcgtgggttttctattctctcatttctcttatttggtctttctaaagtctcatcccaaggcttctggtttagtgctttgaaatagtcattgtaggtcatctttgaaatatagagttcttatcaggcccatttagagactcaactgccctcaaggaattcaatcaggtagtggcgggccctattaacttaaggcaatttagaatagatctaaaaagatttttttggctaagtctgttcagtggcccttgaatcatttccctctcctgctcagctgtgtctttagcctcaatcagagtcagaatagcggcacagaagcctgtggagttaatattaattcctgtgtcagagcatatctaaactgtcaggcttctggaaagaaatcttattaaaataggttaatctatctgttttctgtgtgtagttaaatttcaaataggctgatctttcaaatttagtctgaatatcaggtatttataattgagagagctttccataaaaaggatgcaatgttaaaaagtagttgtatggtttctttgtcccctccttgccagatatttgagataactactgaaattctgtgtttattagcataaaaacccaaccaaacaaaacattaaaaaacctcataaataaatcaaagcttaattgttactagatatagtttttagtttatttagagtacataaagaaaatcagttgtaattagagaacacctacctactctattttccctcatggaaacctaaaagagaatttagaagttaattttgtctggactttattttatataacatcaaaatcatgaaactctttttttttcttgaagagtagcctgatactactacttatgtgaagggtgaaaactatgagatcttttgggaaacaatagatgggagagataaaattttcatgaaagttgaatgaaaagaatgtaaagagacgtggcattgatgtgggtcaagtgtaagttgtaactgtttctaaaagacatcagataactaggcatggagatgcagttctgtgatcacagtgtgtggagtctgaggttgatggcagcctagactgtatagcatgttagtggccaccctgggtatatcgagatcatgttttaaaaaataagggctaaggtgtcatggcaagggtcctaggttccactcactgctctgaaataaagaaaggaggaatgagagacagaaagctggagaggaaaagaaagatacactgagctggggttttagtgcagtggtagatgttcccttaagattgtcactaagccaagcaccaggaaatgagtgtgaaaggcaggtacagtgagattttctgaagaattttctttcttctatcctcaagttctatggagcaagcccagggcctttaagtccaagcaagtgttccttgctgtttctgttcacacttccagcctttctaaaggattttcttcagactggagagagatggcaggactatttaattgtggttcatcagattggaggtcatgtcagaggcgggggagaattgagtgggcttatttgattgactgataggagaattatacaaaattgtatgttcatgagtatattgtatcttaatgtaagaagttgcatacatgagtgtgtgcatgtgtgtgtctgtgtgtgtgtgtgtgagtgtgtgtgtatgtagatatatatgtgtgttgaatgagtagctgggagaatgcataagtgaacataagtgcttatgcaagccatcaagtgctaacatacctttcttgatatgctctaaaatggaagacttttgggatgtagaagatgatattagaaggcctttcacggaaatcaacagacgtgacatgaatgcagtagattgtttggtcatcagtaaaatttggttgggtgactcggggatttgaatatctttccgtgtgtgtccagttaaaatatctcttcttttaaaaaggtgactagaactataagattagtgaatgattgcagatttaaccaacagtttctgtagaattgtcacttcataggaaaaaggtagcaagtatattttcatttttgcttactagaaagctatatttacatttatatgcatatcttatttctgtttcactttatttttttgtttcttttgcaccatatttaggtaaaatggtaacttaagaacatttaattactgaatatgctatatacacacagatgacaccatagctgcctgttaattctgtattctgtaattcctcaaattcatttgcttaaatggtagtaatttaaagtaaccactttctttcagctgtattttgggaacgctgcaatgaattacaggacattgagaaaattatggctcaaattgaacgtggagaagcaagaattcagcgaaggatcagtattaagaaagcactggatgccaaagtagtatattctatttcagtttattagtagattattatatttgcagtagcgattagatttgacttgttattgcactctccattaaaagagcaatttttgttgaaacttacagattgcaagatacaaggctccatttcatcagttgcgtattcagtatggaaccagtaaaggaaagaactatactgaagaggaagacagattcttgatctgtatgttacacaaaatgggttttgacagagaaaatgtatatgaagaattaaggcagtgtgtacggaatgctccccagtttagatttgactggttcatcaagtcgagaactgccatggtatgtattccttttcttgcttatttatcttggaaaggtacacatttcatagtttctcttttactctgttcctccgattgataacatttcattctattagctttctctcccatctccttcaacatagagttagatatacatgtgcacaaagtaaaagagatatcagaacatctatcttcagaaaaacacctgcattttatattaataacaatttgtttatttgatatatttgtgtaagtgtatacatttatgaaccattttaaggtaagttgcagacaacaaaattgttcattgtagaatcttcaatgtagatactttagcatataggatgatttctaacatcaccctcaggcctccactgcacatgcacagacaatgggcccactcatatgctaaaacacacacacacacacacacacacacacatgcacgcacgtgtgcacacatacatgcatacacacgcttgcacaggcacacacacatatgccctccccttcccaactcatggaaaacaaaatgaggagggctggaaagatgactcattggttaagaataattgctgctcttccagaagacctgaattaagttcccagtagctcacaaccacctgtaatgccagctccagggcttccaatgatgtcttctgatctctacatgcattcacatacatgtgacacagagagaaagataaatatgtacaaacaattataaacctttaaagtgaataataaaataaaagaatatatatctcataagaagatctttctacataataattacaatcacatggaaatattagcattcactcaataatacaaaatcccataaacagacttttctggcagttcttcaaatgtctccttttgcagcatgtcaccaggaatactgcatcagattatcacactacctgtgatgttcaatttggtcacttggtttatgctataattcccaaggctcaccactttttatggtacattttccctttgtaactaattaggtgacatttgagagtgtagagatgacctgaggatttgttttcagtgaaaagagattgtaacccaagctgggtcttcctaagaacatcataagaaagaatagttaagtaaaagttagcttatttcttgcctctgcaatttcctctatagctttccaacatgaattctgctcattgtaaattctactgctcctgaacagcaatgtttgtgatgacactcaaatgcatgcagcttataaacaatccaaccaaccaaccaaccaaccaaccaaccaaccaaccagcaaacaaacaaacaaacagatttattgacaggttctcactttgtagctgaagctggcttagaacttgctatgtagcccaggctgacctggagttaaagctctttctacattatcctcccaaatcccgcgattacaggctttcccaccatgctcagcctcatgtgaaaacattttaagattgtcactgaagttctttcacgagccaaggccattaaaacaaaactagagttatattgcctaaaactaaaaagagcctaaacccaacaaaaccagcagtggttttgtgactagttgtaaaatggcatccatttcttaagttgttctcataaatattttattttctaaaagttctttggggtatgaaaaagtgcttcatatttttttttctgatttattttataccttcagctcacactgatgaataaaaggaaaatatgtgttgttctgtcgaaggcattactttggaagaggctttgcaatattatttgttcaaacactaataaatatatctttaccatcaaacatatagatggcataattttgggagagttagcaagtacttcctttaaacccaggatccgtgagaacttaggctagttggaataatgttttagttgacattttcagcatggcattcaaatggtgtatttatgtgaaaggacaaggagaggtgtgcacattactacaatacagaaggattgaaggaagaatgaaaaagataggaattaatctgcagcacaaaggatcatgatcggccttagggacagaacaattgtttgacagggttcttcagatcactgacggagattattgaaacaaatgtagaattgcttttttaaattctcttttggaaataagattttattttgactgtgagttagtttgtcatctcattcagggaatccatgaatatgcatgacagatgactcttttcaaagccacatatttagctttctagccacttgggttatttatttatttatttatttatttatgtaatgacataatttagggcagcaccaatgatttctaaaagaaaaatgcttaactgcatttttcaagaaatcgcatttccaaacatacgtgcccttttatgtgatgaaacatttattgaattctgtgatatttcagtgatattttactaatttttaaaaggttgaaagattgatgttgggtctcatttcttcagttattaaactaaggcagtaggatgaaagcgattgaaggtgcaaggaaagacgctgtttgcaataagatgatcatagaactacttagccttcatactcagtcacagagaggaaaaagctccaatatattaacaaccactagatgtctctgaactcccttgtaaagaattttagttttcctccatcttgttttttttttttttttttgagacatttgcctccatgccttttctttttctagatatttaaattttcagagcatatttgctgaaaggcagatattaactatatgagtggttacaaatgtaaatctgtattttgtctattaaacttgggaatgcctgtgtcctttattaccatttagaaagtagaatttctaatttttacagactcattaaaaatatagccatttattttataattcaatatgttaatttaatgggttttaggtaaaattttctcttatgctaaaatttgatttctcttctaactagtggacaacttttacttatatttctggaattagagtacaagtcatatatttaaaatatgcatatatttatatcatctttttacattacattaatatcaatagttatagagttgtaaaaatggtttattaatatttgtagagcatctacctccatttgttttaaaaataattttctttttagtgagtcattttcacaatctagggagagaatccaccatcttgagagagacagctgtgagttctgtaataaacaacactggaaaatcattgaaaaatcttatctttgagatacaggatgcaatttgattcgttttgtgactatagttgtgtttaaattgaaatctttctaatgattgaactcagcttactaaaaagatttttctttcccagacacatcactaaataatgtgaaatctttcttagaaaaaaaatgcaagaacattaatagttatattttgtaagaacattaatagttatattttatgtgctaatctcaaagtactgaattcatgacatctgacttaactaacacacacaaagtgccgaaaggaatgaattccccctttcaaatatgccacactttgaaaggctttggctaaaggttgaagattttgaagctcttctccatttaaaactgctggctgtacaaaagagaaaataagattcacttccatctctctgtgctaaaaagatcgtgaatttttcgcagagaaattgtgtggtctttaagtaagtaatcagcctctattgaactccataaacaagtaggaaggaagcacatgctgaactcggatttttaagctcagagcataggaattgccttccactctcatctcggtgctgggggatcctagaataggaccttagtatttggttgttcaaaaactactaatatgctgtacttattatgtaagttgtcttttataggatgccgacctgtctccttatcaacattagctcattaattttcttgccatctctgttcatttgttagtgactgatgggacatagcatgttgaagagaatctgagacttttaaaggccataagacattggtcagttcattggacagtgcacatgggaaaggaacctagccttcaatcagtaatgccttaatctttcttagttttcttctaggtagttaaagaagaaaaagtaaaatttaattctcagtttcctctataggatgaccttggttcttaattttagttaaatttttttacctttcaattgctgaagaacacttttttttctcgtcagtcagctcaggaagctgtgtgttgctttgcccgtggccaagaacattacagttgaagctgagtattagtaattaatcattacaattaccctgtcttttgtagtagtttaaatgagttttggcgatagcatctcagagaatcacacactgttgaatactgggtaataaaaatttcatgttattagtttgttttcaaatcacatctttattattaatgaaattgtgccttatttaaaagtaataaagtgacatttctcattagaactgtaggagaaaaactactttctagaaattattgttatagctttttatgaacttgcttctcactttatatggttatcgccgtggctagtaaatgctaattaggttactggttctgcacagaatactgttcaatctagtcagaaaggatgtttctttttagatattttagaggaataaaagggaaacagacatttcctggttgttccatattcacagtgacgctttgttgcttatgactctaatatattacgttattacttaactgccttgaacatctagtgttgatactttaggagactgagttcttaatggaatataagaaagattaacaatatgctggcaaaatcggtagcctataaatgttctgataggttcttcttgagtgtggcattgtatgtgacctaaaagtggagagaaagctcttaggagtaggagggcagaaaaaggagggtccagtcgggaagaagtggaggccgagagaaacaacaaaaacaaattttgcttagaaaaacacaataaaaacctaattcgttgtaaagtcaagtacattttaactcataggaacttgttcactaccctgtgtttgaaagactagactgttccctctctgccttaattttgaaaatgtcttagaatagagaaggtagcgattaactttgccatgtggcaaaggaatcagggaaatagcttcatagaagaggcacatttcaatttgtgggagcaggattatgcaaaagggataaataatcccagtgtattccaaaagtagtaatgtatgtatggggaagtggtagaagatgtaaccaggagtcaaatgatggagaaagctgtggtgttgcactgaagactagatttgggtcattagtgtacaggaagtaggagagacaatgacagattgtagcaggacaatcaaatttatgtattgtaaacacagctctgtagatgtttacttcacttaccagctatagtaaaaattctcagatttatttctaccctgtttcctatcttattttgctccctttgaccaatgtactactgactttctgtccttgagtcattttttcctaccagttttaatcttgaatctggttttattcaagaagaacaacatgggatcttaccctgagtaggcattaggtcaataagccaacacagattgtttgggcttcagtttgtctcaacccctgcaactgaacaagttttggatggaatctaaggaattgcaccaatatgctacagtttatttctgaccctgtatcctggtagacttttgaccttaagtcctgtggcttttatttattgatatgtttgtgaatcacttgcaaataccatgtgtgtctacacatgtagctatagtgtttcatttgtaatcttcaattatttggacaaacagaaatacagttagtatgctaaacagggatcattttggatatttacaccagtgtatcattaggtgggatgtgacaaaaatatttcataaagtaataaagtttttagttgacagtacttacataaaacatcccaccatacaaaacttatttggataatgtaggctacctttatttgaacatgaacttccattcagctgccgacaatgttgggttatgactgtctattatatgccgccattgttttttttgttagtattacagacgttcaaaagtgttttcaggtttgggaaatatattgcaggatttgcagatgaagatatttatttcaaataataagttttttggggtgatatatatggattacataaaagaacaaaatgacaaaggagaaaatatgccctttttgttatactgaaaatcctctttttttcttttttttttaattagatattttctttatttacatttcaaatgctatcccgaaagttccctatacccttcccccgccctgctcccctacccccctactcccacttcttggccctggcgttcccaaaattccaaccttacagaatttcatgtacaaattcagagacacacattcgggaagtgtagatgttttatttaatttactttttttggttccttctttattcatcacttttgcctttcaaccctaacagacaaactgaaacccactacttgtttcatatggcttataggctaagaattatctttatacttttataaagaaatcaagactactgctcagggcgtcccctacagcagagcttcttaatcttcctaatgcagtttaatacagttcatcttcttgtggtgactcccaaccatataactatttttgttgctatttcataactaatttagctactattatgaattttagtgtaaatatctggtatgaaggatatctgaatcacaaccaccaaatgggtcatgaccctcaagttgagaactgctgctctacagagcgctaggccttttcgcatccattatacttacagacaatctgatgaaggcatttccttaattgaggcttgttttcccatataactacagtttgtgtcaaattgacaaaacaaaaacacctggataccactcttctttttgttcccagttcccaatgtaagttttgcaaaaaacaaaaacaaacaaacaaacaaaaaacaaacaaaaaaggcagtaatatgttatactgccttgaaattttctccacagataaattagtccattaattaacctttactgaaagtttttttggggaaagaacaaagtgtatgtatgttctttaccttgtataatatatggcatctattccaacttttaatagaatcctcgttcccttctgaaacctatgagcacagtctttattctctctaggcttttactggctttctggtctttggaactcccctcccagcagaatctttcattaatctctccttattcctctctacccaagttctttcagtgtttccaaactccaccaataaactgtctgtaaaggtgtctgaggcacattaccaggtagtcacagtatgattacatttctcagttatacttttcattgtgataataaatgcatgagaaaaacaaggaaggaaagatatatggttgtgaaccctttcagaggttttaggccataaaggtagggagtggtggagcagagagagtatcttctttattatggccaggaagcagagagagagagagagagagagagagagagagagagagagagagagagagagagagagaatatgaatgcctttagtggatatctgacatgcagccaccaaagaggtcatgaccgtcaagtagagaactgctgtcctacagtgtgctgggccttttcatgttggttattaatcaagaaaacatcctgcaggtctctctccttccccatttcattccatctgcacccccagcatatgggatagttgtatgcacattcaggtcagggtttcctgtttaatcctctatgaaaacactctcaaaggcagatggaaggctgtgctataccaatctgtgatcttctcaactccatcaggttgacagtcaagattaaccatcacaaatagatttatgtgttatgcatcttccaagaaatgttttacacgaaggatgggtaaagagaggatatttactctaaacatggagtatttgtggttctgaagatgattctggttgaggaagctctcttgaaacatgggattgttaggcagagaggaaattgacttgttctgtttgactatacaggttagatatggaaccagttgttagatatcataaggtaacaaataacagtgttgcagaaggaaatgtgttcgaggttttcagagttgaaatagtgaggcttagagggtagcaagtactctgaccttggagggaatcagatagatggctaagatgcataatttattagcaaggatctagtattgaggattcctgtattaacttgaacattttttaatgttaacctgttcctaattttgagtctgagatttttatgaagtgctaatatgtataaaggagtttctgaacacaaaatacatgttgattgtgtctcccttcctgctaaaaatttgtcacagagctccctttgccagtgaaattatgtataaaccttcaattcttttttttcctgggctgtagataacttagccttagccactgctattattttgtgtatgatttgccaagtcggcgtctactaaacattatttcagaaccagaaacatgttttgtgccagaaaaatagatttggggcatgctgacattgaatcttgccacggagacttccaatctccattagaatgctaacagctttgagaagtttgtttgcctctttgagtttcccacacgtgtgaacacagaattcttaaaccatttcccacagcttccaacccagcagaacagtttttcaatttgttgtttcttattgtcttctgtcgcccctaattgctttggcatctcttttctgacttccctgtgttattttttcttcttccaaattcattcctaaatcaagagtggggaattgatgaaagagataattagactacagaattctagaagttgtttgacattccatgaaccattcctgtaacctcagaaaaataggaagacaagaaacagagaaacaaaagtgctcgtcctttctttgttgcctttctgaagaggattctttattctttgttctttgttttttgttttttttttttgtttttgttttggagtagctagtgacaggttcaaaggaatcatggtgagaactttcttgtgactattttgaatcattttgtaatatcctatctccatgcatataagactgtctgaaagtattagtatatgtccctgaatcattcatatgaaccatgaatatgtatctaaagatatctgcaattgcaggcaactattacttattgagaataataatagccagagggtatagcttaatgattcaaaaatcagctttttataaagaatctatgtagtctccctagaaaccaaggatcagatatcatcagggtcaacttagccctttgtataatagatacattgaataacatgctgtttaatttgtatgtatatgtattattgagtgaaactatgatgaataattagtctgcatattcaatgtattagcattactttggtaagtaatccaaattacagtgttattattatcagtttatctaatcttgggcaattatggatgtctaagaaacttgaaaattctggtgttgcataagattgtttattgtttttaattggaaaacacaaatttgttaatgcaaactatctttctggttagtctatatttttttcttttggggcttgagttagagagtataaaattttttggttggttgataatatagtcaatttcaacattccctatgttgtgtggcagttttctagatcttacttagaatgataaaattgtgttttaaaagattttttttttgtcatttcttacaactttataaattttctcaaaacctaaatgatcagtttagaaaagttgggaatatagacatgagttgctatggcaaaagtgtctttagaacttcggtgtaaatgcatcctctgcagaataaacagacccaagtgtttaaagcaaaattcaccactggtgctattttcagagctagctagtgtcagctactagttagtgttctttcagctacttccagtgtctgcatctttgttcagtagttttcttgctatcagtgttctaagtactttctggaaatattttatgtacttccttattatagtaagtgtctgagaatgggattgttaagtcacaggatgtaaaattttagaaatatctctttgctatttctaattcattttcttgaagggaagtgtatcagttttctactcaatgttgtaacaaagaaccacagacttgatggggtaggcaacacttctttatttgttgtcttgttctggggactaaaatccaagattgaggtgccaacaagggtaatctattgggtagatggccaccttttgcacatgatgaaaaggtgatgaaagggttagtacctaccccttttagctcatttaaccttaaatacttctgtaaattatgcctctctaaatataggcagaagatagcatcagatctcatggatttcctaaatatgactcctaaatatggcactttaactgcttaatttttggaagaaagtttagtttataaaaaataacattgtcattcaacatcagtgaatggaaggtctcatttgcatcttactacaaacaagtacacacacttcactcaagtattcacgaagcatgggcacatcactactaatgttatagaaatgacgttgtttggcttcccaaattttttattgttttgttttgttttgttttgttttgagtgtttaactgttttctgttttgtcaggcatttctttttacacagaaaaggagtcatatatttaaacattatttatcctttgatattaatccattatttaccttaaacacagcaaaatatacagggttaataataaatgagtttccatattaatgaatcatatctttaatgctcaccatacattcataaagtctgtttatagtttggatgcattgattgctggcagtaaaatatagtagtggcaaggttaatgcaaaaatcttttcagatagtatttactctgaattagcaagttcatccctgagtcccagaacttaaatcccataagatgtatagtgagatttctgttggctaagtagttttgggaatggctgtatcttatatccccttcctagtggttcatagtgatcatcaggctctgaaggttccataaagccctataataaagaaatctgttttagcaaaccacaaccaatcaaaatatacaggtgtggagctcagccccaatggacaggagttgagtagctatagagtaatattgcaatatgaaaattcatattagtataatctacagaacttgagatatcatttgtacaggcatcattttgtgtgtgtgtgtatctttatggaaaggtactatttgtagacatatagaaaccattgtttccacaagtcagttgtactacctctagctacatggattcttccactcttcttagcatcagacaaacattgttctgttctattctccaattctatcctttaatggcatagtggcccatacctgttatcacagcatctggcccatacctgttatcacagcatctggcccatacctgttatcacagcatctggaggcttgctgcacataagtgagttctagtttagcatggactaaagaatgacaccatgcttcaaaaacatgttatataaatggaaacatattagacataacctttgtgattggatttttcactcagcgtaattctctggactccatgatgttttatgtgtaaatacttcctcccattatattgttgaataaagttccatggtaaaacagaccagattgtttaacttgtcatccatcaaatgacacttagcccacctctgttttactgggacctattaataccctataggaatggtgttctgaaaaatactggtttgattggaggacagagaaaaaatacaaactttggaaagactcttatacagaaatgataaaattaaagaagtatcttatcttaaaagatcttaagaggatacattttagaaattattaagttctttattatttcatttaggaatttcagagacgctgtaatactttgatttcattgattgaaaaagaaaatatggaaattgaggaaagagagagagcagaaaagaagaaacgggcaactaaaactccaatggtaaaattttcagcattttcctaacttttaggtagatctcattttttttacataattacaaatgtttatactatgtttgattctgggttttatgaaatgctaatttgttttagatcaaagaagaatcacatcacaaacgtacttctctttttgtttgaagaatatgtggttaggaattcccttgttacaaaactcagtatttaagaaattcctcgcaaatttaagcagaggcataatacaagtgagatcctatgaattgagactaggtcgccgtggggacagcggaaggttagagtagtgatgggatggtgtgaagactgaaacctgagttgatcaaataagttgtttgatctttgtggaactgtgtatacaaaagaaccctgagcagacaagatagcctgttttggcaataagttcactgctggataaaaatgtgattttaatcctgttgggttgctgtgtatatcaatgattcaaagtattctgtttgagtgtgttaagtagtgcaccatatttcatcaaatctatgatgctttctgttgtaagacaaaacttttttgtgctactaagagatatgatgccaagtatcatctgttatcagttgtaaaatacatcctgatttcagaggtgctaatggggaaaagaaatgtgcatcatagaagatatgaaatatggtgtgttaacatttaccttaacgttattaaataacactcacaaataaacatttcctcagaaactttaaatattaagtagttctttaagataaaagtacatttataagccatgtgtaagtagatacttgatgactatttttgatggatattttatgtcttttcataaaaagaaacacctttaaaagttattttacattgggttatatagtttgttgggctatatagagcattaactgtgagtctaacattgaagtgaatattcatgttaaaaattttaatgcatttacatcctagatttaacattgttgggccatttaaaagtgtgcatattggagcagaacattaaatctgtttccattttagtcacagaaaagaaaagcagagtcagctactgagagctctggaaggaaggatgtcaagaaggtgaaatcctaaagcctagaaataaagttttaaatgggaaactgctattttcttgtccccatcttcaaatgctaattactacttccagtgtattcatggtactctaaggaaaaaaaaaaggaatactctttggttttgatttcttgcatattttatatattttacaatgctttctacctgaaatgtgtagctttctattttatgcattctagtattttctgtactgtattttgtgcatttcatgtcttcatcaaattcctctcagtccttgtttttttgaagcttgtgctgaggttttagcttttctatgttttctatgccgctgctttgaaagagaacctagattctatagctgtattattgttgtttcagactttacatttatatggctgtggacaaaatgaattaaaacgatttgaggagaaagactttctcacttctttgttgctttcttttctatggagtctgggtttgtgtgtgtgtaactgcatactgtgattagcataatcattgtttctttgaggtcatctacatactttttcctaaggaaataaagggtaagaaagaaaaaatcttaaaaataaaccctaatatttgatactgtgtttgctgtcagtgtgcgttacatttaaattattctctaaatattcaagtgggaaaaatataataaaggactgtctataagaaatat

SEQ ID NO: 35 - DNA, 18102 bp, mus musculus
ttcctcgtcccacctcgtctttcccgctccaacgccatggagccggacacggccacagaggcagccaccgtggcagtttcggatgccagagccacagtcgtggttgtagaggatgagcagcccgggccgtccacctttaaagaggagggagcggctgctgccgccaccgaaggcaccacggccactgagaagggcgagaagaaggaggtaaataggaaaggggtgtgtgcgcgcgctctgtgtgtgctggacacatcccgtgcctggcccctcacaggggcccaaaccctgaccttttggcgccgacaggtaccaaaatcactgcagggatgggggcagcggggcggcagaaccatctagcattccctcccctccccctttcctgctggccgcctgctgagcgggggcggggcagggcgggggcgcggccgggtagcggggtatcccgatcctgagccccgagtctctcctagactcgggcctccctctaccttcccggaactgggggaaccttgtgggggatgggactgtgcaggaaaatgcctccgcctctctctctctctctctctctctctctctctctctctctctctctctctctctctctcgttgctcgctcttctacccccctcttcccgtcggcctctgcctgggaaatctgggcccttcagtcccaccatcaggctgatggggatttggctcgggcttatttttgtaatttaaatttcaaggtgctactggtggtggtggtggcggcgggcaggagggggaagagggagaatggttggaagataatgcttgctgtgattggcagtgtctgtctttgggattacagaaataaaaaaaaataataatctctcatgttcctttgatccttgcctcatggtgaggagggggtgttatgtcaagaaaacatcctctctgcgctttatcttacaaccctcacactgaggaaccatgctgtcttaggaaaatgtccaacctttgcaccctctccctctcctgccccgcccctgatggtatagtgtttcactctgggacacccagatgattccccttatctggcctttggccttccagccttttgcttcccttgcctagtggggaaccattcactcctggacacgtttattttaaacgttgtaaagtcctactctgtaggatgaacacaggagagaagaccactgtcacacctattacagacaaatccaggaagtaggtattatctcccatgaatatacaagtaaaattatacaatgctttgaaaaatcgatgttaaagaatagggtggaacataagaagttttgatatataataaaattgcagaacagatcgtttataggtggatttccccccatttaacaatatacacgatgatttaaaaatggtgggtaattgaaattatgctttaagaatctcaagtgactttgtataaatcattatacaatggcatatgactaaatgaatagctttttgggggaaattaacacattttgccttgaattagaagaatgatgctaaatccattagttagttaagttgattaaacagaaagtgctaagtgaaaatcatgggaaacactgggtgtaagatgtgtgtggtacttagatcattaagacggcacagatcattaaagctgggccagataccaagtatttggttaagaaatttaaaatgcatctagtgtcttttattctctggactaggcaaatataagtgttaattatttcttcttcttcacatgggactcaatgttgaattttgaaattgtataagtttttggatttccattttgaaaagatcaataaaaatacatgtaataagcatggagtgtattgctgtatgttcatgaactctgtatgctattatgaaggaacttcatttatccgctcagaatagaagctgcatttcctggatctctaaacattcttattttggtcaatctttttttttttttaatttaatttttaattgtccttaaaagctaagtttgggatgggatgggagaaaaggttaagagctcttgatatataatcatgaaaagtagagtttggattctaccaaccacataacgcagcagcacacatctgaagacctcatctttgagagtgacagagataggatagggcaatttctggggcttggttgctgcaagcctagtgaagaaaaggcagttcttggttgagggacagactctgactcaaggaataagtggaaatgatagaagatacctggtgctctcttctgtccctccacactgtacatggggtcatcacacccacatgtgcgtacacccacacagatacatagaaatgcacataatgaatcctttaaaatattaagtatattttgtactacctgaatctgtaaggagttcacatttatcctgtctataaccttaggttagtgtactttgacaatgttacaaagccagttgacattaagcatgctgatttccctcaactaaataaccatttctcagactctttttttttagtaataataacttctaattatttgtttctaataattctttctgtctcctcgctagccagctattcacttacaacttttaaagacctcatctactttcatcagaagaaatttatctaccataaaatcatgaaaataccagtgaagcccaaccccaaggataaaggatgctactatacaagaagaagcattttagttttggagttctgccatctattcctggtgtccatgataaacctttttttggtggtctttactatgttgtttgctactgctttcatttcttggggcatgcaaagttagattatcaaatgcggtagaactggatagaaataagtgtaaatacacttttgaatgaagagtgctttcatgctgaatcaagtagatgagctatcagtgaactgattgtgatggttagcccacacaggggtattttcttcttaccttccagttcttgaacttacttggctaagtgacagttggattacttaggaatgtagaaatagatagtattttgcaggagttaaaacaccaaagtcatggtctttaaggcaaacgtttttggtaagcttgtgctacattctcttggaatcaatactatatgatctacacataaaaaaaaaggcaggaacataggggtgcattaactgggacaaagaagagttcaccagaagttggaggggataaggagaagaggtgtgaaaatgaccaaatgtattatacacatttatgaaatggtcaaaaaatatattaaagactgcaagatggtaaaatctacaagtattccattagccaaatcttatttaccctttatcttttcttgtatgagaaatttattttgggacacatactcaaatagaaataagaaggttgaaaaggtaggtttttgaaaaaattaaggaatttgttgtggagagtcgtgtcaatgaagtggttacctattgcttttaatagtactcctcaagatgagggattcaattagtgtgtgattagatttttaagcacagaagtaatgaatacatattttcctgagatgtaattctctgaaagtgaagttttcctcacaccacacacacacacacacacacacacacacacacacacacacacacacacacacacaaaggtgaagtaactgttactattttaaaacttgaaaactccacctcattgatcttttaagataaagatgttaattttgatatctaagagtcagttgctttgaaaatgagacttgtactatatgtggcattttacatttgcttaagacagggtttctctacatagcttttgctgttctggaactctctatgcagaccaggctgtcctctaattcacatagatctacttgcctctgtttcccaagtgctgatattaaaggcatgtaccacgattcacagcatatgtgacatgtggaaagtatggtcttgaaagtgtctttctcagtttctattccaatacaccaagaattacatttaagtcatctcatgaagttgatcataacacatgagacgctgtaaatcataatggttggtatgtgattagtgctccaaagtagggctctgaccaaggtcaaggtccataatttttgtttgaatttcgtcaaaataaaacgtctaacaaatgttggaagacagtcattaattattggaagcattctttttcttgcttaaggccctattccgatgctgaattattctgtaagattttaacagcacgttgacaaaagttgtgacgaatgtgaactcacttcttttgtttttcctttaatttctgaaaagtgtgtgtttaaactcaaatattcttggtattgatctggatggataggttcttgcttttgttacgttatcttttgatttctcctagagaaggctatttactctgtctgtcctgatatttaaatcaataggtttgtttttttttttttttttacaaaatgtaaaaatacataggatattaacatacataggatacataggatattaaccctgaacttctaggttgttttagacttttcaagttactaattgatgctagtgttcactaaattacaactttaaaagtatcaacagttaatagaggatagctctgatgaatccctcctataaaatattcttgtaacacgaatatgcagaattgttttctttacagaggaaataaagtgaccagtttgaagctgtactattgggttattttaagagtatgagatcgtgttgcactgtataaaaatatacatgctttaattagtctaggaaaacaaattttaaaagtgtcatttcaggaacagaagccagagtcttttattttgaaagcctggcttgtttccagtacataaagaactgtttgggagagttatcatttacatttcttgaattctttggtttgtggttgaacattagcctgttccggatttctaagtctcttatattatggttatacatttcttttgctttaattaaaaaaaatagatgtaaaggcccagtgttttatttttggtttttattctaattaatgccatctctctgatattttagtttttttttaattggatctcaggtacacagaactggattaatcataagacttgcttcataactttcatcgttgctacaatgtgtgtccctcagtgatttatttatcaagttatttaattatttttgtcttccttcaagggagaatatctaccagcttaaagaccttgctttccaactggctgatatttatttcctttgaaattctagaaaatcacttctccatttcaactcaaacttgctgctaaagcttccaaatctgaaaaggaaatggatccagaatatgaagagaaaatggtaaatatgcccttggtaaggtggtaaacagcatgtttctcttcgtttgtttgtttgtttgtgaaatagttctaatttctgtgattattgatgtaccctaccatacacagctttttgataacttttacagaaatatcagagatgaaaagacttgtctgtttatgatgcataattcgatctcagagtacaaatgcaatttacttattaaattgtcgcaaccattttctctgtgcatgtgtgtgtctgtgcatgcctatatgtgtgagtgcatgtgtgcgtgtgtgtatgtgtgtgtatgtgtgtgtgtaggccagaaatgcctgtcaggtatatttctcagtcactgctcaccttagtttttgatcttggatccctctgacttatcttgaggaagggtttggataaggtccttttttttttttttctgagacagggtttctctgtgtagccctggctgtcctggacctcactctgtagaccaggctggcctcgaactcagaaatccgcctgcctctgcctcccgagtgctgggattacaggcgtgcgccaccactgcccggctggataaggtccttcttaattacacttcaccttaactaattttttttttcactgacttaactaagagtttacagatttgataaggctagatggccactgaagtctagagatccatgcatttcctttgttgatgctgggaatacaggtgtatgccactatacctagctttttatgtgggtgttagggatttgaactcagggtgttatacctttgtgacaagcactttactcatggaaccttctccccagccaaccattacattttattgaataaaataatctcattttcaaaggagaaaattaaagatatcagaaactatgtggaatagttgggatgagaactcatgtctcactttttcttgatgttctttatccaatactaaggtgctgtaaggcaaagacattttgtgtactcagtggtgaagggatcggtggatggcagtatcagtgtggcattgtaccctgagggaaatgcagtcacaataccagatcagcacttttcctttttaaattatatataagcaaatgctattcattaccgaaatatatagtatggtaatacaacattagaggcatattcagacttattaacccaatgcattacatactatgtattacatagttaactagtgtaatcttagttgagccccatatattgcttttgtgacttgtttaattttcagacaccaaggaccaaatagctagttgaaactgattccccacccccagaaggactacttttgcagttttgaaactaaatagagaggaaatatgtgttttagttgctgatagctatttttacaggagtctgtgccttaatgtttaagaccacatctaaggagacagttaatgttttaacaattctaagaacaacattccagagaggataacatgaattggggaagctttggcctccttccagcgtgtgatctgcatgtacttttctaagtcttgtatctatgctaatgaagtctgtaagtttctggtgttattaatttttcaccggtaatcaagtattctttgctgaatagtcagagagtgactattaagtaaaaggaaaaaaatatctttatttcttcctttgtttaggatgaagtaaactcttgatcttttaacgttttgttgtgaaccagtttatttttatttttctatttttcttatatagaaaatagttattttactatattctgattatgtttttccttcctctaatacctcagattctccctacctcgcctcccatctaaatccacaccttttttccttttattagaaaacaaataggcatctaagaataaaaataaaataaaacaacctatttattttgatggtgtagattatatgtaatgcttaggtacttattgaaattatgactacacatcagcattaagtgttggaaatacttaatatatatatatatgaactacttcacatatatgtgtgaatatatttttctctaagttctgtttcttcgtgtagaaatcttacatactaatagcataaaatataaattttcagattgatgtaattcaaagaagtgttattacattattgtaccatgacattgaaaatatttttgagagcagctggtagtctttgcctagatttcagttatttctaaatgcagcttggtaatttgcaaactttgtagtatgtatggattataacatatgtattttattcattcatttataattatttttgagataaggtctctctttgtagtcctagctgtactgtaacttgctctgtgaaccaggttggctttgaactcgtagagatttttctgcctctgcagagcaatgctaggattaaagttgtgtaccaccatgcctggttccaatatatatgtgtttctatctttagaacatacataattgatgcaattttttagttagagaaaaagaaagatcatgttttagaaagagaattaattttctaattttgactttcggatctttctgtcatattgggcactgagaattgaactgtcggccttggaaatactgcgctatacttccaatcccaagggtatacttcttttgggagcatttactaaatctgtcaggtcatttttcttctgttcaaactacttgacatagcattttaaaatttgattacttacaatctggggaagcttggaaatgttcctgtatctccaatttatcatctgtaaaatgggtatgaccagagcgatcacctcatggatttcaaagggaattcagtagattaatatgttaaaagtgccaaggatgttgcataatgaagcagaatataaatgtttaataactaactttgaatgaacataaaaagcaactctttccctttccctctcctttgtaaattagaaagcagaccgcgcaaagagatttgagtttttactgaagcagacggaactttttgcacatttcattcagccttcagcacagaagtctccaacatctcctctcaacatgaaactggctcgtcctcgagtaaagaaagatgacaagcagagcttgatttccgttggagagtatgcagtcttctttccactttcttccctttccctttttctctcccccttcgccattccatttgctcagtataactttctatgaataacatggttattgacaatgtaaatatgttttggagataatgatctttgttattgatttttccttaccagaacttaattagttaaaaaaccaaccgaccaaacaaacaaacaaaaaaacccaaccaaccaaccaaacaaacaaaaaaaccatgtagactgcttctaccacattctatgccagacactagatatcacattcctttttaaataaagacttggtgtctcagccttggctgtgactgtgaaatctcttgggtttgtcttttcacctagctatcgccacaggcgtacagaacaagaagaggatgaggagcttctctcagagagtaggaaaacatcgaatgtgtgtgtcagattcgaggtctccccttcctgtgagtacttcatcacactcatggtttgcctttgcagttcagtgggagaaaaccaaatttcctttagtatactaataaaagtctgagaggttcttcgttttttttttttgttttgttttgttttcagatgtgaaaggaggaccgctgagagattatcagatccgaggactaaactggttgatttctttgtatgaaaatggagtcaatggtattttagctgatgaaatggtaaggcactggtattcaaaggatgtcctgagttactacaagtttttcatgtaaatttgaactacatgtgttgaattttcctcaagcccgatgcccaaaaagctttatttagtggcaaaataatgtactttctaaggtttatatattttactttatgtgtggcactcatataggcttgcctgcctatatgagtgccatgtgtttgcagtgcccggggaggagagaagagtgcataggatcccctggatctggatttatgggtggttgtgagtcaccgcatgagtgccactaattgaacccaggtcctccgtgagagtaacaagtgctcttaacctctgaactatgtctccagcctgcaaaagaatgtttgtcgcctacaactgttcaaataacctgtagaatataaccttttgcatggctcaaagatcgtatggagatttcctgaagtggtacaatacctcactttgctctcgtttttgtttgaactttggcttccaagaagcccagagaaaagtacaatggcaaaagggagcatctcttcatcctctaagtctgcccttgatggctctcctctcctctcctctcctctcctctcctctcttttcttttcttctcttctcttctttttcttttctcttttcttatgctttatcttctagtctaattttccctgataagttttcatttctgttttaccattaatttttgtcccatgtttttataacgggcaaactggcatcttcttgggaatgaagtgggttatataaaccaaacaataagtaaataaatgaacaaattcatacataaatgaatgtagacccagttgttctgtaacttgccattattatatgtccacagactactgggtttcaatcctcttgccttagccttctgagtgttcagattataggcatagacacaatgttcagcttcagcgttgagcttccataacaatagagtgccaagtctcagtcttttgataagctaatgaatcatgggcttgtaaaataactgaagaaaaactaaggtcatataagatgctaattgagtacatgaggggattgtataaggcccagagttgtatattaagataaaattcctaaaatttgacttaagagaggatagagggacttatatatctatttaatccaataatataatatctatgagacttgggaggcatattttcaattactattatccagaaggccaagccatgaaatacatattatgacatctagtatagtctattccatagacactcatctatggctgagcagctgtttggtatatggctgagcatttttttttgaaagctaggatttgtagccccttatactctcattattttgttgagggcaattttctgctcatagtaggagggccttggtttatctgtcaagagaaggacaaggattatttaccccaagaacttcttgtctaagacaaatgatctaaagatccttcaagaatctgctgatgccgtataagttttagttctatcttatcttttagtatctttccccctttcctttccttttcctttccagaactggagcttaaaactaaggccttgtgtgtgctaggcgagtgcttgattaccaggctacacaccagtcccttttatatgttttgtcttgagataaggtcccagtatgttgctcaagttttaaacttgtcattctcttgcttcagcctccccttaagctgagattgcatatgtatgccatcatgtttaacttgttttaagtactaaaagagaggaaggcattttagagaatatatgtaatttagaaaaaaaaagaaattaagtaatagtaattaatagcaattctgccattgagaaataactacagttgacattttgctatgtttctttgacatttttctcttttttaatctttaaaaaattttatttaatctttttttacagtccagattttatcccccttccttgtccaccctctgactgttccacataccacacctcctctctgagtctccactcccttaccagacctccccactccttggggtctccagtctcttgagggttaggtgcatcttctccgactgagtcctctgctatatatgtgttgggggcctcatatcagctggtgtatgctgcttggttggtgttccagtatctgagagatctcgggggtccagattgaggctgctggtcctcctacaggattgcccttctcctcagcttcttccaggctttcctaatttaaccacaggggtcagctgcttatgtccattggttgggtgcaaataactgcatctgactctttcagctgcttgttgggtcttttggagggcagtcatgataagtccctttttgtgagccttccttagcctcagtaatagtgtcaggccttgggacctccccttgagctggatcccactttgggcctgtcagtggacgtccttttcctcaggctcttctccatttttgtccctgcagttctttcagacaggaacaactggttttgttttttgttttgttttgtttttagatgtataattgagatcatgtggtatgtgtaatttggcattgtgaccttttcacattcatatgtatttttcatatctctaacattttgtcaaagtaagcttttaccatcgcctagtcctcaggaggccccactgattccttccacttctctcctgacattgcccatttggattgctagcagtgcagtataatagtgctactatgacaattttattgctagtttctctgtgcttctcacgttgcaatcataaaattcctggaagtagaatcagtttcttaagcattttaaggttttggtggatcttgtccacaacaatccaccctaagtgacttatcagataagatgtagcccataaaagtggcacttagcctagattcatggagtgaagttttgtgctctgcttagagattaagcaaaagctgcttaattatttagtgtttacttttactctggaggctgggatcaaacccagggcttcatactaaacatgtgctccccactgagccacaccctaactcttattttaaagtgctgactcttatttttaaaggctgaacagcatactgcatagttcccgttcccgctggctaggtgccaggctcatgggtgtttgatatactactttaaaaaaagcacactgagctagtggtctctaaggtctcttcacactgctgtgctctgtgactttctgattcctaaggtctttaagagtgtggggtatcaatagacagctatgagcctcttgaaaggcatagtgtgaatatttaatgcctgggctggaaccatgatcagaacaataggaaagaaaggtcactatctcaaaaggctctagaaagacgtctatttttgtgaaacatgcacccccaaattcctaggtttgtatctactagaaaagattacagatcattttgcttgttcctcaacagaatcagcattccctaaatggaaaagtgatttattaagcaatatcttggctgcaggtttttggttcttttcttctcctctcacaacaaataatgaattgaaatggttttgtgtttttcttctttttaaaaagtccctcttccttttcattgctggaaacctaatcactaatgtgagataattggcaagaacttttttgtaatgttgtttctaaaaaagtgtttcattaaaaaagcgtatttacatgtttttccccccttgtgatgataaatacagggtcttgggaagactttacaaaccattgccttgcttggttacctgaagcactacagaaacattcctggaccccacatggttttagttcccaagtctactttacataactggatgaatgaatttaaacgatgggttccatctctccgtgttatttgtttcgttggagacaaagatgtgagagtaagtgagaaactacttttaaaaagacggtcaagaatattatttctagactgcagttgcataacgatcctgttaaacacatttacatcagctatgactactaccactaaatgacccttcagatggactgactcctagctaggctctgttgtactgtccatatactaactcatttacttaccacatttatgaattctgtttactttttttgtttgtttgggttttttttttttttttttcgagacagggtttctgtgtagccctggctgtcctggaactcactttgtagaccaggctggcctcgaactcagaaattcgcctgcctctgcctcccaattgctgggattaaaggcatgtactaccacacccggcgtgtttactttttagtatgtactgttagtcactttatcatttgtgtacttaggagacagaaatgtggaaatcggaatgacttaagttttgctatttaaagttttggcttcacacacttgtccatacatagaaatcttcacacacttgtccatacatagaaatcttcacacacttgtccatacatagaaatcttcacacacttgtccatacatagaaatcttctgtgactgcaaagagcctcaccattttgtatatgcaaggcttgtaacatgcctgtatatattcgcagataatactagaaacttggattttggccatggaggaagaggtatttatattaactatttgtccagttagtaggctataattattttaggattgtagagtcaatcaaaaagtaataaattatgcaaaaatcacaaaaataatttgcttagaaagagtattattgaaaattgtctttattttgcccccagagaacagagtttaaaataaaagtttgtattattttacatatttagatagatgaattatcaagagatactctcagtggaatagtcccataatgaattatgtaattttatcattatccttttgcttgaagaaaaattacttaaatttatttaaatttaacttataaataatttaagtattgaaatactgagttcataaatttagaatcataaggttgattcctcctgaaggctactatttttccatagcaaattggtcacttaaaattctgttctggtcattgctactatttaatattcacttcttagagattgatgttgatgtatctaaaattcaagatgatcattggcaaacccatttgactttggtatcatttggggtagatatgtttatcctcccattttttctggcttttagtaaatattttaggaggctagtatttattaatgaaaaattcgatactataaaagacattttagttgtgacattagagatattcttgatcctgtctctataaaaagagattctcttgatcctagttggaataaagtcatcttgcaatttcttgcagtattgtttttctttatctatcacagagaaatccatatccagtggacacggaaacagatatggtttaatttcccatataattactgtttgtgtaatgaattagtttcaatgtgtacaattttaagagcctttgggtcatgtggtcttcaatattttatcaagatacttaaccctaaatcttgtcaatagtttcaaaattctaaaagagagttaaattaaatataaaacaagtctcaattccatgaagttctcaaggaagcatgatgctgaacctttcaatgagtgaaacaaggataaggtggtactaggggtcaatgagatctggtacccaatccttcccaccactgtaacagtcctctacaattttaattgccttttaaatgtgacaatttctcagcatataactaaggtggctacagaggtatttttctgtccactgtgtcagtctaggaaatcctttaatacataccggatacttataaatattgttgaatgaatcaacaatgcatttggtgcatgtttgtgaattataaagtagaggctttgtaacaacccattggttttgtttatttgccataactctgaaattataataccaagtagttcctttttatacaaatttttctgcttcctttaaaattttgtggttttactttggcccataatatctggaatgaaattcataccagctacagatgttttcagtcaagttggctaccatgttggctactgcctgtgaagattaaaaagtagttgtaaatattatgtctctttttaaaaatgagatttatttatttaatgtgagcatactgttgctgtcttcagataccccagaagagggcatttgatcccattacagatggttgtgagccaccatgtggttgctgggaattgaactcaggacctccggaagagcagtcagtgctctttaccactgggtgatctcaccagcatatctctgtttttaatagcttcctttactacacagagaagaagccacatccatagccttataataacattaagaacctcacaaaaatattaaggagcttctgggactccttaccaaaatacataattattatctgttggcaaatgaaggaaaatataagatgtctccaaaggcaggaaatgtcactatgtgttaaatattatatgcttgttaaatgagactatgatagtgcttggatctttgtgacactaagatcctatgtcatcccatgttcttttgggcctctcatgacatgaagtgttcttctagttcatgtaaggtgagattttgttttgttgataagtatattctcaacacagctagaccattggccacaaagttatctttgagccttttcctgagattttcctatctctcaaatggatgagacagagtggtctatgatgttccatatagctcttaatatttttccgacagtttcttttcagtaattcccttgtcaacataatctaatatacacaatttattttgcattaggcagcttttattcgtgatgaaatgatgccaggagagtgggatgtttgcgtgacttcttatgagatggtaattaaagaaaaatctgtgtttaaaaagtttcactggcgatacttagtcatcgatgaagctcacagaataaaaaatgaaaaatctaaggtaagttctcagtcccattatcttgcttgcttgttcacttttctgtgtttaaaataaaaattaagtagcagagattgggcttttattcacagaatgcgaatgataattagttttgaaagtgcccataaaggctaaattattcaatacagaaccaataaaagttaagtactagctttaatgcaaattagatattatttgcagtttgtcctgttggcagcctaactctgtcatgctacattattttaacatcactgagaatatttgatgtacaaatatcatttgcattgacttatttttttatcaaggagctacttcccttatgtgtatgtattcctatggattagaaaagggagttttctgatttatgtgaattagagtctggtattaatattgaaaattataaattatttgttgccattcaacttcatcaacagtaggaaaaacttcacttgtaatgatgaacctctctttggatcactgggctacttttgggagaaacagggacagaactggagcaaaaccaccaggtggagcatactaatttcacattggaactaatacttgataaaaggacgcatgttaaagattcgcttcattaagaacattatgaaaataggattttttttgtaaaattactgattttatgtttttgtcattttttttggtggtcttaaaacttgaaatcttaatacataggatcaaggaaaatgagatcaattctggtgctaagtaattgtgaaaaggccagagttggagcttaactatgcatgtagatgaagatggctgttggggagaagatgctgttatagaaagtgatagcttggatctaatggaagaaatttgattttctgaaaccccaaaatggagaaactaaaaattttcacgatgggggagggatctcagatgtaaatatgatttgaattctttcaggtgtggacatgtctaggatagtagtgttcggttgtgctttgttgtggcaatgcctactgaaatcggttattctttccatagaaaattaattttaatgacgtatataactgaatttcaagagccagaacaatgcttatataaattttatttttattttagctttcagagattgttcgtgagttcaagtcaactaatcgcttacttctaactgggacacctttgcagaataacttgcatgagctctgggcattacttaattttttattgccggatgtctttaattctgcagatgtaagtttaaaacaaagtatttgtgtgagagggagtggtgctcagggttgaagccagggtgcttagctaatgctttactattgatctcccatcccagcctaaagccatccatcttaatatatattcctaatgttcagaatcatctatgctctccctccttccacctttccccctctcctttattgttattattattatttatacatatgtgaatgtgtggagatcagaggaaaactcgatctagtcaattctcttgtagcatctttatgtgggttttggggaatcgaactcatgttattatgctgaccctgagagccatcttgctggcctgagacatctgttttcaaagtatagaaaataggttaaattttacacattttccatttgtgattctttcatttgcttattttagttttctcaagcatattttgggaaattgtatgtttctcctcttgtgataattctgtctgttattttgtatatagcacattgttaccacactgataagagagactcagttcatagtggtgtatccaaccttttcattaaatttgagagactaattatttttcttcattaccagcacagttttgtgagattagaaaaatcacatggaatgatttaggggttttaaggcttgatttttatatcctattcttcttaactagctataacattatgtgatatacattatgtgatataggaaaacctaatattttctaaggtgatggtgttactttacattgccattaaaattttgtcaatggttgcagtattttcacatattataaaagtaaaacattatgactatcacaataaagtgttttaaaagt

SEQ ID NO: 36 - DNA, 184 bp, mus musculus
ggttgtctggtcgcatctcagaaacccataacccttgcagcatggctgaccaactgactgaagagcagattgcagagttcaaagacgctttctcactatttgacaaggacggggatgggaaaataacaacaaaggagctggggacagtgatgaggtccctggggcagaaccccacagaagcaga

SEQ ID NO: 37 - DNA, 165 bp, mus musculus
gaaacccataacccttgcagcatggctgaccaactgactgaagagcagattgcagagttcaaagacgctttctcactatttgacaaggacggggatgggaaaataacaacaaaggagctggggacagtgatgaggtccctggggcagaaccccacagaagcagag

SEQ ID NO: 38 - DNA, 3247 bp, mus musculus
cgccggcgcgccctcctccccacgccccccaggccgccctgggttcctataggaagggcatcagcatcccatccccacccacccgacgacacttggctcttttcccctccccctcctggaacttcctcctcgtccccggtcgggccctccgcctctctccgcactctcctccccagttcgcacatttccgcccaccttccgcctggccttgccgcagcgcagctagcggggtgttattttttcccccccttgggtaaggagttggtgaaggtgagactcatgagggaatacaaggtagtggtgttagggagcggaggggttggcaaatctgccctcaccgtgcagtttgtcaccgggactttcattgagaaatatgaccccaccattgaagatttctaccgcaaagagatcgaagtggactcttccccgtcagtactggaaatcctggacaccgcaggaaccgagcagtttgcctccatgagagatctgtacatcaagaacggccaaggtttcatcctggtgtatagtttggttaatcaacagtcttttcaggtaatcaaaccaagtcttgtaatttctttgaagggggtgtggtaatcctacatgtacttctcatttgcttgagctgtgcgttaatgagcgtgtttggcttttgaaagtttggcatggtatggaaaagccctggattgtttctgtagagagtgctaaagtaacagacatcgacaaatattttaaagttatttttaaggaaaagaaaagtgaaaaggaaataggtcagcctgagtatttttagccctacggtacaacctgaagttgtttattcacttcaacaagtatcgattaacgtgttcacaaaaccttccgtagataacctcaagtgcggagcacggtgggctgggcgaaattgtttgaagtccattctctcgtacactgagctaaaacctgtgtgcctgcttttccttccccctgctctcctagctcctaaggtcctcagcttgaagcctaaatctcagtggtgcaaaatgcgggctaggcctgctttcttggcatttttcttaggggaatgcagccgaaaggggaagttgctgctctaaaagactagtacctaggattcctaacccacagaaagcaaggatgactctccttttctcccgtcgagccatatcgtttctgccatcgtagcctatacttacagaaaaatatgtgggactgggaacgcagatttcttagcccagtggggtagccaacctggatctggtccagttgcttcagaaaatccctccatccctcaccgggaactagactgaagttaacgttattttaagagatgcactaattgttgctatttattccttgaaaataaatgaccttatattgacccgttatattgacctccattgatttaggaaacggattttttttctgcatttaaaggtatgcacttaatgttgcttacttaagaaatattaagtgccttagccagagtaatgtgctagtttcacattctttgggagttgaagttaaagtgctatgtatgaatttttctggtaaccttatacaacaacttcaagaacttctttgtaaagagtataagttctgggcaaatgactccaaagaacatgctaggtagactcacattccaaacaaaagtagcataaagcatttcccccagaagtgctgagggtattatttgacaggtattttccttctaagggatcctcgaaagatttgtttttcattcagcagactcttctggtcttttcaaaggtgtttcataccatttccactgtatcctcttctgttatagccataagtacggagtatggaactctgacattatttcagcagagactcgggttcctttgaggcaaaagttggtgtgcttaggtacacttgttgttccataaggaaacccagaaaagcagcttaacagttcagacaagattgaattggtatatttgacctgtgtatgaatgttttgtttactgtaattagtcaaatatatatatatttatatataaggcaactctttaagttacaggacacatacaggaaaaaaaaaagcaatgctggctaaccctataaaattcctatatcaaaaccattctctgcggaaattgatgttactgaaacatagctaatgctgtgatctttagtaatgaactacagttattcccatgcaatatatgtgtggacaaatcagaaggcaagcaaacatggaagaagccatgtctgacttctcacccagacccctgatgccttgaccttcttgggctgagttcactgttaccacagttgtttgctattacaacgctaagcacttagtaaccaatgtaaaatgagatatttatgtctatgaatcttaaaactggatttctaagcatcgagtggtgtctgtctctgtctctttctgcctctctctctctctctccctctccctctctccttttccccttgtctttaaaccactttcccttaagccctcttgttaaatgactaggagttccatccatgctgcagtcctgtgctgggataacaggtggtacaaggaatggtgacaacaggcaggtttagggggctggccaaacatgtgtatgttcatatttggggacatgattctttaatcgaagtagactgaaggtgggggtggggttagaggagtcttaaggttggtgcacagcttgagttttatatttctgatgcaaaaggcacagctagtgcaacccatctcgttcccatgtcaccaggggaaaatgctactgttgtctttatttccagatgtgactttagctttgtagagtcaccaagtagtgatttttctgattttgaaaggtgtcagctgtggtaatgcaaaagtctaattgtgttctttccctttgtgattgcttcactaggatatcaagccaatgagagatcagattgtgagagtgaagagatacgagaaagtcccactcatcctagtgggaaacaaagtggatctggaaccagagagagaggttatgtcttccgaaggcagagctctggctcaagaatggggctgtcctttcatggaaacgtcagcaaaaagtaaatcaatggtggatgaactttttgctgagatcgtcaggcaaatgaactattcatccctgcccgagaagcaagatcagtgttgtacaacttgtgttgtccagtaaaaaagaaaacctcagccatggccataccgagcaggttagtggtgggactctatggaccaagggctcttttggtt

SEQ ID NO: 39 - DNA, 293 bp, mus musculus
tccgcgggaccctgggggcccagagaccccgccccagcgatagcgagcgagcgagcgcgcgcgcgcgcgcggcggggcccggaggcttcgggccggctcggcaggcagcggcgccggcaggaagcggggaccccgggcccctttgtgtgtgtgtgcgcgcagggcgggggggaggggtggcgggcagcccccggccgccaggcccccgccccttcccgcgtgggggtgcgccgcggctccccccaaccgtcgctcggacgctcgccggcgcgccctcctccccacgcccccca

SEQ ID NO: 40 - DNA, 375 bp, mus musculus
ggggcccggggtccccgcttcctgccggcgccgctgcctgccgagccggcccgaagcctccgggccccgccgcgcgcgcgcgcgcgctcgctcgctcgctatcgctggggcggggtctctgggcccccagggtcccgcggagctcgtgtgacctgtaacggggggggggggggaggggaacggggaagagggaagaaggggacgcgcgttaggtgttgcctgacctccacgctggcgcccgcagccgccacctctgccgccgcttaccctgctgtcctggccacacgctcccagccgcccgggaggctaagtcaagccaaggccatggccaccgggccgcccgggccctgctgctagcggaaggacggggaaggg

SEQ ID NO: 41 - DNA, 33608 bp, mus musculus
cgggccgagagggcgggccgaggggcggagcctggccggcagcgtttctgagccattgctgaggcggcgagggagagcgttgggcttacctcactgctttccggagcggtagcacctcctccgccggcttcctcctcagaccgctttttgccgcgagccgaccggtcccgtcatgccgacccgcagtcccagcgtcgtggtgagccaaggggactccagcagagccccacagccgggccccatgcgcccggtggcacagtgacgcaggccggagccctgaggctcccgaggcccgctctgggcgctggggcggccgggactctttgatggcgggggcggtcagggattcctggagtctggctagatgccccatgagggcggcgggcaggacgggatggcggggttcgggggtggggatgcccctccagtgagccccgacagagagagagggcaggctgcgtgtggaccaggaaggtggcaatggcgttggacttgacatgtgcggccggcggacgcgcgcggtggcaagcggcggagggcggcttcaggaaggatcaggcgcggggagggcgggggagctctcctgggagaggcccagctctacaagtttggggtttggcggccagggaacacctctagaaggagcttcggttcccaagacgaccgcatgagagggcatgttcaggcctggactttgcccctaattctgcagatgccataattcatatttgtgggaatgcgcaatcactccgttgaatcagcgctgcggcccaggcagtgaaaatcacgcctattttccacctgaagagtggaaaggcggctcgttttttgttttgttttgttttgtttttttacccccccatggcccagaataatgggctttggcttcagatacacttgacttgggagcccatgcccttggatgctgtgggaatttaaaaaaaaaaaaaagtatggatttggttgttacgttggatgacttttttccacactcatcttcagatatcctgccttttctcccattggctcaattttttctaacctgccaagctctgtctcccctatcaatcccaacgccataaccttgctgatcatgcttgctagaacatcccatagctcctgcttctgattaacgactttagcctgctctattcttattcttgcctctggtactccttaaatgtcatattatgctttatatactacagatttagcaggtatctggttacttgttggttgactttcccactcacacgtactttatcttgatgttttcaggcagggtcttactatgtagctctgtctggtctgtaattggtaatgtagaccatcaagctggccatgaacttgtgacagtcatcctgactcttgcctcccaaatgttgcatcactgagtcttgctggttttttaaaaattcattttagggaatgaacccttgttctactgggtaagcaagctctctactctactgggccaaaagccaggcccctaaacaagcctcagctttaggtatagcacaatgtctggtttgtggcaagttttcactaatagtttgttgggtgaattaataaccatttgagcccttaaaaaggtgttctctcatagtgtattagatattgtggcttaaggcaaaaccactgtgttcttaatgacccagaatcctgcttgcttagaatatgttctatgtggccttcagtatcttcacctagactgaagcttccttttcagacatttcttcctgtgcaaccattgccctaagtagaccaggccttgaactttcagccatcttgcttctacctcagtgtgggaattacaagcaagcatatgctatcaccaggttgtacatttttcttacacctgagatgctggctgctggtattgttaaaaggactgtaagataataaacaacacttatatagtccctgagtgggaatagcataatagccatcattttgtttacatatatctatccttattagttttcaaaataatcctgtaacaaagggcatgttcacattatcagacacaagttattaagagggtagagagctcccctcaattatgtactaaaccctagttttgatcaccagcaccagaagcaaggatacattttagaaaatggagttctgtctcaattcttggtctgtgtctgaggtctatgcaaataaatactatggtaggattcagtagataatgtagtaggtgctacttttattcggatatggctgcttttaagcttggagatatggtacttgttcagtgtagagttaattagttctttgtgctagaagtggctattcttagttttgtttgaacattaagaaattcacagtatttttagtttgtaaattcctgttcctttttttttttttttttgcttccttcccctaaattgtctgcatgctaggaataacaaacacttaaaaagtgcttactacatgctgcttgctcttctaagcccgttagcagatttgacttcttttatttctattttttttcctgtatatggctgctttgcctatatgtatgcatgtatgccatgtgcttgctttggagtccaaaagagctgccataggggttatgctcatggattggcaggatcaatatagtaaaaatggctatcttgccaaaagcaatctacagattcaatgcaatccccatcaaaattccaactcaattcttcaacgaattagaaagggcaatcggcagattcatctggaataacaaaaaaactaggatagcaaaaacctaggtcccctgaagaacaatacgtactctgagccatccttcaacccctacttgactccatcttttaaaaaaattacacagacaaggtaaataacttgcccatatcagtcagtgctaccacatttgaacctgttaatctggccccagattctacccttaaccagtagacttgttaggagctacagtgaatgtttatgaaatacttgttctgtcttcagcaatgacaaatgttttgtggactttacctaataccaataagttacataataagtgccccttgtgtagatgaacatgactggggtgatacaaggtagaggaagtaaatataagctacattactttcatgaaatgggcccctagatatgcttgagagctacaaaaacgtgctgcttgtaactatcagtctagaaaaggcttctggcttcttacaaactaatgtgaaacatcagatatgttttatatggtatacacttgaacttcaaaatagcccagatgaaagtataatatactaactgaacttaaaccttgttaatgaatttttcaaaatttatagtgtcttgagacaaagacacactctgtaaattaatgtggcctgctggccttaaactaacagtccttctgccttagtcttccatgtgctagagttacaatcatgagccaccacccttggctcagatgatttttttgagatacatactctgtagttttaggctggtctcctaactcactttgtgagaataagagacacattctaccatgcttggtatgctaatgaaagtgaatctgtgttttggtgatctaacttgaggtcttgtgctaataagcatgtttcaccattaagctatacctttatctatctgctaatttttttcagtttttaaagatttcttgttatgtgtatgagtgttttgcctgcattatatgtgtgtgtgtaccattaggatgtctgtggatgtcagaagaaggcatttcatctcctggaactggagttacagactattgtgagcctccacgtgggtttggggaactaaatctagatcccctgcaagagcaagtacttttataaaattaattctttttaattcactttatgtcctgatcaccctccctcctctctccccagtcctaccctaccatccttacaaatccctccccctccctcagagaaggggagcccccactttgctcataccccactctgggcatctagtcccagcaggtctcccacggaggcctaaccaggcagtctaagtactcctaaccattgagccgtctttctagcccatggttttttttttctctcagaattggttaaatattgtagtttttgcctaacactattttattattatcaatggtgtctaaaataacatccatttataaataagaccaaaatgaattattttgatcaccaaaaaatgggaatagtccctcttagaggtttctttatgtaaattttatactcttgttacctctgttatatgtctatcttatttggataaaaataatctggattattgtagcaggtgggaaaaagacttaattatatcagaaaaaagatgccttacagttttattattgttttgggtggggttctttttgtgagggattagtttactttatttagtctgggatatattttctttatataggccaggcttgtctcagactgggaatccgttttagtctcttaagtgttgggattatgagcatagactgctatgcctagtcttgtagtttttttttttttttactttgtaaattttagatgaaagaaaaaacagctaacttattttattaatgactatcatgaattgaattttcacttttttatttttgtgcaattggtagttcagagacctttacagtttttttttaaatttcttttccttttttttctttttggtttttcaagacagggtttctctgtatagccctggcagtccttgaactcactctgtagaccaggctggcctcgaactcagaaatctgcctgcctctgccttccaagtgctaggattcaaggtatgctatgagtcacaacacttgacaaattaaatggaattatatcattttccccttcccttttctccctccagttcttcccatttgcccaccctagaatctttttctttgattatcattgttacctacacatgtgtatgtatgtatgtatgtatgtatgtatgtatgtgcacatatacttgtttgtgtgtaaatgggttcaaggttgctcactccgcaatggatagccaaaaagggagctcttcctgggcgtgactaattcttctcacagttgtcattggttgcctgtagttctttgtctaggggtgggaccaagagaaatttctcaaacctggaatcctcctgccttagtctcctgactaacttgccttagttgattctgtaattctctgatgtagatccttaggattaaattcagattaagtttggcagcaagttcttttatccaccctaccgtctcagcagcctgagatgggatctggctgtgttgcccaggctagccctgccttaattttccaggtacttaggactacaggtgtatcaccctattcccagtggaatgtgttttattccataattaattagattaaacaatggtccatgtcatttttctcccctatagtaaaggggtattgaaattgtgtttgttctgtctttctgtaattttatgttaggtggatttactaacattgatagatcacatagaagtgttaattactaccagtaatagtaatattgagatacacttgttattttcctgttgaggactaccaaaataactaccatttaaataatttgttactagtaggaattcagacacttcaaattgctttgaaaactactttcagttttttcttgctgtttagtgtcaaaatatctatgattctactatgcatattagtaaagggaaagattttttttttttttttttttttggtttttcaagaccgggtttctctttatagccctggctgtcctggaactcactctgtagaccaggctggcctcgaactcagaaatccacctgcctctacttcccgagtcctgggattaaaggcgtgtgctaccaccgcccggcaagatttttttttttaattcatgtccttacagatatggtagttacaggcctacttgcctagagtggttataacttattcctgggctgagtagtctactaccttattttaatttttcttatagctttaacccttggaaaggaaacaaatactctatgtatgttatttgtaggactgataaaaaaaaagaaaatgaacatagtaccattttaagttgttttcatatttaggagtatctatcaataaattataatttttgtttaatcatatccagacataatataaattatctcaaggatagcttatcatctgctttttttgagattttttttaaaaagttttatttgtttttgaaaaattttaatatatttgaattaagctagtgtctcactgtgtagccaagaactagtagttttctgtctcagacttctaaatgctgagtttataggtatgtgccaccatgcccagcacaaatccctattataaaatgtgcacatttgtaataatggcaatcacatgaaagacaatccttgtgatttacacataaaatttcctgttacacaggtacattatcagaaataatatgaaaaaggaaatgaacctaagctaatacgacctttggaatgtcaggttattgtctacaatttggattgtttaagtctctttatagtaaaatataacattgttcatgagcccaaacaagactccattaaatggaagtgagtcctaaaatgactacttgggagacagggggagaaggttcagctacatagtgagttcaaagccagcctgagctcatgagactgtctcagagaagaaaactattgtgaattaagagttgtatagtaccaggcagtggtggtgcatgcctttgaacccagcacttgggaggcagaggcaggcagatttctgagttcgaggccagcccggtctacagagtgagttctaggacagccagggctatacagagaaaccctgtctcgaaaaaccctccaaaacaaaacaaaaaatccccaacaaggacaggaagagttccaagccagcccgggtcacatagtgttgagacaggaaagggtgtgtgtgtgagagagaataatagatagtagaaaaattgttttgaattttatgactagtaatcagcatgttcaaagttttagaatggacagaaatgtgaccgtcacatctgtgcacctgtgttcacacatgcatgaccacataaatacacacacacacacacacacacacacacacacaatctcaagtgaagagttgtaagactttttgcattttggagaagaattatgttgatatggctttaataaactgggtatgatggttcatacccataaacccatcatatgagaagccgaggcagaaagattgccccgggtttgaggatagcttagactatgtcgtgagattaagtttatggtgtactgcagagccaaggcaatctgaaatcagaaacaaattttttaatgttaaaataactataagcatttcagaggaacaaaacaaaaattctcagatatgaatttgttttaattagaaatcaagacttttgcattggtgtgttgatggaaatagaattcctatttttgagtaattcctgatgtttgtattcttagactacttgggtgcacatctgtaatcccagcactcagaggcagagggaggaagatcatagcaagtttgaggccaacctaatctatatagctagttccagtacagctagagttacatagtaagaccctgtctcaaacacacataaaaagactgggatgaacttggcagagttcacattggatttgtctttaattgaaacagtctttgaagttcttaggtaggttacctgtagaacctgtaaccaggcattgagctattttagtaggtgcagtagtctgatgaaacctgggtgtgataggcttaaggcagaaacagagtgagtgggcagagggtatgagaatgcctcaggaaagtcattgtggtattctaattttgattctaaggtactttgaaataatccagctttatttttgtcaggtagtacataagttctcatgagcctggcctgaatatttattgttgttatcttataaaattgagcagtctgtcatctttccccaaaacatgaactaaaatttgctttatagaacttacaaaaatgctttttttgtaaaatactctttgaatattcctttgtatgatacaaatgcccaatttctatttttgttactaaatgtcctaatataaatattaagtgaatgttaagcaggtttttttagctctctaattttttaaagaaattgccataatgtttcacaaatttttctgattatgaaaaaaaatacatgtgtatttaagaataaatcagtattctgcatgctgcaggttcttgtgaacagacctaaaaataaataaaattctatcaaacattgagctcaaaatagaccttttgtgactaaacagagagacagacagactatacaacttttaatttttttctctgggagaaacctcaaaatatatctgaattctgagctgggtgttgacagtcccagtacttggaaagtagaagaagggttgtgagtttgaaaccagcatgagctatgcaatgcaattccatctcaaaaacaatggcaagtgaattctgcaaagaacgtaaacttatgtaattttaatttttttcaaagtcaaaccacttgtgacgaaagcacctaataaaacgttaactgaaaggaagaactctgtatgaattcacagatatgatgaaatttagttatgatttggccaatattccttgaaaactgccagagcgtagacaaccaggtcttgtagtctattcggtttagaggattttttgggatgggggcaggagctctctatgtaggtcaccttggcctttaactcgtgattatccctgcctttgtacccgagtgctggcattagagatgtgtgacaccatgtgcagcttgatgctttagttcttacaacaccgtgccagggactgctgcttcttagatggggcttaaaagttgggaatgtcatgtaagattgagtagtctaattcttcctggcttatttctctcaataagtttttttaaaaagatttttatttattattatagataagtacactgttggctgtcttcagacacaccagaagggggcatcagatctcattccagatgattgtgagccaccgtgaggttgctgggatttgaactcaggaccttcggaagagcagtcagtgttcttacccgctgagccatctctccagcccctctcattaagttttgattaatagattaacttatgatcttttaagcttttcttgtagtttagtttttgttttgcttttagtgtaaagagggctggagatgagcttggttgctggagtgcttgcccggtatgcatgaaaccctgggtttgacacctagcatcgcataaactgggtgtgatatactcatgctcataatctaaaagaaggagaagcttcagaagttgaaggtcaactgcatagtgagttttaggccagtttaggatccatgacacccccccgccccccatatctcactataattcactgtcaaatggcttttatgatttggagtttggggatacttttaaagacagggtcttggtagctcctagatggcttgggattcacttagtaacccttgctggcctaaaattcaggaacttctacctcatcttcccaagtactgggttagtagggatgtccagcatatttagcttgctttaatgattttgctgtacttttttctgtgtgtacaggtgcatgtatatttataaaactaacataatatattttacccccaaagtaccataaccctaattaatgctattaaatgttttgtatgctgggctctgggcatactaatataaccaatattatacaatgcaaaacaattttggaatatcttctgtaaaattatcttattagtaagttgtaaccatctcagacttctaagtttgagtttgtaaaggatcagttttttttggtgacctacacacacacacacacacacacacacacacacacacacacacacacacacaggggggtggattctgagaatttagagaatttagatggttaataccagtttttatttttattctgtgtgatatttatttattaagatttatttatttattacatgtaggtacactgtatctgtcttcagacacaccagaagagggcatcagatctcgttacagatggttgtgagtcaccatgtggttgctgggatttgaactcaggacctctggaagaacagtcagtgctcttaaccgttgagccatctcaccagccccgtgatattttatttaacttactagaatatactgtgttaaaacatattttaggggattggggagatggcccattctgtaaagtgtctgccatgtcatcttcaggacctgcgtttgtaaccccagcatggagaagacagagacagggagacccctgggcttcctggcaagctagactagcaaatttggttaactaggttcaatgagagactcagtctcaaaacataagaagtgaattttttagacccaatttcaatctctgaactccatacgtatgcacatgtacctgcatataaatatatatacacacccataaacacatgcacacacaaaaaatggttcaaaagttcttaaaatgtataagagtagaaagtgtagagccgggagtggtggcgcacgcctttaatcccagcacttgggagcagaggcaggtggatttctgagttcgaggccagcctggtctacagagtgagttccaggacagccagagctatacagagaaatcctgcctcaaaaaaccaaaaataaagtgtatatactaatctttcatgcctaaaatatttatttttgccacatttttcatacctctttaatatttttctttttctctttgtgcttcaaaggaaattttgtgtcatgttttacttttcattcttgactctattcagcagtaagacgcagcatggctttcttagagaagtataatctattacaaaacggtaacatttaactgctctacataccctcttgtagctaaattcctctgttaaactaagacttattatctaaacgtaattaaatgttgatatcttataatgctccactttgaaacagctgtctttcttttgcagattagcgatgatgaaccaggttatgacctagatttgttttgtatacctaatcattatgccgaggatttggaaaaagtgtttattcctcatggactgattatggacaggttagtaagacctcgattgaagttatttttagagggtgtgtgtgtggtgtgtgtgtgtgtgtgtgtgtgtgtgtgtgtgtgtgtgtgtgtgtgtgtgtaagagagagaggagaggcatgtgtgatatatatgtgaagtgtattgcatgtacatggaatccagagaaggacattaggtgtcctactctgttgctctcttattcccttgaatcagtgtctcttgctgaacctggggcatacatactgatttggctaggctgcctggctagcaagacccagggatctgcttgtctctgccccccagtgctgacgttacaagcaggtgcaaccacatctggtttttatatgggtactgggggatctgaacttagggcctgatgcgtgcccaagtgctctcacccgccaagccacctctccagccaaagggttttttttcttgtattaattctaacttagcaactgttgagtagttgatgtttgaatataagctaagccaacttattagaataaatgttttctattttttacttgtatgtgtgagtgcctgcatgtatgtatgtgaagcatatgtattccaggatgtcagaattgtgatggattccctggaactggagttacagaccattgtgaaccactgtgtatgggtgctgggaactgaactttaggtcctctgcaaaaacagtaaggatcttaactgataaactatctttctagccctaaggctttctacttttaaagttcgtttctctttctctctctctctctctctctctctctctctctctctccctctccctccctcctcctcctcctcctctttcccccctctcgcctcctctttctctctcccctccctctctctctctcacacacacacacagacagagagaggagagagaaaggaagccttactaattaattacctagttttagacataactagtgggaatccatagtaagtaaatcaacattcttgaagagaggttagaagaattggctctcgttgtccatcgaggctgtataagattattcttctgttttctcagcttaccatacatattttctacgtagacaataccaattcaaatacactgtacgtaaagtatatgcgcacacacacacacacacacacacacacacacacacacacaagttacatattgtcatatagtactaaaatttatggactttttcatattaatacatctagagctatcatgttttttatcttttaaaaattactttacggggctacagagatgtctcagcagttaggagcactgactgctcttccagaggtcctgagttcaattcccagcaaccacatggtggctcacaaccatctgtaatgggatctgatccactcttatggtgtgtctgaagacagtgacagtgtactcatatacatgaaataaatctttaaaaaattactttaccatcagggtatatatatatatatatatatgtgtgtgtgtgtgtgtgtgtgtatgaagtatttgctatttgagagggtctcactgtttagctcagtctggcttggaacgttctgtatagcccagactggcctcaactcagcagtccccctgaaaggctctcatatgtggagattacaggtatgtgctactgtgcccagccctacatgttactttgtttttgaaatagggtatcaaatagcttagactggcttctaagtcagtgtgtagctaaggatggtctgagcttctgaacctgctacttcaactcctggtgtgccatcatggccagtttgcacagttgtgagagtagaactcaggacctcctatgtgttactagacatgttctctaccagctgagctacatcccaattcgcctacatttacttttattttttaaaagatttatttatgtatacagcactctgcctgcatgtacatctgcatgccagaagagggcaccagatctcatcatacatagttgtgagccaccatgtggttgctggggattgaactcagggcctctggaagagcagtcagtgctcttaacctctgagccatctctgtagccccctacatttattttaaagattataggctattctattcatagatgtgccataactgatttaaccagatcttcattattttgtacttagtagagtatattagagggaatgaatcttaaatacacattttgacacttgctcagctttagacaagtaaaaatcactggtcaaggaaatggtgcttagtggatgcttctgaactgtcaaattgtcctccaacaagttacatcattttatacttccaacgttatgtgagagttcatttttctttaggctcttctagtattttatatttgagaaataaaatttaaccaaaatttgccaatctagtaagcttgtttttatttgtatctttaaattttatgatagatgttatagtgtactctcctctcccctcccctcccctctcctcctcagcaggatcttgttatgtagccctaagggatctaatacttactctgtagtccaggctgtccttcagctcatgagacacaccatcatgcttggcatgtttcttgttctgaaaggtatctggttttaattttggttgagctggtgtgttggtgtatatctgtaatctcagcacaggcaagtagagacaaggattatgattacagtccagcctgggctatttagagggattctctttaatctttcctcatgccccaaaatcttacctttggtatatgaaaaatagtctccacttctgcaaaatattgctttatgaagtaagaattcccttcatagagacaaggaatgtgtcctgtaaaagtttaatgtgtaagaagtatttgttataaaagataaatattcagaatcttctttttaattcctgattttatttctataggactgaaagacttgctcgagatgtcatgaaggagatgggaggccatcacattgtggccctctgtgtgctcaaggggggctataagttctttgctgacctgctggattacattaaagcactgaatagaaatagtgatagatccattcctatgactgtagattttatcagactgaagagctactgtgtaagtataattaacttataattaaaaaaatagggccattctagttttatctatatttttttaaacttgtgcaaactatgctacataatcaacttacttgattatgtaatatatatagtaatagttggaattactattattacatatttatttttctgtgctggggtagaacccagggaactaagtactgtaataaccgagcttcattcatcctagtcatttttaatttttttttttttttttgttttttcgagacaaggtttctctgtgtagccctggctgtcctggaactcactctgtagaccaggctggcctcgaactcagaaatctgcctgcctctgcctcccagtgctgagattaatgacgtgcaccaccactgcctggcattttttttaaagttttaatttgagaccctttctcactaacttgctcacactatcctcgaactcattacgtgggctggtctagaaatttcagtcaacttgcctcagcttctcaagtagctgggattacaggcaggtgctaccacttctggccatgatcattgttgttgttgctattattattattattatttcactgatacttcatatcacaacacagaatagtaactgtagttcatgaccaacaaaaaagttgtacagtttctctgttgtcttattttgatctggattttgatttgtttcatggcactgggcaggctaatctcaaactgcatggctcaaatagtccttctgtcttaatctcccatgttctggaagtataggtatcactacacctagctgtattttcatatttaaaaaaaaacgcctaagaattgctattgaatgaggcggagagatggctcagcagtcacaagtacttgtagaggactggggtttggttactagcacctcaaagatggcttacaattatctgtagctccaattccagaggatctgtgtggtaaagctgcatgtatatgggcatgcaggtaaaactgctaaacatataaaaatagctcagtcttaagagaattctaggcctggtgaggtggctcactagtcaaaagcactggctgctcttcagaggactcaggttcaattcctagcacttacatagtggctcacagagtctgtccctttagtcccagggatctgccactctcttctgtcctgcaagggcacctggcaatcacataggaaacaaacttgcagcagaaacccccatacacataaaattaagaaaaaaagaattgctattgagacttgatgttttctcaactgtgtatgctggtggcaaatactctcactggagataattgctctgagaggaatcctaagttatttgaagcaaagccttaattattaaggttaatgattatttcttggaaatcagaaaatacttttggcctgggaccactttacctttgccagagtttgaaatgatttagagtattgacagtatgatgaaacaaaataaatgtcatctttatatgtaaaaacttcaccattcacaattatgatggtatagtttgtttcttcctttcctttccttcccttcccttcccttcccttcccttcccttcccttcccttcccttcccttcccttcccttcccttcccttccccctttttccccctttcccctttttccctttcccttcttccccccttcccctttcccctcttccccccttccccctcttccccttcccccttcccatcctttgactctctgtgcagtcccagctgtcctggaactcactatgtagaccaggctagccttgaacttagtgattcccccccttcaatcccagcactaggagtgcaccatcactgcctggttaaaatatgtatttattttaaaattaaaactgcagaaagttatagaaaaaaaagattgtctttccaaagtctactttttaaaaaatagatataattttattttatgtttctgcggtttttttgtgcacatgagtatatggatcatcttgagtgcctcatgtctgcagaggccagaagaatacatgggatcccctggaaatggagtttcaggtgtttgtgagtcaccatgtgggtgctgggaactgagcctgggtactctatgagaatagcacatacttttaactgttggaccatctctctaactcctgtcatcactttttattttgaatattaagagttttctctatatatacatgtccccacatacaactatagcttacataatcagtattagcccaggaggtatttaacaatccaagtgcaaaacagcctaaggagtccaaatatctattttattaaatgaaaaagtccactaattaaaaccactgtatttgtgtgcttttaagaaagaaactacctccagttatagttgtatggtgccatgaattatgatgtttacagaggtagtaaagtatgaatgttcatcttcaaacagtgaaatatagtgttatatatttggtgacattttttctgtccctagtgctctgtaactttcagaaaaatgaaacatttgataagtacacaaatgtgtcctattttgacttttatttcaattttataaaattctaaaatcgtcgaagaacaaaactagaccttgagagaaagggttgttagtaaacaagtaatggtttttaaaagatttattttattttatgtatatgagtacactgtagctgtacagatgattgtgaaccatcctgtggttgctgggaattgaactcaggacctctgtttgttccggcccagcttgctccaacccaaagatttatttattattatatgtaagtacactgtagctgtcttcagactcaccagaagagggcgtcagatatcattacatatgtttgtgagccaccatgtggttgctcaagacctgtggaagagcagtcagtgctcttaaccgctgagccatctctccacccacaagtaatgttttgagttttatttttaagtttgtaattatttgagtgttggatgaatctaaggtcgtgaatatgctaagcaaatatgctctaaatcctgagctcttgtttctatttagaggttgccagaaatcctagtgatggaaaaataggaatacaacttctttcttgtcactcccacttttccatctagactctaagaggtagacaaagtagaaagaaacattacggctgtatttatagaaacctgagcttctggggaaaatatatataaagtgagtgttttgcctgtatacatgtctgtgtaccatatgtgtgcttgaagtccacagagggcagaatagggtgtctggacccctagaatatagttatagactgttgaaatgctggatgctggaaattgaacctgggtcttctggaagccgttgctctgaaccaccccttcagcctcctctggggatttttggtagttgacagtagtgacacctgaatgaaggatgtgagtatactgtagctgtacagatggttgtgagccttcatgtggttgttgagaattgaatttttaagacctctgcttgttccaggcaactctgctcactcaggccctgcttgttctggcccaaagatttatttattgttatacataagtacactcactgtaggtgacttcagacacaccagaagagggcatcagatctcattgtgggtggttgtgagccaccatgtggttgctgggatttgaactaaggaccttgggaagagcagtcgggtgctcttaaccactgatccatttcaccagcccatataacaactattaaatgaaactttttttctctttatagtgtccctttaaaaggaagctgtttccttaacaaaaacttcagggaagcataagctgaaacactgaatgggactgtggaaacgtgaacatcttagcgtgcaagtgttctgtgtgctttggagttctgttgcctcggaccctatagcaatagcctttggatcacacttgcattcttagatatttattccttatgtctgtcctttgaaagaggaagtacttggcattgggctgtaataccatttttctacagcaggtgtcagtatttatcagggtttgttattactatgtagcactcagtgtaatgccatcttaactaggttcaggttttgtacagttctttttctttgtgtcattaatcagttgtgtgtgtttgaaattctgagttttaggctaaactagtttaaattaaaaagccaacatttagtttacagcttggactagtagtattttttgtttattttgttcttctccactccccttaaacatgctaggtaaacattctaccaactgagctatcattttaaaaaaaaattttgagatagggttttgaataccgaataaaaatagttttataggtagtatatttgtctgctacttggtgttactaattagtattgatccacataagaatatattagattgtgtcattctttgtaatagtttcatagtattatttatgtgtattaatttctttaagtaattcccttttaaagacatgctgggtttttttttgttttgtttttgatgactacctgatatagtgaacatttttgaatgtttcccttgcatgtttgtggatatttttgtaacactgattcttggaaatgggattgttagatcaaaataatttgcatgtttataattttaataggcattactatattttttcaaaagaggtcatattgctttctgtaatctaaccagcagcttgagtatttgtttctcctgaatgtattatcaggcttaattgctgtaaatgtggatgaatgaacagtagaatcacatgtagaatctgtcaggtggccatcagttgtctatttgtattctaatagttcttttttttaaagagatttgtttatcttgcttcatgtgtatgtgtgaatgccagcatatatgtatttacaccatatggatgcctgatacatttgagctcagaagaggggatcagatcacctgaaactggaggtataggcatatgaactgccatgtgggtgctgggaactgaacccaggtccttggcaagatcagcaagtgctattaattctgatctctctcctgtcccacctggtaggttcttattttgagcagaatttacattaggaatagtggttacagatctttttagttggagttcatgactagttttttatcctttctaagaatacaggggaaaattatatatattcctgggggctgagagatggctcagcagttaagaacactgtctcttcttccagaggtcctgcgtctgggaattgaacgaattcccagaaaccacacggtggctcacaaccatctgttatgggatctgatgccctcttctggtgtgtctgaagacagctacagtgtattcatatacataaaataaataaatctttaaaataaaatatattcttacattttcttctaatccacttatagttctattttttacatttagattttagtccatctggaatttatttttgtgcatggtgtgaggtaggaaccatgctttattttttcccaaatggataagtaattgaccaaataccatttgttgaataattcatctcttaattactgactcaaaatatcatctttgtcatatactaaattctcatgtttttgggtctgtttctggattttattgggttccttgaactttttgtcattcactgtgctggttctataccaagctaattgctgcagtttttggtatgctttgctgtcccagtagagtaagtccacactcttttaatcatcagttttctgatttaataccagcacatccaaattatagctattcccaccaactctagtgagtgttaatcactctcctttgaaacctctgtaaggttttctgctaatttctctacaagcagaaagtgggaacctaagaaggatgttctaatagactagtaatcagacctggtttctcagacagttctgaagatgacctggatatgggcatatccaggatatggacatattttatgggcatatcttcagggttgaatgtgatatagaccagctcctacacttgtgtgactcacaggaatggttcagggccagaagcagacacctgtcatgctaataaattgtcctttgtagttgagaagtacctgattgatgagtagctataatatgcccactcagaaatagatgtactctagttttagaactcttcagagcctcaaatactagtaatggtcaattaagatttttaatttttactaatctctatgtaaaatttacctagtcattcatttctagaaacctaattcttatactttataatttagaatagcataattttgtggccattagatagctaactttttaaatcttatagcttatatctaataatttgagaagcttatatatatatacacaagaatttgcatttaagtgatgttcttttttcaactagaatgatcagtcaacgggggacataaaagttattggtggagatgatctctcaactttaactggaaaggtatgtaacttgaagaggaaagaaagaacatttttataccaagaaacattagtaactgctttcaaccacttacttagaggtactttattagtaaaagtaagctggtattgtttaactcttagaagtacttgatatagattaatattatctcctggactttatagccaaatgacagcagaatataccattaaccctcacagtccatattgctaattactgctttattttggttttttcgagacagggtttctctgtgtagcccaggctgtcctggaactcactctgtagaccaggttcgcctcaaactcagaaatccacttgcctctgcccccaagtgctgggatcaaaggcatgcgccaccactcccggctttaattactgctttctataatactactttgaaactctaatttgggatccttcagaaaatatagctggagagggacagtcttttttttttaatagattcaaatgtagtttcatttgaaggtgtgtgtgcgcgcacacatgcttctctatgtgtatttgtttttctaagacacagtcttacttagagtctacaccatctttgaacatctcttatgtaagtcaggttggccttgacatggtggtcctgcttcagcctcccaaatgctgggattgcaagcataagcccccatactagactgtgtatgttttctaagcggctggttattttttacttgtaggcactgtgccatatataaatgtattaacctggttactttcacagtaatctagtgaaggcagttatatttccattttgcagatcaggaaatgaaacaatacacttacagtttcaaaaactccttgggattatgagatgtaaacaatctctcgaagtcacgcaaccaggaagtagaaaagcttgcatgctgacaccaaattctttctttcctctagcttttaggtttagtgctcactgctttcttgcactacttactcactactcactacttccttcactgaaactctgtagggaactttaacataaaatgctggtattctggaggcctgtatcagggtcacgccaaactaatgtcgctgtcagcagtgtttagaacctccaggggcgaatttgtaatctgttcgttctcgctctctgcctctctgctgtccatttggtgtacaactgccagacctctttcccttttagcatggtttgtccatatttagaagctattcgaaacctgcccttctataatccgttttcggggctggcaggggcctagccttcgaagcctgctgggatttagtttgaccttcttcacctaatggctctgtctctacacagcgctgtgatcttaaacagagctctgcttctaaaataacttctcagagcagccacaatagattctttttattgtggaaaacatcaaggaatacaaatttagtaaagttaaatcttgatgatgagattatgggtttatttaaaacattctaattttttgtggaaatttatcttatgtgtatgcaagtacagacataatgcacacattttcccattaatacttgaaacggtagtctttggatccaaaataacctttattcaaacccctttctcttgcccttctcaatgtttactactttaggtagttcatttgactactcagcctcattgtttccattattaagtagacatgtagctatttgacaaaataaactctcagtggtagcagttctctctctctctctgtattagaacaatagtctttaaaatgtcccaaatttttatatctttttaaaattttctatgcatatcctgacctttattttttgaaagatttacctacttatttaatttatttatttctatgtatgtgagtacactgtacagatggttatgagccttcatgtggttgttgggaattgcgttttaggacctctgctcactccagttggtcctgtttactctggtcaactccatttgctcggtccctgctcactcaggcccagagatttatttgttactataagtacactgttgctgtcttcaggcacatcagaagagggcaatggatcccattacagatggttgtgagtcaccatgtggttgctgggaactgaactcaggacctcgggaagagcagccagtgctcttacccactgagccatctcaccagcccctgacctttactttaaagtggctttttcctgcctatagaatgggatgcagttgtagcttgtttgccagaagttctgggcttacattcttagacctgtatagcactgtaagatactgccttctatggtaaactactttgaaacatggacatattagatgtttttcttgattataatttccttttaacgcacagctttgattctccaaatgatttacccacagcatatgtatttttaaattacacttgagttttggtagtaatttatcttgtaaagtacttaaactataggctaaaggagatgaagtatgtctttagttactttgaatacacacaataccaaggcaacttataaaagagaacatgtaattgggagcttgcttacagtttcagagggtaagtctgtaatcatcctggagggtagcctggtggcaggcaggcagcatgacactggagcagtatctagagcatacatattacatgcacattggatgcagagagtactagagactagacccggtgtggcttttgaaatgtcacttttgaagcccattcccagtatatgcctcccctaacaaggccacacctattaacccttctcaaaaacagttccaccaacaagggatcaaacattccaatgtaagagcctatggggggaatttttcattcaaactacaaggtgagaaagaattttgaattttcatggactccaatggaggctatgtactctaccttgataatcactaacttaaagtaataaagaagacttggcaattctgatgttatggttgtttggcagagtgatttgagaactatagactaacagtataaaataaatctgtccagtgagtattgtgggcatgtgaaatgtctgtcaccttatctctctaactagcaactcagaccaggcatgataaatcacaattgcaatcttactattcagtaggttgaggcagaaatggtgctgccagtttgaggacatttttggctacattatgagttctaggtcaacctgggctacagagtaaaattaactagaagattgagttggggttggggtgggtttaagggctctggtggatgtattgatatcttttcccagtttcccaaatacgcacacaaccatatactagttttagcttgatggagaaataaaaaatttgcattttatattatgttagatgcattattttaaaagacatttatacagattacagttcttggaatattagagtcaaaatacataaaaggagagctggttcaagtttttcagtttacatatgagtcactgagatcctgagaaatttcccaagtatgaatttgggtaatttcttagaatttgtttaatgatttcactgataattgggaatactgtctcacttcatatactaattttcatttctctgttttcttctagaatgtcttgattgttgaagtaagttctacgtttacttttaatatactgtctacaactttctaacttagtgtgtatggtaataaaggtaagtcgggggcgcttgtgttttctaaccctaagagaagccaggtacagtagggcatgtctggaatcccagatcctcaggaggctcatgaattcctgggttagcctgagttgcatagtgagtttaaagaccgagaaaatccttattttaaaaacaaaacaaaaagacacaaacaaaaaatatattttgtaagtgatgtgttttgctgctcatgaaaaaagttatatacttcctttttcagttttgatttttttcttttaaaactagttataactatatagagaagggtgtgtgtgtgtgtgtgtgtgtgtgtgtgtgtgtgtgtgtgtgtgagtgagtgtgtgatttcatgtgttaagttttattttatggaatgttacaagatttttaacatttcatctaaataatataaaagtatcaaatatttctggcaagtgagtggagtaaagactcaaaccgctactgtctggagcccattgcttttcaatgtgtaaaaaaccaaaagcattagccaggagcttatggattcagaatctttgtgataaaaaccatcaatttttgtttgagcaaaccttgagctgattccgatacatgctgagctttaagacccattgatttactcagaagaaaatgagaagacactgtctcattaaggccttctttggctgtcctacataaaaccgtacatttccatgtcttcatcttcctattcctttccatacttttttttttatcactgcctacatgcagactttattttttgcctgtggcttccctgtttcacatctgtctgacttgctgaactctatacatgtacgtctataccacagattgtggtcatcctcctaccttgactctattccccagttcttcaggatgcatcttaatagattctcattgtggcttcagaatatatatcagcttcattccccatcatttttcattctttatactttttgcatttcctagagcatcatttttctatcttcattttctgtccctagtagttgcttttcatttttgtaatctcttgtttcctttccactttttgtagtatttatgtttgtgcattgttttgtgtgtctgactgggtatgtatgtgtgtgcaagtatgcatgctagtgcataagaacagaggccagtagaggatgtgtgtgccatcctcttgcacttcctattctatgaggcagggtctctccctgaacctgaggctcacattttcttacataggccggaagctagcaaaccccagcaatcctcctgcctcctgtcttttcagacctgagttgtgatggaagcaggatgcctggattttgtgtgagtcctgcaatgcaaactccagctactatagttaaccactgagctacctctccagccccaatgcccctattttttttttaaacaaaagaatttttattctttcttttatgtgtggtgctagggatcaaacccagagcatgctaaataagtgctctaccaccaggcgtcacccttgactctttagggttttttgtttctttgtttgtaagaggtaggtaaatatctcaggctagactcttactccctccatcccacctgcctgtacctctcaagtcaagtgctgggattataggtatctaccatcatttgcgtctcttcttccctccctctttctcttattccatccctgctgtcttcctcccttccctccctccctctctcctttcttcttttcttcttttctcccttcagcatgatcttgtcatacaactcaagatgagtgtttttccttctatgagacctggtcttaatgtagcctcctcatctgtcctgggtctcactatgtggaccaggagcctaagccttctgaatgctatccattacaattgtgtgccaccatacctgccctccaagctggctttgaacctactgtgtaacctgtgctgcctgtgaactcataacctctctgcctcagcttttcacatgatggaattataggtgtgtgccaccattggttggtttgtatttctttttaagatctcttctcttttttcaattagttttagtctactgcattttgattatgtttgcgccctctctctactcctcccagatctctcttcccttccctacctacccaactttgtgtttctttatttaaaacccatcaacacaatttgtgctgctcctgtactcttggatgtgtgaccatccatcactagaatggtcaacccaccaggagacacatccttaaagaaagctgagtcctctagccgcagctatcaatgatagcttcctcactatgggtgggacatgatgtccacctcccccactccatgctgggaatttgtctgtctttgaccctgcacaggttgtgtgcatgcattctcaactgatgtcagttgataagtgcaaatgttgtactgtgacagaaaacattgtttctttatagttgtccaccacctctggttctttctctttaattaaaaacaaaacacctttgtgcttgcatgagtaagcatgacacagaatgcacatggaggtcagaagagcgctttgtataactgcttctctcctttaccacttacatggaatctagggattgaacttagctcactaggcttgcatggtaaaatgtacccacaaagccagctatctgggcgccgttcttttaagtaacacatctcatctccctccctacagagcaatcagtatccttcgccatcatttcttatttctttctcccccttctccactttctaaggtttattttttgaggacataggtgagtgggattacaccgtaattgccctttgtgtttgaagaggatctcactatttctctctggctgtcctggaacttgctatgtaaaccaggctgtccttgaaccatggcaggtttataaacacacacacactccacaaataaaataaacgtagctttttaaaaaaagttcatgtaggatgatagcactgtacagtttctggtgtgattggccagatgagggacaatttctccctgactatccaggggtagctctcaactacaaagatcatccctcaagtcctacgacacagccctgtcacagcatcacagctttttaaaccagcaggagagttaggtttcgagccctgatattcgttgtggtctatctgttttatggatttttatctgttttctgattttttttatggtactggagaatctagggcataatgggtgccatgtgggtgttttatcactgataaagtcattttatatagtaaaacttattacttagatgcttttaaagataatacaaagtgggctggagaaatggctcagaagttaagagcattgtctgcccttctagaggttctgagttcaattcccagcaaccacatgttgactcacacccatctatagttagatttggtgccctcttctggcctgccagcataatgcaggcagaacattatatacataataaatctttctgtaaaaagataatacaaagcaatgtttcttagagtatcaaagtttgggatgttaagagtccctatctttaatttacaaaaaaacctactatatcttttacagaattaaacctggtaatttatgcctgcaaccctacctcttaggagtctaaagtagggggatcttgagtttaaggccaccaacctgaactacatagcaagaccctgtgtgaaatacaacagaaagatttgtgtatgtgtgcagtgcttacatgtagacgttccatttactgtttttgaccttgccacatctatgcaatctagttctggggactgacattacctctgcttacttagagccagataggttacaagttccagactatctctgtgtgaattgtggtgagattttgtgtatactaaaaatgaatggcattgtgtcgtggaatactagaatattgcatttggaattgtatgtttgtaataaggatgattttttttaaattgtggtggttttatttaccattaaatgtctcttttctttttaaaaggatataattgacactggtaaaacaatgcaaactttgctttccctggttaagcagtacagccccaaaatggttaaggttgcaaggtatgtatgccactttaaagtagaatgctttccttatttagaatattaagtgatagcttctttgtaaggagacatgctttttcagctttcgttttatcattacagagtaatgtaatcttaaaactcaagacagtagcctttgtaattttattgtgtattaataagccattatagtcaattccttgtctaatacagtatatataaggccttggatctagaactacctcagatgctaaactccctagatgttcaggtccttcataaagaatgtcagatgagctgctgagatggctcagtgggtaaagtcatctgctgccaagcctgacaacctgagttcaatcctgggacgcatgtggtagacagagaggactgactccctctgacctccatgtgtgccacactcaagtaaaataagtgcaattgttaatggcaggagtgtttgcacagaatccatgcatactctcccatacactgtaatacctaccacagtgttaatacatataattacgctaaattatttagggaaatacatatctttatagtatgggttcttagaatattgtttatttatgtgtgtagtatatgtattatgtgcaggtgagtacacactcatcatgcagatatgtgaagggcagggcaggactgaatatcctgtactgccctttactctgttgcctgagacatggtctctaactgagctgtaagctcaaagttttagccatgcaggctcattggtgaggtttttgaatctatctctagccccagcgctggggtcacgaacacatacagccatgggcaactttttaatgtgaatattaggagtcaaactcaagtgcttgtgcttgcagaccaaatagtcttatccatggagccacctccccagtccctagaatgtctagtcttgatacacaagtttttagaaatggaactctcacatatatacagagctatgtaacaattgctgtttcagcatgttacttatatcaaatttatcctgagtgacatggcatatgatctgaggtccccttgtgaaattgaaataaatcataccaaggtagtaacaagtggtggacactgcacatctgaatcttctggattagagtggtgagtgaggcattctattttgtgttgtcactgaaattgtaccatgcttgcttcctttttctgaagtctcaaatcttactatatctgggtatttggcttgtgctttcatagttttctgtttttatccttggttatagtttgattctacaacagttgttatctccaccttatagataaggatactgaagcctagggaattgcccacagacacagagctaataagctatagagagaagatttgaacacagggaacctgtcacagttgatgcttctgctattttaagttgggttttgttgttaaaagtgacatcttttttgttgtgttgttgctattgctttttgctttatttttactttatagtttcatttttactttaatatctttgactgctctgtgctttttgtgtagaggagaggtcgggtcttttatttttgtcttttcctgaatgattaattggctcttaattttttttaaagactttacttatttatttattatatgagtacactgttgctgtcttcagacacaccagaagagggcgtcagatctcattacggatggttgtgagccaccatatggttgctgggatttgaacccaggaccttcggaagagcagtcagtgctcttacctgctgagccatctctccagctcccggttcttaatttttgaaaatttacacttatttattgtggcaggaatattggcacgtgccacttgcacttgtgttggtcagaggacagcctaagattctttctaccttgttggtcctgggtcggggtggaacatagtttggcagtcttgatagcaatagtctcatatacactgtgctatgtctgctgaccaattaaactagctttataaaatcgttttaaaagatcaaagtatctataaagtctttgaatctctataattttaataaaacttatttcagcaatttgtcttcatggactttttggatagatggcacaaatatacctcagtgagtttttgccatgctgaaggtgagatgtgcccagagaatacttgggtaatttttgatgatgtagttgtcctacgcaagtgtgttttggtctttccccaaactaaaaattaagtcttatttggtagtattgtaagatagcgtggtcactctagaaagcagttttttttaaaaactgcacagggaactaccagaagaccccagacgttgtgctgagtacttatccctgagaagtgaccatgttgctataaaaatctgtattggtttatagtcaggtatggtggttcacccctgtaatctcagattttggaaactgaaggcaggaggatcacactgaatttgagacaagcagcctgagctatatagtgaagacctgtcttctatctccctactcaaatacgactgttcacgtcatttgtgataatgcagaattaagaagaacaaaatttgaacaaatttgaagcacatttataccacgaaatcagcaataaataggaacagccatcaatatgcagcagttgagatgagtgttactggagctgtacagtgcttcaggaggacataaagcaggtgttcgctctttctgtttaaatgcttacctgtctcccagttttgatatgcccaagatttttaatttttttcaaggctattataatagtaggacaccaaaggcaaagcaataaaactgtatgattctacttatataaccccgtttgaaatgacagatgagaatggattaggggttaccaggggttgagagagaatacaggagggagccttgcatgagtcagagtatcttgattgtggtagtgattagactagtctctatgtgattaaaattgatgaaatctgtacaaggccgcttagttcaccaaggcccatgttctggttctgataatctgctgaaatacgacactagagacctttgtgtgtgatttttttttttcttttgtgacttcagtgaaaacaaaaataaaaattttgaaagccattaactttttttgggcgatattagggtttcaactctggttgtatgcatatatgacaagcattagataactagcatttaactttgtagttttatataattatgtaatcaaactacattcataaattcatgatttctataaataataaaggtataaatttaaaaataaaactgcttaaaacttacatttttagcaagagtcaagtagttgaaaatgtaattaactaaaaaattgagtgagtaactcagtggtcgagtacattcttaatgtgatcaaggctctgagttcagtatccactgcaaaaaattcccattggtgagccagttattacaagtcctgatgaaagagcatgtcttaccttctttagttaggattctgctctcagaagcatcttaccaggttccaggtggtgatcagtcgggggccttgaccttcatgtgacctctctgtgatttagttcttctccctttcagccttcctatgggtctgcgaagctgtccttattctgaatgcagatgatactacttaagaacactgatgttttctttgtaatgctctgtagtctttccatatgccacatgtaattttttgtaattaacagcttgctggtgaaaaggacctctcgaagtgttggatacaggccagactgtaagtagatgccctttggccaatcatttatccatcttataactgaaaaagttaactatgaaatggcttagggttactttagagaacatttgtgaggaaggtacatttgcaagaattagaattgaaagtattattttctctaaagaataaactatgattatttatttacagttgttggatttgaaattccagacaagtttgttgttggatatgcccttgactataatgagtacttcagggatttgaatgtaagtaatgcttttttttttctcgctctcatttttcaaaaacccacataaaaattgaggaaagggaagaattgttttctccttccagcacctcgtaatttgacccgactgatggttcccattagtcacataaagctgtagtcaagtacagacgtccttagaactggaacttggccaggctacggtgacacttcttgctggctgaagtagttgaacagctttaatatacaacaactgtcttattgttatttcacatgatatagtcataagtaagaaataaacgattcagtttcaattttgtaattgactctgcttcagatccctgcctcccattctggaggcaggaaggagtcttctgggtgagtttataagcatggtccaggagcagttagaaagtctccatgggcaatattacctaaagcgtattttttatttcacttacctgttttgatttcagctttatgtttctcaaagttacgtactaagacaaagaaaaagcaaactaatggactatagttctgctttgttttcaaattatgtcctcttcaagttgctggtccaaaataccttgtttggtagaaacccagacaacgtaggaggaccctttaatgctgttattacctctttagaatccgcttttctaacgagaatgtcttttattttatagcacgtttgtgtcattagtgaaactggaaaagccaaatacaaagcctaagatgagcgcaagttgaatctgcaaatacgaggagtcctgttgatgttgccagtaaaattagcaggtgttctagtcctgtggccatctgcctagtaaagctttttgcatgaaccttctatgaatgttactgttttatttttagaaatgtcagttgctgcgtccccagacttttgatttgcactatgagcctataggccagcctaccctctggtagattgtcgcttatcttgtaagaaaaacaaatctcttaaattaccacttttaaataataatactgagattgtatctgtaagaaggatttaaagagaagctatattagttttttaattggtattttaatttttatatattcaggagagaaagatgtgattgatattgttaatttagacgagtctgaagctctcgatttcctatcagtaacagcatctaagaggttttgctcagtggaataaacatgtttcagcagtgttggctgtattttcccactttcagtaaatcgttgtcaacagttccttttaaatgcaaataaataaattctaaaaatt

SEQ ID NO: 42 - DNA, 520 bp, mus musculus
ggggcggagcctggccggcagcgtttctgagccattgctgaggcggcgagggagagcgttgggcttacctcactgctttccggagcggtagcacctcctccgccggcttcctcctcagaccgctttttgccgcgagccgaccggtcccgtcatgccgacccgcagtcccagcgtcgtggtgagccaaggggactccagcagagccccacagccgggccccatgcgcccggtggcacagtgacgcaggccggagccctgaggctcccgaggcccgctctgggcgctggggcggccgggactctttgatggcgggggcggtcagggattcctggagtctggctagatgccccatgagggcggcgggcaggacgggatggcggggttcgggggtggggatgcccctccagtgagccccgacagagagagagggcaggctgcgtgtggaccaggaaggtggcaatggcgttggacttgacatgtgcggccggcggacgcgcgcggtggcaagcggcggagggcg

SEQ ID NO: 43 - DNA, 95 bp, mus musculus
cctcgttgactccgaagggctgcagcagcaattcatgttttggagtattgccaaggttcaaaacatgaagcgctgcaacaccccttcgtggggaa

SEQ ID NO: 44 - DNA, 2145 bp, mus musculus
gctggctgctcccgctcgcctcttggggtgcgctcggctccagcccaactccgccagctccgccggctccagcaccgctccaacccgattccagccggattccagcccgattccagcccggttccagcccgattccagcccggttccagcccagctccgtcccggctccggttcttctccgccacgcctctctgtgagcccctcgccccgcgaaccccggttccccggctgtccgtccctctgtccctcgatgtcccgcaccaccgccacctcgcgccctcccaagtctccgcgactcgctcttctaacctcacaacctcgccacacccctccgccctttctctctcgctgtccgtctgtctgtccgcctccccgcccgccttttccttcctctctctagcttccccggcttgttttctaggtcgacgctgaggagcagcttcgcaggaaaatcccagaaacctttgcaaaaagcttacaatgaaatttaagaagttctacgatttcggcgccattttcgagtggagtgagaggtgacttagaatctaaaaaagaaaaaaacgagggggaagggaactttttggcccgcctccccccgcccccaactatgtctctggtcactacagactgtaacagatacggggataattctcaaaaaaatgttatgcgtcgcgctgggtggggtgtgggggtggaaagcgtgtccgggggtcgtggtggggggaggacagatctttaaaatgtctagcaagtgagtgtggccagggaacttctcagaaagtggactgagaagagtaaacggggaggggtggggagagagaaatgagtgaggggcgggcagcctcaggctgtcagccttgccagggtggggagcaactagttttgacagactgtaaatgggactttgggccactcatttgtaagcagtaaagaatgtcctggaaagaaccgtaaaattcgttttccattgtctctcgctaattaaaacttttcaaggttgtttagttgttttttttttttttccagtattggaaaagtttggctggaaggtgcggaggacctgtgcatcatgttttgggtgtgggggcgcatggcatctgcaacattaaaagacaaaacgttctcaactgggaagagaggaagaggcttagtctttggctcttaaatcatttggccaaacccttcgcagttctgaagtgggtggggccattttgacccgtcgtggttctgaagtgggtggggccatggtaaccctaaagtattgattctttgtctattgtatcagcgaatgaccctctctagaagtgaccagacatctctttgtgctctcttttcgtaagtaaagttaagcccaaggggaaatacacaaacccagggagtgagatggctttttaaggatataagtcgttgtagagtgatgggaagaaaagaaatggatgaaggataatctagagatgaatttgattccagtgtattcgttaacaaaattatctagtaagaccttcgtttttgatgatgttatctcgaatgaattttgtttttatgagtagtcaactaaggaaatgttaaattaagaggaattgcaatctctgatgtgacatttgtgtgggacataaagttaaattgggagaaaaatacgtatctttaaagtataattgtatctttactaaacacggcttttctctctcctctttttaaaggtgaccatcgatggttttttcctccacaattccgtgtccatgtaaaaatgacttgtaatatagccaagaaaagacggaattttcattccaacttaaggagtggggctgttattattaatggctttatttatcatgacctaagcaatgcatatgttagcactggatcattatctgttatgttaggaattttgtatttagtttaattacatactctgtatattttattaattaattaaaaggacccagcattcattgtactagtttcgaaaaacggacataattttaaatgagaatacaggaaatttgtatacagaatgttttttgctttcaaaggcactgtagttttgttgttttagttattaggtttgtggttaaggactaaaggatggtttttgtgctttcctgaatgctttgtttaaacaaggaaatgaatgtaacttgttgc

SEQ ID NO: 45 - DNA, 2145 bp, mus musculus; identical to SEQ ID NO: 44

SEQ ID NO: 46 - DNA, 1467 bp, mus musculus
cgccccccgggccggctttttctagggctgctgcggaccactgggcgctggctgctcccgctcgcctcttggggtgcgctcggctccagcccaactccgccagctccgccggctccagcaccgctccaacccgattccagccggattccagcccgattccagcccggttccagcccgattccagcccggttccagcccagctccgtcccggctccggttcttctccgccacgcctctctgtgagcccctcgccccgcgaaccccggttccccggctgtccgtccctctgtccctcgatgtcccgcaccaccgccacctcgcgccctcccaagtctccgcgactcgctcttctaacctcacaacctcgccacacccctccgccctttctctctcgctgtccgtctgtctgtccgcctccccgcccgccttttccttcctctctctagcttccccggcttgttttctaggtcgacgctgaggagcagcttcgcaggaaaatcccagaaacctttgcaaaaagcttacaatgaaatttaagaagttctacgatttcggcgccattttcgagtggagtgagaggtgacttagaatctaaaaaagaaaaaaacgagggggaagggaactttttggcccgcctccccccgcccccaactatgtctctggtcactacagactgtaacagatacggggataattctcaaaaaaatgttatgcgtcgcgctgggtggggtgtgggggtggaaagcgtgtccgggggtcgtggtggggggaggacagatctttaaaatgtctagcaagtgagtgtggccagggaacttctcagaaagtggactgagaagagtaaacggggaggggtggggagagagaaatgagtgaggggcgggcagcctcaggctgtcagccttgccagggtggggagcaactagttttgacagactgtaaatgggactttgggccactcatttgtaagcagtaaagaatgtcctggaaagaaccgtaaaattcgttttccattgtctctcgctaattaaaacttttcaaggttgtttagttgttttttttttttttccagtattggaaaagtttggctggaaggtgcggaggacctgtgcatcatgttttgggtgtgggggcgcatggcatctgcaacattaaaagacaaaacgttctcaactgggaagagaggaagaggcttagtctttggctcttaaatcatttggccaaacccttcgcagttctgaagtgggtggggccattttgacccgtcgtggttctgaagtgggtggggccatggtaaccctaaagtattgattctttgtctattgtatcagcgaatgaccctctctagaagtgaccagacatctctttgtgctctcttttcgtaagtaaagttaagcccaaggggaaatacacaaacccagggagtgagatggctttttaaggatataagtcgttgtagagtgatgg

SEQ ID NO: 47 - DNA, 1467 bp, mus musculus; identical to SEQ ID NO: 46

SEQ ID NO: 48 - DNA, 998 bp, mus musculus
gctggctgctcccgctcgcctcttggggtgcgctcggctccagcccaactccgccagctccgccggctccagcaccgctccaacccgattccagccggattccagcccgattccagcccggttccagcccgattccagcccggttccagcccagctccgtcccggctccggttcttctccgccacgcctctctgtgagcccctcgccccgcgaaccccggttccccggctgtccgtccctctgtccctcgatgtcccgcaccaccgccacctcgcgccctcccaagtctccgcgactcgctcttctaacctcacaacctcgccacacccctccgccctttctctctcgctgtccgtctgtctgtccgcctccccgcccgccttttccttcctctctctagcttccccggcttgttttctaggtcgacgctgaggagcagcttcgcaggaaaatcccagaaacctttgcaaaaagcttacaatgaaatttaagaagttctacgatttcggcgccattttcgagtggagtgagaggtgacttagaatctaaaaaagaaaaaaacgagggggaagggaactttttggcccgcctccccccgcccccaactatgtctctggtcactacagactgtaacagatacggggataattctcaaaaaaatgttatgcgtcgcgctgggtggggtgtgggggtggaaagcgtgtccgggggtcgtggtggggggaggacagatctttaaaatgtctagcaagtgagtgtggccagggaacttctcagaaagtggactgagaagagtaaacggggaggggtggggagagagaaatgagtgaggggcgggcagcctcaggctgtcagccttgccagggtggggagcaactagttttgacagactgtaaatgggactttgggccactcatttgtaagcagtaaagaatgtcctggaaagaaccgtaaaattcgttttccattgtctctcgctaattaaaacttttcaaggt

SEQ ID NO: 49 - DNA, 998 bp, mus musculus; identical to SEQ ID NO: 48

SEQ ID NO: 50 - DNA, 998 bp, mus musculus; identical to SEQ ID NO: 48

SEQ ID NO: 51 - DNA, 998 bp, mus musculus; identical to SEQ ID NO: 48

SEQ ID NO: 52 - DNA, 10886 bp, mus musculus
gcacttggtgaaaggcgggaaagcgtaaagggcagtactaagtctggctgcctgtgcccgccgcggggactagaggcctcttccgtacaggaggaagcgaggacatgggaaaaggcctccagttgtcgaaaatggggcccgaccagaagtggaggggcattgggtagatttttcacggcactggcgtgggacctgtttgaactgcaagtcgcggcgggagggaagtaaaaaaaaagtgataaattccattggagaacactttgatctaggaacagtgataactacattgaccctgacttctgggactcttatggctaggatgcaaaataaatcgctctactacctagtgatttggggaagtattgtgggaactttgagtactttttaagggccaatagggtgtgccagaacttcaggaaatgttatccctttctcagacagtccccctcacactttccgttcatagttttacttggaattcgtaataaaaagagctgacagagagagttgaacacttgttaattcctttttactcgacttctgcctcttctacatgccccctgtaccagagggagggcatcagtaaagcagtcatgggatctgtctatgtgcatcattgggtcctttccatgcagctctctgcctttgccttctacagcagaaccaaaatcacctccccacccctttggcctctgtattgggcttatatccagcctgacccatgctcctttaatccagaaggcttgcatccaactgagaagttcattgaatgcctaccatgtgccaagcactgtcctaagtactagtgagtccttggtgaggtagcaacaaaaagactgtcactattgaaattggaacctacaggagtagatgtgcaaaattcaacttctcaaaaccgtaagtgtggagctggagaggtggctcaagggggtaaaacatttgctatgcgagcatgaaatcctgaattttctaattcctagaatctatagaaagctgggcctaagtgcctaaataagcactcccacaaagttgattccccagaagttcacaggtcagtgtgccttatctagtttcgaacaacaaaaagagagactctgggtagaaggcaaggactgcattagaagttgtactgtgacccccacacatgttttgtggcatatgtgtggccatactcacacacatggatgctacacacacatacacgcatgaagaagatataaatatggagtcacaactgtgatgtggtctataaagtgtggttatatcttttacagttggaaatgagcctgtctgtggtgtgagataagtgagcccggaagcaagatgattccaactggaatgtgacaagaaagacttatttggaagtgtgcacttgaaagagcaagggtgagttgtcctaagcagatggtagagggctaggatgtgaggcttccagttcccagcctgcctcagccggaacaatattaatgttgttgcaactccagctttaaagcagtggatcaagggccacattccttgaggctatggtaaacagaaatgacccattgaactaggatctttggagtagccacaatatattaagaatcctgtagggttgaatacaaatctcaccatagaccagatggggcataacattagctttaactccagtgatataaaaggggacatattgattgagaagattctatcttccaagtgtaagatatgtagttttctcagggctttcaaacatatcagtaattcgcaaaggttactgtcctaagacatagtttcatgatgtcatgacactgtgcataactttctttcccccttaaagttattaggtagagtccgattgtgtaattatttcacttcagttgcaaatatttcagtaagcatttatttcaattctcagcatgctcaccattagttcttacatggcccctcttttgctcatattattgtgtatattacttgtctcattctactagaaaacagttgtaatgtttgacatatcattaatagtttaagatagtgtttttaaggacagatttttttgtagggcaggttggccacaactcagaattagtagaggctatccttgaattccctgttctttctttacttctagtgtgctatatgtgtatggcttttgcatacacagacgtggtactggactgtaaatctgtttctcactgctaccattaaatctgtatttttaaaattgcttttgggacagtgtctcagtatttatccttggcaggccttgaacacatggtgatctatttgctcctgctaccaaagtactgggaataaaggcatatgccaccattcccagggtcacgaaaactcttgtgtcttcttcatgcactgtggcaagaattttgcgagtgtgctcttacagagttgtgtatgcacttcctgtttcttcttttgcactgattataaaacaggctctgaatgcttaatattttactgtcatttacaatacagtagaattatttatttacagttatttttctcattggactattagtactatctaggcagaaaagatatcttattcacccttgtactttaggtagattttaaatgtttggtgtttgttctcactgtggggatatgttgtggcattatctttcctcttttagatttctctggggtgggctcatactctacacctcacggtgtgggggggtctctcaatcctaatcggataccaaattctttcagagtcttagagtctactcatgcattatccaggctttcattctccacctgcttccctatagccactcttgccttctttttgtcaagtcgcaagacaaaataatacccctgcttatgtgccataccaatcaaactgccaccccaaacactctgatgggatttctggtaatgtttctttggctaaacctaaagtaattatttattcaagtcttaatgttttatacattctgacatcttttatcccttctgcctcacattctaaatttcacaatcatgatacttcctttgatgtcttgaaattatcaggcaagttgttagtctttttcactggaatgtaaacttaattttgaaaaaaaaaaaaaaagattggtcttttatgtattgcttaagtgcctgtgtcaccaatgtcgggaacacagtagatggtttctaactatttattgaatgaatgggtaagtgaatgaatgaatacatattgaagactcagcataaatgacatctgctccatgcctatacttcagcatgtctggccctactttggcccctatcttccattaaataactgtctgttgtctctgcatcgatttcttctatatttcatggttttgtaacttgagccctctatgcctttttattcctcagtcctagctgaaatgcccttcaagacactgcttaagtcagacttctttcatgttattttctctgaacatatcacctcgatttgacctctcctctaaaacagatattcaaaaaatagaataccatgttttagatgcatgcctctaaacccaatccaacatggagatagaagcagaagaatcagaagttcaagggcatcttcagctgcataatgagctcttgtccagtagtaggtacagaccccatctaaaaaaaactatcaaggtaatgcttactgtaggaaaatattaaatgacagtgtatttgcatttaaatgataacaactatagttagaatggatggtatccaaacattctgatatattcctatgatattttcacaactgatatctagtcatatccagaagactcaaggaagaaaaagattggcataagttaattattcatgagagatgagaagcttatcatgaaagatgtatctggaatagataggtcagccaaatgtggtttaggtttagacgacaccttaagacagtgagactgattcaaaacttggtgtagcatttgccattcagattgtgctctgtaaccctaaccatgacttcttgatagaattcaagatctaagaggagcagatagagatgctatgtaaggcatcacttgtacttgtcctaagttcttttccaggcaatggagctaataccaactgcttttcaatcaactagtaagagtgagcatcttcaattccttcatggcaatggcttggcttgtgcacccatataagaattcctggacacagatagtagcactggtataatttgaagacagagaaattaccaggcattgtttgtctggcagtagtaaaagagttttagagataagagctatcagaataggaacagggaaatagaaagtgccattagaggagaactcattaagcattactaggggactcttcagagttagtcttaagaaagaggagagactacaacatcctctgaattatataggatggagcacagtcagagtaatacaattgtagcactgctattatcacttctatttttatatctaggttgatatgactgagaataaaaatacacaagaatttatgtcactaagccttgcagcagaattgattgctatttgatggtttcctttagcactgaaacctgacttatgaatgcgcactaaagtacaatatactgaagaatagaaggaaatgaaagtcagtttggtcagtttggcttgaaagatttatatttgataatgctttctcctggtaaatggtaattttgtcatataaataagaaaatagtaatatgcaccttggttgaactattattcatagaaactgaccaattaattattcaaaagaaattaattcttccaaattgaggctgggagctgattttaatctggtcactgacattttgaacttctgagaaagctatataaatactaaaaatggaacaaatcttgtagctttttaaaatcaggatctctttatagtaataaatctgaaatgcttctaataaaactggaggggaaattgggcagagttttaaaatttgaagtaaatttatggtttaatacttgtgcattacaaagttgtgcaagtgaaaagagatgctttgaataaatagttctcaattccaatcactcttcctctcttaggaaaacagatgttggaacctccaattgttggggacaaaagccttggattcttcaggagtaagtaagcagatagagaattttcttcttcatgagcttcaggaatatgtgggcattagcatcccagatctttgggccaagaaagagaatgctgggaggattttcctgctgttgtggggatccttggttgtcaaaatgagaaggaggtatgttgtttaattttggttatcttgacacaaactgagacttccccagggaagaagtattgtcttaattgaggtattgtctttgtcagattgcatgtaaccaagtgttgtagggttttactaactgatgtggagctgcccagctctctgtggatggtatcattctggccaggtagtactggcttattaaaaaaaaaaactgaggaagcaactgggttggagcaagccactaaagagcattcccccacaacctctactgtagttcctacctctaggttcctgccttgaattctggtccagacttcctttaatggtgagctgacctgacagtgtaagtcagataaaccagtcctttccccaagtagtttttggttgaattattttgtcacagcaatagaaaacaaattaggagggaaggtatgtctagtttctacttaacttgtgtctttctgtagtgttgttttgcagggagtcttcttgatcagcctcaccctgcctgaatctgaagttctattacattatacttttctaaaatccagaactgaagtcccccaaagcgaagttactgtagtataaataatcacttcatagattctgcagtcagaaagaaaattcatcagacacatccaggtaaagagacttgctaggaggcataggatgtttggaacagaaaggcgcatacaacatttgagaaaacgtgagagcaactaaaaggataatttgatagcccaaataaaggtcagaactgttaagatcaaaacattataacccaaaccctagctcaaaatataaaacacagagagatagccaccatgaataatcaggatatttggatgaaagataggaaaattggtaagaattctaggggaagaaaaataaagagagtaagttgaataaaattatagaagaaaatcttcctctaaggattaaagtgctgagtctatggattgaaggtacataataagttcctgactggcttggtaagaagagttattatgacagcctgtgttttctaagataccagaaagatggtgtagaaggaatttacttgttcctgaagtgaattaagttacttgaaaaaacagaaaagtgctgtttttatagatagcaccctgaaagaaagcatcccggttacaaaaattgtccaggtgatgatgatgcaaggctgaggaggaaagacagttctagattaagcaaccaatctgctgtcttctctgatctgcagagaaagtgatactaacaggagtactctctcagcctctatggcaaagcaaggccgaaaatgatgcatctgttcttatgctatagtaaagatcattgctgcatttgccaaacattgctagtgctttctagttacagaaatgtggtggtatcttatgtctgagttctttttgttgttgttgttgttgttttgtttgttttagtcttcccctttctctgtgaacatgatgtatgcacaagtagatgacatagatgtgagtgtagaggaaaaggtgggtgccagttgtttcttgcaactgctctcagtcttaggtttttgagaaagtctctgcatttctctggagctcacaatcttggttaggttggctggacagggaactatagtaattcacctgcctctggtccctactctcccaatcctggagttttaggtaggcacgaccacactcagctattacatgggtgctgctgatctgaacttaggtccttgttattttatgcaagcactttaccaactcagacatctccccagtcaccttagtttgtaatttttattatttttatttttcacttttgatattagagaagagatcttcctgcattgctttagctagcctggaactcatagatgtctacctgcctatacctccactgtgctcagattaaagatgtgtactaccaagcctgctttattatttccacttttgtgagtctttttatgcttatgtttgtgtgtaattttttggctgcatgtgtgtctatgtactttatgcatgtctggtgcccatggagactataagagggctttggactttctagaactggagttacagaaggcggtaagccactatgcagatgctgggacatgatgcttgaagaactaggaaaagggtgacattagaggtgaaaaagctttgaattccatggatctggtgcttgtagaaatagcatggagcatggagagtaagaaagcaaaggatttttaattttttttttatttaaaacaattttaaatgtaaatagattttgatcatattcttccctttcctcaagttctttctgatcctcccccccccacttgcccaactttaagttctttctcaaaaaagaaacccaaacagacaaaaaccaatacaagagaaacctccaaaaccaagaccaaaccaaaatgggaaaacaacaacaacaaaaacaacaaacaaaaacccaaacagaaaaaaaattaaaatcgccaaaaaagtacacactcatgtattcacaaacagacagacagacagacagacagacagacacatacacacagacacacacacacacacacacacacacacacaagcaaacagtggaatccattatattaggccagctgtttctgaacatgaagccttccctggagttgttgatataccgtgtgtcactccattgtagaatactgatttttcctcttccagcaggtataaatgacagttcagtttttaacttttatccaagtgtctagagagtcattcattcattcatttaataaatctgtaacaaaataaatgaaacaatgataaaataaaaattatcatattgaaattggacaggacaaaccaacagaagcaaaacagcccaagagaaggcagtgggtgggtaggggagcgggggtgggggggggagggtataggggaatttcgggatagcatttgaaatgtaaatgaagaaaatacataataaaaaattggaaaaaaaggaaggcacaacaaccagagacctacatgtttgtacattcaggaatcccatattatggcatccacagaagcccctgtgcatgctgcctaagtatctgagttcatatgagctttactcaggtgatttaaaggcccttgttcttctgcctcttatactcactccaccttctctttagcgggcttccctagccctgaggagaggtctttgatggagacatcccatttagggcttgttgttcaaaggtctctcactcaaaagcaaaggatctaaatagctttacttctaactgtggcatattataatagtaatgctaataaaatttttaaaatctttgtttttattgacttttccagaaaaagaaggccaagaaggaaattggatccaagttaaaagtatctctattcaaatatgtattaaaactttttgatcttcaaagcaacttggatctgattcataaaagtgaactctgtaccctttcaaaaatcaagaattcaggaatgactttctgcatagaacagaactctccaaaatatatgcaaatgagataggtttctactccttaaaggtaccaaaatactttctgtgtgaaattttacttgtaaggtgaaaggatccatgtcattgtctgggaaggtagataagccaatgtttaggttgtttatgagtctgagcaattggtggctgagtttccgggattttggagtgttctccacatcctatatgtaatgactttgagatttaaaggttcttctttatttggtaagtttagaaaatcaaaatcaaatgtttaatgattttatttttaaaacgagttaggcataactagcattggggtgtggagaaattctaagtccagataactgttactgaatagttccttgggggtggggataatagtttatttttctcatttttgctttaacacatctcagcttttggttgtcattttgaatggacaaatgaagagttttggctgtacctttaaccaaaataatagaaacatcaattggaaacaataggagggagtgttaaatggacactgttggactggagggaaatttattgtattgacagtgtgataggagttctgggactggacacacacagcagataggtaaactcagcaagaaatctgagataccctttccttctccccttgctaggtcacaatgtgtgccttttgtttatggacccagaagcagccacaatgatagatgctataatacagacagataaaggacatcaaataactatatccactcttatctagggaagaaaagtgtcctttctatattatgttctaaaacttctatagttttatcttcgattagttctcccttgcattgtactttcccttttgtatgcggtttgttgtactgatttaacacgaagttttagcaaacagatagtacattgtttctggaccacatgcaaggttatgtggaaagatgggcagtgagaggaaataaaaacctttcaaaggacagggagaggaagatagactggaatgaaaacatactatatgtttcatcttactgcaatgggaaaatgagaaaaagaacgttatatgatagaagcaacactcaatatcttactcaaataaacagtaaagaaatatctgtgtcagaggaaagaaaaatagcaagcagaatgcaaaaataaataatgaatataaagcaagatgcaaacacaaagcaaaagatactagacatcatgttctatttgagtagatggatatttttcattagaatacagaaaagtccccagaagatattttatcaaagttgtttattcattgccaaaataatatgatttctcctggaatcccagtgaacattggatgactttttcccctgtatcagaaggcaatatgtaagtgtggcagatggcagagaccatttataatgatgaagaccttgaagtatggatccagaagtacaagaatctaagtcatgtttgcacttgggatttttagattccctgaaccctgaaatggacttaacaccgacttgagacacaaactttgtttagaccattacagtaagtgctgccaagaatggcattagtccaaacagtgggtgtttagcaaatcttaattggtgagacttcattctaagaagacaaagacttatatttatgttttctttggaaatttctagtaacaaaacgaggtgtaacgtagcttaagaaatgaggcatattatgtgttatttctcttcttaacctatatcctcacatttttcaaactgaaggccaggataaagaatcaaggcaagtgaggtaggtatctgagccatgaagtataaatattgaaagatatcattctatttagcaattacaagaaattcaagttatatagatttccactttaagtccctctcacccgacattacagaatgcacattttcctatatcaactagtctccccttcatttcttcagttaggacagcatgttccttcttccccaaatgtttttgatttctagtatatgtcctggcttactttcatatcattcatttcctttatgtaaaatgattgtgttttttaaaatcttgtgaccaccaagtttatagaaatgttgttgtttttgtctagcagttgtaccatagctgaactgtcaaattgagaagagtgaatagctagtttgtatttgttttttaaattaacaattaataaaattgaccttttaggggttagtcttttcct

SEQ ID NO: 53 - DNA, 19795 bp, mus musculus
gtttgactgtttacaggaggcgcagcggagcccttggcctcagtcagtcaggcgctggggagcgtttcggtttcacttccggtgaggggccgcgcctgagagggcgggcagtgaagcaaacggacggcgagcgcgggcggtggcagtgacggcggcgccgctgccggggggcgtgcggtaacgcggcggcggcggcggcggcgacggcggctgggcctcaagcgcctgcagcccacctcccggaggcgggctcccggcgcgaggacggacgagaagatggaggagctggtggtggaagtgcggggctccaatggcgctttctacaaggtaaccggctaccggacaggcccggtcctcggcctccctccctccctcgtgtccagggtggcgggcgggcccctcgggcgcggcgggagcggcgggctgtgggatgtgagggagcggcggagtcggggcctagagcccgcctcagcgttccgactcccgcctgaggccccggcgcctggcggaacgcgcgggttgccgagggcggttgagcggccgagtttgtcagcgaagcgggaatgcgaggacaggggatccgatcggccatggggccggtgccgcgggaagtggcggcagcggcttagtccagctttcccaaataatcctctcccagtgggttcggggcctgacacgcggggagccgtgcgggaaccgggggcgcttcagcccggccgccgccagccctgctggacgaacggccgttacgaggcttgggcggccgttaggaggtttgggctccgcgttcggcccacagtccagactttggagagctccccggttctgggcgaggggtgtgcagggagtagtaagaagcgggcggcagctcggaatcacaatggcaactgctcttgagtggcctctttgtgaatttccaaggagggttttagatctaaaagtttcggaaagaccatgacatctgagagagcggtttcaaacgctagccagagccggtatatccacggcctccgaggctctttctaactgggagcaattcagggataagcatgtcgcggcttctaaaaatattaccaagtctgcttattttaaatttccctttgtgtttaagttctcgaggacccgaatttgtgccacagaacttcaggaaattaacggggactgtacgattgctactgaatttttaccaggacggtttggaatgtttgttctgtgcgctgaagtgcataaacttgagtatattcgctttgagttttgcggtgttacagtgagctatatttgaggttttaaatgggcattcatggaactactgagagtttttttataccattgaatatcaagtaacatcgtatatttttcaaggaactttaaacttaagtattgtgtgatttttttttgatactgcataaatgtagatctagcaatattataaattctccttttgtgaatgtttataagctctctaaggccccacctcactagaatattttagtaacagaaggtgcacgtggaaggaagcatggaaaatagcttttgccattgtccaatagttttaagtttattatagaataacttggacatttcaagtgggacatactaagctaaactcgggaaagtgactttagtaaattatgcttttgccaagtttatggagacatttagtggaagataaaattctcgaatcaaggaaatttgtaaaatactaatttatactaaaaatacccttttgttgtaatataggagacagaaagaacacaacatttatgttactaattttaccagtgcagttatttttcaatttgctgtaataaaaaaaatgttccggttagttttggttagtttgcattagaaggtttctaggttctagaatgacagttttagttgctagagttggggcactgagacacagatgagcaagggataatagttaagtagtatttttgttcatctctaataacagcttagatttgagtccgctgttagtggcttttaatgaagttggcttgccattgagggcaagtaccacatcctactcttgaaggatttattggccccagtaattttccttgaaaactgactggaatatatttttttaaagtgctctgtttccactattaatccccttgctttttttcttggctttgtattccaacaacttcttgatttgaaggtgaacaaaaaaggaataggttatgaattatcctttgattccctgaggggacatgtagtgctttttaaaaatgtatattgaaaaattgctattgtgtttaagtttggttttggtgttgtttgtttgtttgtttcaactggtctatataaagggaagggtactgactatcctgaaagaggttcaaattttacaacacttagaatattgactgtgaacaggaaaaataaagtggaagcatgctgagtcgttttctggtgaaattgattacaaaaaatgagaggtaaagaccattatggaaaaactggggtccttgttcattaaattggtagaaataaaaatttaaagtgaagtaagtcaaattcaatataattgaattcagtctttgatttgcttactagaactactgtattgtgaaggatagttgtacatctcctgagaacattaagttagcagaataactatatagaacacatattagcagtgatttgattctttctctgaggatcactaaaatgaagatttcaaaatcacaaatcatgctactagcatgataacagccaaccagttctaatttggatctttttcttttggtgtttaatttttaaaactattaggtttatttgtgactatgtgagggtgagtggatgcttatttgcatcccatgccacacttgtcaagaggacagatttcaggagttgtctgtctccaccatgtggctactggggatggatctcaggtctgcaagcctttacctgctgagccatctcaagatgtggctcttttttggtgtttattttttaagatttgaccctgcgtggtggtgcaaaccgggagtggtggtgcacgcctttaatcccagcactcgggaggcagaggcaggcggatttctgagttcgaggccagcctggtctacaaagtgagtgccaggacagccagggctacacagagaaaccctgtctcgaaaaacaaaaacaaacaaacaaaaaaagatttgaaacttagactcagcactcaccagaatttctagttttaagctttgtttttttctttaacctggaaaaagttggtcacacgtactagtttttaagcccttcagacatgttatatttaaaatctgaagaaactttgatttgtatctcacatgatctttaaaaagccagtaatgttgcaaaacactgctatacatctttattcaaggtgcatctgccccatgtagtttttttgtgtattacagtttgggtatgttgagaatgataatgcattaaattcattttgatatagaatgtatgctgttcagatgtgagaatactacatatgcaaagatttctaggttttatattctagtatcaaaattagtaaaccatattagagacgtatacaaaacgtttaaatttcaaactataatggctaatatctaattattatgtgtaatgatgcaaattcacaaatatattatcatcttaattttaagctcagcatctgagaatagactcccactagctgaatattgttgccatatatagtggtttattaatacacaataatatacagtcaagacattttttaatgccaggtttggtagatctcacctataatcctagcacctgggaggcagagactaatggatttctgagttccatgccagacagggctacatagtgaaaccctactttgggggtgggggcttacaaagtatttagtacccaacctatatatcattttagctacattggcttgtagaagtaaatgttttaccataaactttcacaggtttagaaatttataagcctacataaaatttaaatgaactcacattcatagttttctctgaaatccagcaatcttgaagtatgagtgttaatttacatgttaaagagatgaattatgtaaattaccatattttagcctcccaaatcaaagcaccctttgtaagatttagtgtctttgtgaatgtaacaccccaccttagaaatgtgcaattccagttctatactcatgtattctgataacctcaaaattactaattttgtgcaaaattttgtgcagtgtagtacttgggagttcagattctggcctgctctgggagatgtttgggatcatggttatggtaatagttaccaagtggggagtcttaggcactactttgcctctattaacttcctcccactgttttaatttatataagggatatagatatatagggagatgaaataaataattactaatgtttgtcagggtgctaaaagttttggatctgggatttgaaatcagacttgataatgaaatgataaaatttagcttgaagaagtaaagtagattacatttgttgctcacttttcaatttcattataatctttgctcatatttgtacagtgacattgccttagcatcccataactacaattgttgtataatcttttttaactgtagacacaaagatgtcagtaatctccagtttatgtatccatattctttttttattaaccttctggcttgaaatattttcccataaattcttagtaaggaaagataaggttactctgctgtaaagcttgcttttgttagttaccctaggagcttactaaacctgaaaaactgtaacttatatgaacagtatataaacatcaggaaaacaagtcagtggatgctgttttctttgtacctgttgtctttagttagagtgaatcatttttcttagaatttatggaagaactgttgttgttttacaaagtggggagaataaagattcaatgtatatatgaagccttgggtttgaattatacatcttatatggccctataatttatctctaggaggaaagtttttacttattttatgtgtatgagtgttttacctacatgtatgtctgtgcaccaaggaagtgatagaaaagggtatcagatctccttgggatacagatggttgtgagctggaatgtaggtactaggttttctaacccctagtttgatatcttaaaacttaagatatgtgaagaagtcatgataggggaataaaagtttacccaaataggactggactctttgtcctttgtgtactgctttaataaagcagtgtttgcattagatagttttggtttttatatatcctcaggactatgacttggtccaattgtaattaaatgaagggatgctatgatgacttaaaacttctgtttttcccctggtgaacaaccttagtgtgttttggtcactgcttttttttttttttttgcttttttttttaatcacttctttcaaaccctaaagctttttttttttcctttctagagtgaaagtaaccattattatttagtaattttgtaggactatccctttcttgttctatcttactttttaagcctttatttgaccattaagactttcatttactttcctaaatagcagtctttggatctgtcatgattatgagtgggtaagtctcttctctccttaggaaaacattagcactattgagtgactgacatcctgtggagaactgtaatctttagtcatgcccttaagaacttctggtttgatagccccattaaagccttttttaaagtatagagggagtacttaacattctgaaatgcaaaggcatttatagttctgtatcttttatgaaaattacatatgtatatttacgttacaactttaaaaggctagtctctaggtccttagtttaaaaatgaggaggaatctgaggttcccaaatcctgcagctattatatgatagagccaagattttagagcctatatttaattcataacaaaactcaacctctaagttctctgatcccattaatagccctacatgtcagatccagtgaagctctttgggcattcatctaatctgcctttgaatatatcacagaaatcttctcagcctgttgtttttacatcaacttagcatgataggaaagaattacagcaaaatgaggtttttcaagttggtaggtgaggtgctagctctctagaggaaccttgtgaatgagttaagagagagtcggagagtttttaaaaagcattattggaaaaagtatgatgagaacacatagaaagatatgaaacctgtggggaaggtttactaaaagactttagaactgacaggatgtcttgtcctatccttagtatgtgtgcggggcagagtccacagatgagattcttttatttacttagtaaagcagtaaccagaaggtattaaatgcattctatatcagttactatgcaaacagtgactaaaatgactgattttgaaacaatcatgcaaatatctatacatagataagcctcattaactcagaggcagtggctctgttggatgtgatgattactcaaactatttctgacacttttcatccaaaattatattctaggactgtgaaaacatttctttttgcctcttattttttggctgttttgctttctgtctctgtctctctctctctctctctctttataccatttacagctctcctttgaaagggaacacttcatttttaagaaataggcaaatgtattgaatgcatatgattaagctagataataattcaggcaagtagggggaaataagaatacagctataaagtcataagactaaggctgatttttatggttagtttgaaaactcttaatgttgtaaatgttttaaatcaataggatatgctacaaaccccactgatctacccatagttcttgatccctcaaaatgtggaaggtgaatgggtgactgaatttaattgtagttaattttaatgtaaatagccataggtcacttctggttaccacagacaatgcaaacagcaaagaccagctttggaaagactttgctttacaaaggacaattttctacccagctgtaccaaagttcagtttgctgactaaagagtttaactttttcagcatataatgtactataaagaactagtgctgtgctcttatgctcttgcctcttttttgcctctttcccccttgctccccaacccctccccccctccacatggccagggcctgcctctgcttctctcctctctgcctttctctgcctctatcaccctcttaactcccctccccataccctaaataaactctatactaaaaaaaaaaaaaaaaaaaaaaaaggaaagaagaactagtgctgttatgtatgttgttgtgctgctgccaaggcatacaaacatcatacaactttcaaagaggatgaagacagaagtagttaccttttccttttcttagtcttgattttagttggcagtctaataatctcccccagaaatacattattaacttggtattagctactgtctgaggacaaagaacaccttccccttctccataaatttgttttatagtatataaaaccaagatcctgagtgaacagttctcacaactttttattcaaaatcaggaatatttgttgttgaataggacaaacaatcccttagcacactggacgcatgatacatacttgcttatgaaatagggcatattctaaagtatcagaataatattaaaccagagttgttcaaatatactgtaaaatttttaatgatttaaatatatatttaaatataaataaatatttttaatgatttaaatatatctgagaaataagcaacatcaagtggatgggaaagaaaatttgggttcatcatcatttaaacctgtaaatataaagatataaatatagtacttgctccttgtactaatgacttcatagtccatattcctgctatttgtgaagtctccattgtattgttggcttcacaacatcatttaggggctccaatagggattttatccctgatacacatatcacttgcctggcctccaatatttcttttgcaatttgggtgggactttccataatttttattatacatataaaagctggtgaatcaccaaggtgtgctaccaatgccatattgctgaaatgaatcctggggaaataactttgtcactagtttgagcagagtttctctggtgctgctgccttctcaaaggaacatttattgcttgagttgtagagataagagatattcatccaaacagacacacccctaacacatgcacacatatatacatcatgggtttaaaattctattctttgttctgtctcagctttcttattgttttgttttgtttttttttgaaacaatctcaagctgttttttgttgtctgtttttactcttgcttctccatcctccaactagttgttggctagttcatccttacactttaagggtcagtagaaacttcacctttccagtatgtcttcccttttcaaagtaacagcactaccaaaaaaccagaccttacaccaggtctagaagagaagcatcttaggcagcagtccacttagtagatgttcattgaattcattctaagtatttccaagataatcatgcatatactatatttaacttagttgtagtttctacctgaattgaaacctaaaaagcaaatagaagatagttaagtgaaaagagggaaaggacaatagagcacttatggataagttacaggcttatctttactgctaggcatgtggttctagaataagtttcttaatttttaataatgtagcttaaagcgtacctcttacttcatattcaacactgaattttaatggccagtgtaactatctctttgagatgttaaactcttaagataattttttcttatttagtattgtaattatttgtattcttaaagcctaatatatagtacctagcaaaatagatatggtgaagaagggggcattagaaacggattttcaatcaaagatccattttattctctttttttttccattttttattaggtatttagctcatttacatttccaatgctataccaaaagttccccatacccacccacccccactcccctacccacccactccccctttttggccctggcgttcccctgtactggggcatataaagtttgcgtgtccaacgggccatcttttgatacatatgcagctagagtcaagagctccggggtactggttagttcatattgttgttccacctatagggttgcagatccctttagctccttgggtactttctctaggtcctccattgggaaccctgtgatccatccaatagctgactgtgagcatccacttctgtgtttgctaggtcccgtcatagtctcacaagagacagctacatctgggtcctttcagtaaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggaggggcatagtgtccacacttcagtcttcatttttcttgagttccatgtgtttaggaaattgtatcttatatcttgggtatcctaggatttgggctaatatccacttatcagtgagtacatattgtgtgagttccttaaattcttaaatatctctaaaatttaatttcattggtcttcaagcttaaaagttaatttgttgtggttttttcttgcaggcatttgtaaaagatgtccatgaagattctataacagttgcttttgaaaacaagtaagtttcttactatataatcttaatgttgaagatttttaatgttttatgctcatttttttcttcattttttaaattgaagtctgattttagtgggtttttttttcctattatgaaacaaagttcccagagagctcaggattaaatcaatggaaggccctcttttgctaatgattgaccttagaggtccttactatataatcttgatccttaagtccatttgattatgaaaacaaaagatccattcgtctcaatgaactaaaagttttaaatagtttgtaattttattaaaagttgaaaatatgggaatttatggatgtttacaataaaaatgattataggtttttatactgatttttaattatatggtttattttatcagaagaaattatgtgtcctcattaggttatttttatttttttcatatatttttaatcaataattatgacagttaatctttactgctttttgttctagatcataaaacagtacttaaatatctagaaatatgagctgtatgaaaaagtcaatagtatagatattatcatttcattgggggaaaaattctagtcactaaattcattaagtattaataaagaccattttcaggtagccatttgagactctgaagtacatatgtttagtattggtattaggatttttactaaactttggtaagtgacagttacaacatttagtttttctctaccataataatagtacatccaaggcagtctgaaaatctgtagattaaaaaaaagtagtatagtgattgcttagacttgttaggaatgtgtaagaaaggttataactaaagcataaaatacttcctgttgtggagataaaaacatactataattcactaacaataattgtatattatatgacaacacactatacactattgaatttgtgaattatgtggtttattaattatatcttagtaaatttcccaaactgcagtctgtggcacagagttactaaggactaaaaacaaataccttggttctaaaatattaagaatagacctgcaattcactgtctagaaaaatctaaagttagaccgtaagcttagattctttaagctatcaataagacaaagtagtaacctttgatgcctgatacacatttagaaagatacagatgaaagtactaacagaatattaagccctcttccatgctccagactaataatgttagtttacaagtttaaataatagaatatctttacctgaatgtataaagacaaaagttccataattgcctttttacatcattaaacaatagacaactataatatcgcgtctctatttaaggtctcatgggtaactaaggggataatcttttttgtatttaaactattatttttactttaattatgtttctgaatgtatatctttgtatggtatgtgcaacaagagtgcagatgttaatggaggctagaagcatcaactctggagctggagttagagtcagttataagttgcccaacaaggaggctaagaacaaattaaggttcgctgtaggcgttatttaatggctaagccatgcttctagcttcgttgcaattatacttttatctttttatttccttcactagtaaaacactgtttttaaaaatggccatttgattctctactcgtagttctgaactgtaaactcttaagcagaatctttgttcgttttgtgtttcctcttttggcttccactaaaaaggggggtaaaggaagagaaagattcatcaggaatactgaaagaaaacacagtatttcatagaataggatcttttcatttagaaagaatagcttagttagggtgcttagtttttaacctgtatttaacgtcttcaaatctgtacgattaaagagttaaagacattgttacttctttggaaccaagaaatgtatattttgcattgtatgtctcacaagtgaaacgtaactgacagttcataacatgttaaaggtcactaattatcagtgggtataaaaaagctattctgctgtattttaattatacccttttcaactgtattcataagtaatggggggagtcagtgtaatctcatcattcaacagatttctacaaattctgacttatttgtcctcttgtgcagtagttctttgtaaacagaaagaaaaaaaagagacaaataagtattcctcaaggttgttttattaaaatgtcctctatcaaaatataggcattttatgaagctaaaaaggttactcagcagttaaggatacttgttgttcttacaaaggactaatattcagttctcggcacctgaaactttaattccaggctatctgaatctctcttctggcctctgtccatgcacattcttagacacacaggcatagaagtttttacacagaacagaactgttttcttaatggaaaaagtgactgctctaaatgattgaatcactagtgttcttataaaattttgttacttagtatttgttatatctttgtaagtaaaaaaatggtgttttaaaactattcaatattttaaattaagaaattaggcaatttaattgaactcctgtaggctgtctccattgggtttctatggtttaggagaccccccacacacacaccaatccagtccatgctgatacatcggtagatcagcatccagctacctatggcaagaattgactacttcgtgggatctaaaatttaagggggacaagtgagttgagaattgctaatgtgctgactgccattttgctttggaaagtagaggatagttattgtggttgatggaatgtagtcagaattactttgcaagtagaactatgttgatgataatactaacaattgtcaatactaatttaagcatcaaaggaatttctgttgtagacttgggtttctaaagtgtgagttaaaattattagaagaaaaaccttttaagtaatagttttgatctgttgtctttagaaaaactgtgtggaaacctaggttgctatgctgcatgtagacttcgttaaaatgtctgtgcactgccattatgcaccactcagcaaaaactggccatttgaaggcatttgcttctttaaaccaagaaagagtcacatttaaccaaagttgattgcagcatgctcactatttgcattaaacaccaaaagcttgtcaaataatgatattttgtttatttgcagctggcaaccagagagacagattccattccatgatgtgagattcccaccacctgtaggttataataaagatataaacgaaagtgatgaagttgaggtgagttcccaagccataaaataaccagcgactaagggcatgtgtgtaattttctttgacttttaaaatataccttgcttttaacagtatttaaactaccttgagttaaagttaaaatcccttttagttaattatttgaaatgttatatggttacttatatttggctattcagccacactcaggaaatatcttgtcccaagtttctttaccccattagcatatccttgcctcatctctaaatctttgtgtaggtaatacttttgttagaaagagtcattaagtgagcccatgaaatgcgactcaggttgctgtctgcagaccagagcacttctagtttttctccgctgtttctgctcagagttctgcaacttctgcaatctctagtgctgtctgctttcagggaaagggcgcctagttacaggtcatgtgacttacacatgttgggagaagactgtgctatcaagagtctccagcccacttctcgtgtgtgcgtgcgtgcgtgcatctgtgtgtctgtgtatgtgttctgggcactgaggattgagctagggcttcattcatagatgctgtacacgtgctccctaatgaaccacaccccagcctcacattgacaaggaaatgcagcattgagtgtggggtgaaggtggggtacacagagcagataaacatgattgacctgcctcctcctacagcgggaggcagatctgtcagcaggcagcttttacatcctgtagtgcctgacagcaccagttccaaatattggtatcaacagctcctcccacatcttcgtggtacctcaatccttaaataaaagccattgctgatattaatgccagtagtcccctccccgaaactcacagtgcctcgaaatccttaaataaaagccgtggttgatcatcaaaaaaaaaaaaaatttgttgctattctattcactttttcagcaaaatgaatttggaaaaatagttttacaaaggaaagtaatagttctaacaaagcatgaatatgatattatatgcctatgatcttaaccgttaggaggtggaggttagaggatcaggatttcagagtttatcattggctacatagcaagttagaggccagttcttcatacatgagagccttaactctaaaagaatttttttaagaattctagagccagtgtggtggcatatggcctttaaatccagcactcaggaaacaggcatgtggacctcatgagttcgaggcccaccaagtctatggtactgagttctaggacaaccaagtctacataaagagaccttgtttcaaaaaaaaacaaacaaaaaataattttatataatagactagtaatataaaatttattttagtagtagtgaatctttctgatatatatttttcaaatctgtatcttttatatcatatatagatagatagatagatagatatatacatatatctatctatatatacatatacatatatatatatatatacatatatatacatacatatatatatatatatatacatatatatacatatacacacacacacacatatatatatatcccaaatgtcctttaataggccatactatgaactacatgctcatctaccattgagctcttagaataaaaggtgctgttgaaatttgatcaaaatcattgtatttatgattctctactcattgaaaattggttttctattataatcttatttatcttacaattttgtagtctcttttacctcctacttcccaagccttattttgaggtctttttaaaaatgcattaatttttatagtttcatgcatgtttgtagtataaagcaaataaataggtacttgttaagaggtaagcaacgtgaagttaggtccttaaatgttaattttctgctcaggctatcaggtacatcaatacagtcttcctttgatgaggttacattctagctggaatagctaatgtcatgacaggtgaaagttatatgaaggaagagaaagctaaatggaagataatacaggggcagcaatgctatttcagagtctagttggaggtctctgaatgttcaaacctatgttcttttctctgcaatttaaatgaggaataacatacttataataaatacttataataaatacttataatataaatacttataataataatataaataataatataatatattatatataaataatatataatattaatatataatatattatataatatataataataaataacataaataaatacttataataaataataattaataaataataaagcctaaaactgtacttagtgtattctggatttggctttgcaagagatcttaattgtaaatacagatgttatctaaacctctacaggcctttaagctcagtagataacatgtacttgttcccagggctgactatatgagttagatccccagtcctggcatggtagaaggagagacacagacacatgggggattgtcctctgacctccaattgtacacctataacattaccaagtgaatgtatgtgtttgttctctttcaaaaaccctctggtatctccttccctgtgggcttcttgctgtgttaaagcaaaggccagtttatgtgtatgtttttatggcaagactttggaggggtaaagaaaaccattttgtttttttcaacttagttgcatgacagttgaagcccaatgagatgcatcataaaacttacctcagaagctagtgagatggcacagcagatcatggcaacttaggttctattaatatttatttgttattgtcttcacaaaagattgcatgctacacattgcaaatgaacttgaaaggtttcctaagagataattattagagctgtgtatgaaagccagaaaagtgatattcagaagattgctggaatagatttgtcttttttcatggagaggaggagccagaaaagcagagtagccttcaaaagagatgaaggccaggaccctagtaagctgagtgatcagtgaactcactaacctatctgcttagagtacaggtagttattgcctttgtctgtaactttggattggttttccttgttataataaaaatgatgcttacatggtttcagatacatttttgtagattattgaatagctacagaagaaaatctagtcatgctatggatatcagcttttctcaagtgttcatgtcaagagtactaaatattactgacatagatcagagaagtaaacaaagtgcttttaaccgtgagttctcaagttgtttccaattatgtatttttgtctaagccaacataaatgtaaagtttggttgaaatcatatggtatatgatttcaaagataaatatggactttttaagatttcctcactgtctagtgtctgctgcttttgaattatgttaatcataaatattctgttttataatttttatgtaggtttattccagagcaaatgaaaaagagccttgctgttggtggttagctaaagtgaggatgataaagggtgaggtaggaaaatgcatattgttcatactatttacattttctaagcccacattttaattttggtgtctatttttaataactgcctaactttaagtcattttataaaaatgttttcaatataggtttactatatgcttgctatatgtttctattgattaaagtttccccctccccaagagtttatattttaaaatgataggagctgggcatggtgatccattcccttaatcccagcactaagtggctgaatcacaaagatcagggttaaaagtcatccgtggctatagagtaagtactaggctagtctgggctattatgagttcctttctcaaaacaatagtcaaagttatgtaggtttcccttcttttaaaaatatggctaagaatgacttgtttatttctctcagttttatgtgatagaatatgcagcatgtgatgctacgtataatgaaattgtcacaattgagcgtctacgatctgttaatcccaacaaacctgctacaaaagatactttccataagatcaagctggaggtgccagaagatttacgacaaatgtaagttgatacattaaaaaaatgctatatcagaagggcagtggtggtgcatgcctttaatcccagcacttgggaggcaggggcaggtggatttctgagttcgaggccagcctggtctacagagtgagttccaggacagccagggctatacagagaaaccctgtcttgaaaaaaaaaaaccaaaagaaaaaatgctatatgaaaaaatgctgggaacatgcaagggtgtgtagttttacaaatatacattttatatacacatacatatgtgtatataaattaaaatattatatataggttactgcatatataaattaagatgttatatccaggttactaattcagaatgtaaattttaaaatgatatgttttgtatctttgtcaaaagtagtttggttacagtagtgaaggaaaaaaattttttttcctagttatataatcaagcaagtcctgtatttgtttaaacttacttgatatatggctaaagtgtgtaaatctacactgagttctctaaacaaagattttttttttcataagctttgaagattttgaaaatgatagaattctatcaaaagtcacattgttcatattgttgttccacctatagggttgcagaccccctcagctccttgggtacttactctagctcctccattggaggccctgtgttccatccaatagctgactgtgagcgtccacttctgtatttgccaggcagtggcatagcctcacatgagacacctatagcacggttctttcagcaaaatcttgctggcgtatgcaatggtgtcagcgtttggaggctgattatgggatggatccccaggcagggtagtgtctctagctgcatatgtagcagaagatggcctagttggccatcattgggaaaagaggcccctgggtcttgcaaactttatatgccccagtacaggggaacgccagggccaagaagtgggagtgggtaggtagggaagcagggtagagggaggatatagggaactttcgggatggcatttgaaatgtaaataaagaaaatatctaatacaaatgataaaaggttttttaaaaggtaaaaataaataaatagaaagtcacattgtacactacaaaattttctcctgatgctttcccttttagagaaaatattttcagataaaatacatactaagttaaagctaaagaggcttggaaaagccctgtttctaatcttttatctagaatgatgttaaacaattcagagaagagattaatttttaaaggtacaataagtctgatgtggactactaccctagataaaagtcatattatagttcagaatacatagaaattctatttttaagtctagagatgatgtatgcaagtaatttttatgttttcatctttatttcaacagatgtaactgttcttcttcaagagagaaaggagaggattaagatacccatagcttatctccataatttttcagtttgctcacagaaaatattgacttatgtaaagaaaatcaagaattatacagaaaaaaaagtggttcctataaatgtggcttcttcaacaatctaaccctaatagcaattccttaagagcataactgtttagccagatgtggtacatgtctgttgtctcagtacttgggaggtagaggccagcctaagttgtgtaattgagtttaagactaacctaggataacaccatgcatgtgcatacacagaaacacatgggtaaataaatgcttaaaataatagctaaaagggcacaggagatgggggtcatatagatgcagtgctcaagaataaaattttccaaaaaaataaaatatgttttaattagctgcttttttaccctttattgtgtcaaatgtttgctttatttcacaggtgtacagtaaaagtacataacttgtaaatagaactagcatttacataaaagaaatttagtataaatccttggtttttagtataattttatctgcatatatttgtgctagtgattggtgatcattcatgttaatgatgaatatgttttatttctaggtgtgccaaagaatcagcacataaggattttaaaaaggcagttggtgccttctctgtaacttatgatccagaaaattatcagctggtaattttggtgagtgttttttaattgtctagtttggtttatttcctctggggcatttgctttggtaacaatattgttaactttaaatcactcagtccatcaatgaagtcacctcaaagcgagcccacatgttgattgacatgcactttcgaagtctgcgcaccaagttgtctcttatactgagaaatgaagaagccagtaaacaactggaggtatgttcctttccctagcactgttggtaaggctgtccagaaataactactgtatggttctcaaattcaagtatggacagcttgttttattatttcctatttcctctagtttggaaatttaaattgtacaaaatataagcatactaaaattttcatgcctgaaattacacaacagtcatatattttaaggaaattttagacatttcatttttaccaaaagtttgtcaaagctgctataaagtgagacaatgcttcttctatgtaacatgttatcattaaagtactagagaatatttaaatatctaatcttattcctttcattatgtatgtttatctctgtttaaaagggtatagaacttcttcattctaat

SEQ ID NO: 54 - DNA, 38966 bp, mus musculus
gtttgactgtttacaggaggcgcagcggagcccttggcctcagtcagtcaggcgctggggagcgtttcggtttcacttccggtgaggggccgcgcctgagagggcgggcagtgaagcaaacggacggcgagcgcgggcggtggcagtgacggcggcgccgctgccggggggcgtgcggtaacgcggcggcggcggcggcggcgacggcggctgggcctcaagcgcctgcagcccacctcccggaggcgggctcccggcgcgaggacggacgagaagatggaggagctggtggtggaagtgcggggctccaatggcgctttctacaaggtaaccggctaccggacaggcccggtcctcggcctccctccctccctcgtgtccagggtggcgggcgggcccctcgggcgcggcgggagcggcgggctgtgggatgtgagggagcggcggagtcggggcctagagcccgcctcagcgttccgactcccgcctgaggccccggcgcctggcggaacgcgcgggttgccgagggcggttgagcggccgagtttgtcagcgaagcgggaatgcgaggacaggggatccgatcggccatggggccggtgccgcgggaagtggcggcagcggcttagtccagctttcccaaataatcctctcccagtgggttcggggcctgacacgcggggagccgtgcgggaaccgggggcgcttcagcccggccgccgccagccctgctggacgaacggccgttacgaggcttgggcggccgttaggaggtttgggctccgcgttcggcccacagtccagactttggagagctccccggttctgggcgaggggtgtgcagggagtagtaagaagcgggcggcagctcggaatcacaatggcaactgctcttgagtggcctctttgtgaatttccaaggagggttttagatctaaaagtttcggaaagaccatgacatctgagagagcggtttcaaacgctagccagagccggtatatccacggcctccgaggctctttctaactgggagcaattcagggataagcatgtcgcggcttctaaaaatattaccaagtctgcttattttaaatttccctttgtgtttaagttctcgaggacccgaatttgtgccacagaacttcaggaaattaacggggactgtacgattgctactgaatttttaccaggacggtttggaatgtttgttctgtgcgctgaagtgcataaacttgagtatattcgctttgagttttgcggtgttacagtgagctatatttgaggttttaaatgggcattcatggaactactgagagtttttttataccattgaatatcaagtaacatcgtatatttttcaaggaactttaaacttaagtattgtgtgatttttttttgatactgcataaatgtagatctagcaatattataaattctccttttgtgaatgtttataagctctctaaggccccacctcactagaatattttagtaacagaaggtgcacgtggaaggaagcatggaaaatagcttttgccattgtccaatagttttaagtttattatagaataacttggacatttcaagtgggacatactaagctaaactcgggaaagtgactttagtaaattatgcttttgccaagtttatggagacatttagtggaagataaaattctcgaatcaaggaaatttgtaaaatactaatttatactaaaaatacccttttgttgtaatataggagacagaaagaacacaacatttatgttactaattttaccagtgcagttatttttcaatttgctgtaataaaaaaaatgttccggttagttttggttagtttgcattagaaggtttctaggttctagaatgacagttttagttgctagagttggggcactgagacacagatgagcaagggataatagttaagtagtatttttgttcatctctaataacagcttagatttgagtccgctgttagtggcttttaatgaagttggcttgccattgagggcaagtaccacatcctactcttgaaggatttattggccccagtaattttccttgaaaactgactggaatatatttttttaaagtgctctgtttccactattaatccccttgctttttttcttggctttgtattccaacaacttcttgatttgaaggtgaacaaaaaaggaataggttatgaattatcctttgattccctgaggggacatgtagtgctttttaaaaatgtatattgaaaaattgctattgtgtttaagtttggttttggtgttgtttgtttgtttgtttcaactggtctatataaagggaagggtactgactatcctgaaagaggttcaaattttacaacacttagaatattgactgtgaacaggaaaaataaagtggaagcatgctgagtcgttttctggtgaaattgattacaaaaaatgagaggtaaagaccattatggaaaaactggggtccttgttcattaaattggtagaaataaaaatttaaagtgaagtaagtcaaattcaatataattgaattcagtctttgatttgcttactagaactactgtattgtgaaggatagttgtacatctcctgagaacattaagttagcagaataactatatagaacacatattagcagtgatttgattctttctctgaggatcactaaaatgaagatttcaaaatcacaaatcatgctactagcatgataacagccaaccagttctaatttggatctttttcttttggtgtttaatttttaaaactattaggtttatttgtgactatgtgagggtgagtggatgcttatttgcatcccatgccacacttgtcaagaggacagatttcaggagttgtctgtctccaccatgtggctactggggatggatctcaggtctgcaagcctttacctgctgagccatctcaagatgtggctcttttttggtgtttattttttaagatttgaccctgcgtggtggtgcaaaccgggagtggtggtgcacgcctttaatcccagcactcgggaggcagaggcaggcggatttctgagttcgaggccagcctggtctacaaagtgagtgccaggacagccagggctacacagagaaaccctgtctcgaaaaacaaaaacaaacaaacaaaaaaagatttgaaacttagactcagcactcaccagaatttctagttttaagctttgtttttttctttaacctggaaaaagttggtcacacgtactagtttttaagcccttcagacatgttatatttaaaatctgaagaaactttgatttgtatctcacatgatctttaaaaagccagtaatgttgcaaaacactgctatacatctttattcaaggtgcatctgccccatgtagtttttttgtgtattacagtttgggtatgttgagaatgataatgcattaaattcattttgatatagaatgtatgctgttcagatgtgagaatactacatatgcaaagatttctaggttttatattctagtatcaaaattagtaaaccatattagagacgtatacaaaacgtttaaatttcaaactataatggctaatatctaattattatgtgtaatgatgcaaattcacaaatatattatcatcttaattttaagctcagcatctgagaatagactcccactagctgaatattgttgccatatatagtggtttattaatacacaataatatacagtcaagacattttttaatgccaggtttggtagatctcacctataatcctagcacctgggaggcagagactaatggatttctgagttccatgccagacagggctacatagtgaaaccctactttgggggtgggggcttacaaagtatttagtacccaacctatatatcattttagctacattggcttgtagaagtaaatgttttaccataaactttcacaggtttagaaatttataagcctacataaaatttaaatgaactcacattcatagttttctctgaaatccagcaatcttgaagtatgagtgttaatttacatgttaaagagatgaattatgtaaattaccatattttagcctcccaaatcaaagcaccctttgtaagatttagtgtctttgtgaatgtaacaccccaccttagaaatgtgcaattccagttctatactcatgtattctgataacctcaaaattactaattttgtgcaaaattttgtgcagtgtagtacttgggagttcagattctggcctgctctgggagatgtttgggatcatggttatggtaatagttaccaagtggggagtcttaggcactactttgcctctattaacttcctcccactgttttaatttatataagggatatagatatatagggagatgaaataaataattactaatgtttgtcagggtgctaaaagttttggatctgggatttgaaatcagacttgataatgaaatgataaaatttagcttgaagaagtaaagtagattacatttgttgctcacttttcaatttcattataatctttgctcatatttgtacagtgacattgccttagcatcccataactacaattgttgtataatcttttttaactgtagacacaaagatgtcagtaatctccagtttatgtatccatattctttttttattaaccttctggcttgaaatattttcccataaattcttagtaaggaaagataaggttactctgctgtaaagcttgcttttgttagttaccctaggagcttactaaacctgaaaaactgtaacttatatgaacagtatataaacatcaggaaaacaagtcagtggatgctgttttctttgtacctgttgtctttagttagagtgaatcatttttcttagaatttatggaagaactgttgttgttttacaaagtggggagaataaagattcaatgtatatatgaagccttgggtttgaattatacatcttatatggccctataatttatctctaggaggaaagtttttacttattttatgtgtatgagtgttttacctacatgtatgtctgtgcaccaaggaagtgatagaaaagggtatcagatctccttgggatacagatggttgtgagctggaatgtaggtactaggttttctaacccctagtttgatatcttaaaacttaagatatgtgaagaagtcatgataggggaataaaagtttacccaaataggactggactctttgtcctttgtgtactgctttaataaagcagtgtttgcattagatagttttggtttttatatatcctcaggactatgacttggtccaattgtaattaaatgaagggatgctatgatgacttaaaacttctgtttttcccctggtgaacaaccttagtgtgttttggtcactgcttttttttttttttttgcttttttttttaatcacttctttcaaaccctaaagctttttttttttcctttctagagtgaaagtaaccattattatttagtaattttgtaggactatccctttcttgttctatcttactttttaagcctttatttgaccattaagactttcatttactttcctaaatagcagtctttggatctgtcatgattatgagtgggtaagtctcttctctccttaggaaaacattagcactattgagtgactgacatcctgtggagaactgtaatctttagtcatgcccttaagaacttctggtttgatagccccattaaagccttttttaaagtatagagggagtacttaacattctgaaatgcaaaggcatttatagttctgtatcttttatgaaaattacatatgtatatttacgttacaactttaaaaggctagtctctaggtccttagtttaaaaatgaggaggaatctgaggttcccaaatcctgcagctattatatgatagagccaagattttagagcctatatttaattcataacaaaactcaacctctaagttctctgatcccattaatagccctacatgtcagatccagtgaagctctttgggcattcatctaatctgcctttgaatatatcacagaaatcttctcagcctgttgtttttacatcaacttagcatgataggaaagaattacagcaaaatgaggtttttcaagttggtaggtgaggtgctagctctctagaggaaccttgtgaatgagttaagagagagtcggagagtttttaaaaagcattattggaaaaagtatgatgagaacacatagaaagatatgaaacctgtggggaaggtttactaaaagactttagaactgacaggatgtcttgtcctatccttagtatgtgtgcggggcagagtccacagatgagattcttttatttacttagtaaagcagtaaccagaaggtattaaatgcattctatatcagttactatgcaaacagtgactaaaatgactgattttgaaacaatcatgcaaatatctatacatagataagcctcattaactcagaggcagtggctctgttggatgtgatgattactcaaactatttctgacacttttcatccaaaattatattctaggactgtgaaaacatttctttttgcctcttattttttggctgttttgctttctgtctctgtctctctctctctctctctctttataccatttacagctctcctttgaaagggaacacttcatttttaagaaataggcaaatgtattgaatgcatatgattaagctagataataattcaggcaagtagggggaaataagaatacagctataaagtcataagactaaggctgatttttatggttagtttgaaaactcttaatgttgtaaatgttttaaatcaataggatatgctacaaaccccactgatctacccatagttcttgatccctcaaaatgtggaaggtgaatgggtgactgaatttaattgtagttaattttaatgtaaatagccataggtcacttctggttaccacagacaatgcaaacagcaaagaccagctttggaaagactttgctttacaaaggacaattttctacccagctgtaccaaagttcagtttgctgactaaagagtttaactttttcagcatataatgtactataaagaactagtgctgtgctcttatgctcttgcctcttttttgcctctttcccccttgctccccaacccctccccccctccacatggccagggcctgcctctgcttctctcctctctgcctttctctgcctctatcaccctcttaactcccctccccataccctaaataaactctatactaaaaaaaaaaaaaaaaaaaaaaaaggaaagaagaactagtgctgttatgtatgttgttgtgctgctgccaaggcatacaaacatcatacaactttcaaagaggatgaagacagaagtagttaccttttccttttcttagtcttgattttagttggcagtctaataatctcccccagaaatacattattaacttggtattagctactgtctgaggacaaagaacaccttccccttctccataaatttgttttatagtatataaaaccaagatcctgagtgaacagttctcacaactttttattcaaaatcaggaatatttgttgttgaataggacaaacaatcccttagcacactggacgcatgatacatacttgcttatgaaatagggcatattctaaagtatcagaataatattaaaccagagttgttcaaatatactgtaaaatttttaatgatttaaatatatatttaaatataaataaatatttttaatgatttaaatatatctgagaaataagcaacatcaagtggatgggaaagaaaatttgggttcatcatcatttaaacctgtaaatataaagatataaatatagtacttgctccttgtactaatgacttcatagtccatattcctgctatttgtgaagtctccattgtattgttggcttcacaacatcatttaggggctccaatagggattttatccctgatacacatatcacttgcctggcctccaatatttcttttgcaatttgggtgggactttccataatttttattatacatataaaagctggtgaatcaccaaggtgtgctaccaatgccatattgctgaaatgaatcctggggaaataactttgtcactagtttgagcagagtttctctggtgctgctgccttctcaaaggaacatttattgcttgagttgtagagataagagatattcatccaaacagacacacccctaacacatgcacacatatatacatcatgggtttaaaattctattctttgttctgtctcagctttcttattgttttgttttgtttttttttgaaacaatctcaagctgttttttgttgtctgtttttactcttgcttctccatcctccaactagttgttggctagttcatccttacactttaagggtcagtagaaacttcacctttccagtatgtcttcccttttcaaagtaacagcactaccaaaaaaccagaccttacaccaggtctagaagagaagcatcttaggcagcagtccacttagtagatgttcattgaattcattctaagtatttccaagataatcatgcatatactatatttaacttagttgtagtttctacctgaattgaaacctaaaaagcaaatagaagatagttaagtgaaaagagggaaaggacaatagagcacttatggataagttacaggcttatctttactgctaggcatgtggttctagaataagtttcttaatttttaataatgtagcttaaagcgtacctcttacttcatattcaacactgaattttaatggccagtgtaactatctctttgagatgttaaactcttaagataattttttcttatttagtattgtaattatttgtattcttaaagcctaatatatagtacctagcaaaatagatatggtgaagaagggggcattagaaacggattttcaatcaaagatccattttattctctttttttttccattttttattaggtatttagctcatttacatttccaatgctataccaaaagttccccatacccacccacccccactcccctacccacccactccccctttttggccctggcgttcccctgtactggggcatataaagtttgcgtgtccaacgggccatcttttgatacatatgcagctagagtcaagagctccggggtactggttagttcatattgttgttccacctatagggttgcagatccctttagctccttgggtactttctctaggtcctccattgggaaccctgtgatccatccaatagctgactgtgagcatccacttctgtgtttgctaggtcccgtcatagtctcacaagagacagctacatctgggtcctttcagtaaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccacttctaaggaggggcatagtgtccacacttcagtcttcatttttcttgagttccatgtgtttaggaaattgtatcttatatcttgggtatcctaggatttgggctaatatccacttatcagtgagtacatattgtgtgagttccttaaattcttaaatatctctaaaatttaatttcattggtcttcaagcttaaaagttaatttgttgtggttttttcttgcaggcatttgtaaaagatgtccatgaagattctataacagttgcttttgaaaacaagtaagtttcttactatataatcttaatgttgaagatttttaatgttttatgctcatttttttcttcattttttaaattgaagtctgattttagtgggtttttttttcctattatgaaacaaagttcccagagagctcaggattaaatcaatggaaggccctcttttgctaatgattgaccttagaggtccttactatataatcttgatccttaagtccatttgattatgaaaacaaaagatccattcgtctcaatgaactaaaagttttaaatagtttgtaattttattaaaagttgaaaatatgggaatttatggatgtttacaataaaaatgattataggtttttatactgatttttaattatatggtttattttatcagaagaaattatgtgtcctcattaggttatttttatttttttcatatatttttaatcaataattatgacagttaatctttactgctttttgttctagatcataaaacagtacttaaatatctagaaatatgagctgtatgaaaaagtcaatagtatagatattatcatttcattgggggaaaaattctagtcactaaattcattaagtattaataaagaccattttcaggtagccatttgagactctgaagtacatatgtttagtattggtattaggatttttactaaactttggtaagtgacagttacaacatttagtttttctctaccataataatagtacatccaaggcagtctgaaaatctgtagattaaaaaaaagtagtatagtgattgcttagacttgttaggaatgtgtaagaaaggttataactaaagcataaaatacttcctgttgtggagataaaaacatactataattcactaacaataattgtatattatatgacaacacactatacactattgaatttgtgaattatgtggtttattaattatatcttagtaaatttcccaaactgcagtctgtggcacagagttactaaggactaaaaacaaataccttggttctaaaatattaagaatagacctgcaattcactgtctagaaaaatctaaagttagaccgtaagcttagattctttaagctatcaataagacaaagtagtaacctttgatgcctgatacacatttagaaagatacagatgaaagtactaacagaatattaagccctcttccatgctccagactaataatgttagtttacaagtttaaataatagaatatctttacctgaatgtataaagacaaaagttccataattgcctttttacatcattaaacaatagacaactataatatcgcgtctctatttaaggtctcatgggtaactaaggggataatcttttttgtatttaaactattatttttactttaattatgtttctgaatgtatatctttgtatggtatgtgcaacaagagtgcagatgttaatggaggctagaagcatcaactctggagctggagttagagtcagttataagttgcccaacaaggaggctaagaacaaattaaggttcgctgtaggcgttatttaatggctaagccatgcttctagcttcgttgcaattatacttttatctttttatttccttcactagtaaaacactgtttttaaaaatggccatttgattctctactcgtagttctgaactgtaaactcttaagcagaatctttgttcgttttgtgtttcctcttttggcttccactaaaaaggggggtaaaggaagagaaagattcatcaggaatactgaaagaaaacacagtatttcatagaataggatcttttcatttagaaagaatagcttagttagggtgcttagtttttaacctgtatttaacgtcttcaaatctgtacgattaaagagttaaagacattgttacttctttggaaccaagaaatgtatattttgcattgtatgtctcacaagtgaaacgtaactgacagttcataacatgttaaaggtcactaattatcagtgggtataaaaaagctattctgctgtattttaattatacccttttcaactgtattcataagtaatggggggagtcagtgtaatctcatcattcaacagatttctacaaattctgacttatttgtcctcttgtgcagtagttctttgtaaacagaaagaaaaaaaagagacaaataagtattcctcaaggttgttttattaaaatgtcctctatcaaaatataggcattttatgaagctaaaaaggttactcagcagttaaggatacttgttgttcttacaaaggactaatattcagttctcggcacctgaaactttaattccaggctatctgaatctctcttctggcctctgtccatgcacattcttagacacacaggcatagaagtttttacacagaacagaactgttttcttaatggaaaaagtgactgctctaaatgattgaatcactagtgttcttataaaattttgttacttagtatttgttatatctttgtaagtaaaaaaatggtgttttaaaactattcaatattttaaattaagaaattaggcaatttaattgaactcctgtaggctgtctccattgggtttctatggtttaggagaccccccacacacacaccaatccagtccatgctgatacatcggtagatcagcatccagctacctatggcaagaattgactacttcgtgggatctaaaatttaagggggacaagtgagttgagaattgctaatgtgctgactgccattttgctttggaaagtagaggatagttattgtggttgatggaatgtagtcagaattactttgcaagtagaactatgttgatgataatactaacaattgtcaatactaatttaagcatcaaaggaatttctgttgtagacttgggtttctaaagtgtgagttaaaattattagaagaaaaaccttttaagtaatagttttgatctgttgtctttagaaaaactgtgtggaaacctaggttgctatgctgcatgtagacttcgttaaaatgtctgtgcactgccattatgcaccactcagcaaaaactggccatttgaaggcatttgcttctttaaaccaagaaagagtcacatttaaccaaagttgattgcagcatgctcactatttgcattaaacaccaaaagcttgtcaaataatgatattttgtttatttgcagctggcaaccagagagacagattccattccatgatgtgagattcccaccacctgtaggttataataaagatataaacgaaagtgatgaagttgaggtgagttcccaagccataaaataaccagcgactaagggcatgtgtgtaattttctttgacttttaaaatataccttgcttttaacagtatttaaactaccttgagttaaagttaaaatcccttttagttaattatttgaaatgttatatggttacttatatttggctattcagccacactcaggaaatatcttgtcccaagtttctttaccccattagcatatccttgcctcatctctaaatctttgtgtaggtaatacttttgttagaaagagtcattaagtgagcccatgaaatgcgactcaggttgctgtctgcagaccagagcacttctagtttttctccgctgtttctgctcagagttctgcaacttctgcaatctctagtgctgtctgctttcagggaaagggcgcctagttacaggtcatgtgacttacacatgttgggagaagactgtgctatcaagagtctccagcccacttctcgtgtgtgcgtgcgtgcgtgcatctgtgtgtctgtgtatgtgttctgggcactgaggattgagctagggcttcattcatagatgctgtacacgtgctccctaatgaaccacaccccagcctcacattgacaaggaaatgcagcattgagtgtggggtgaaggtggggtacacagagcagataaacatgattgacctgcctcctcctacagcgggaggcagatctgtcagcaggcagcttttacatcctgtagtgcctgacagcaccagttccaaatattggtatcaacagctcctcccacatcttcgtggtacctcaatccttaaataaaagccattgctgatattaatgccagtagtcccctccccgaaactcacagtgcctcgaaatccttaaataaaagccgtggttgatcatcaaaaaaaaaaaaaatttgttgctattctattcactttttcagcaaaatgaatttggaaaaatagttttacaaaggaaagtaatagttctaacaaagcatgaatatgatattatatgcctatgatcttaaccgttaggaggtggaggttagaggatcaggatttcagagtttatcattggctacatagcaagttagaggccagttcttcatacatgagagccttaactctaaaagaatttttttaagaattctagagccagtgtggtggcatatggcctttaaatccagcactcaggaaacaggcatgtggacctcatgagttcgaggcccaccaagtctatggtactgagttctaggacaaccaagtctacataaagagaccttgtttcaaaaaaaaacaaacaaaaaataattttatataatagactagtaatataaaatttattttagtagtagtgaatctttctgatatatatttttcaaatctgtatcttttatatcatatatagatagatagatagatagatatatacatatatctatctatatatacatatacatatatatatatatatacatatatatacatacatatatatatatatatatacatatatatacatatacacacacacacacatatatatatatcccaaatgtcctttaataggccatactatgaactacatgctcatctaccattgagctcttagaataaaaggtgctgttgaaatttgatcaaaatcattgtatttatgattctctactcattgaaaattggttttctattataatcttatttatcttacaattttgtagtctcttttacctcctacttcccaagccttattttgaggtctttttaaaaatgcattaatttttatagtttcatgcatgtttgtagtataaagcaaataaataggtacttgttaagaggtaagcaacgtgaagttaggtccttaaatgttaattttctgctcaggctatcaggtacatcaatacagtcttcctttgatgaggttacattctagctggaatagctaatgtcatgacaggtgaaagttatatgaaggaagagaaagctaaatggaagataatacaggggcagcaatgctatttcagagtctagttggaggtctctgaatgttcaaacctatgttcttttctctgcaatttaaatgaggaataacatacttataataaatacttataataaatacttataatataaatacttataataataatataaataataatataatatattatatataaataatatataatattaatatataatatattatataatatataataataaataacataaataaatacttataataaataataattaataaataataaagcctaaaactgtacttagtgtattctggatttggctttgcaagagatcttaattgtaaatacagatgttatctaaacctctacaggcctttaagctcagtagataacatgtacttgttcccagggctgactatatgagttagatccccagtcctggcatggtagaaggagagacacagacacatgggggattgtcctctgacctccaattgtacacctataacattaccaagtgaatgtatgtgtttgttctctttcaaaaaccctctggtatctccttccctgtgggcttcttgctgtgttaaagcaaaggccagtttatgtgtatgtttttatggcaagactttggaggggtaaagaaaaccattttgtttttttcaacttagttgcatgacagttgaagcccaatgagatgcatcataaaacttacctcagaagctagtgagatggcacagcagatcatggcaacttaggttctattaatatttatttgttattgtcttcacaaaagattgcatgctacacattgcaaatgaacttgaaaggtttcctaagagataattattagagctgtgtatgaaagccagaaaagtgatattcagaagattgctggaatagatttgtcttttttcatggagaggaggagccagaaaagcagagtagccttcaaaagagatgaaggccaggaccctagtaagctgagtgatcagtgaactcactaacctatctgcttagagtacaggtagttattgcctttgtctgtaactttggattggttttccttgttataataaaaatgatgcttacatggtttcagatacatttttgtagattattgaatagctacagaagaaaatctagtcatgctatggatatcagcttttctcaagtgttcatgtcaagagtactaaatattactgacatagatcagagaagtaaacaaagtgcttttaaccgtgagttctcaagttgtttccaattatgtatttttgtctaagccaacataaatgtaaagtttggttgaaatcatatggtatatgatttcaaagataaatatggactttttaagatttcctcactgtctagtgtctgctgcttttgaattatgttaatcataaatattctgttttataatttttatgtaggtttattccagagcaaatgaaaaagagccttgctgttggtggttagctaaagtgaggatgataaagggtgaggtaggaaaatgcatattgttcatactatttacattttctaagcccacattttaattttggtgtctatttttaataactgcctaactttaagtcattttataaaaatgttttcaatataggtttactatatgcttgctatatgtttctattgattaaagtttccccctccccaagagtttatattttaaaatgataggagctgggcatggtgatccattcccttaatcccagcactaagtggctgaatcacaaagatcagggttaaaagtcatccgtggctatagagtaagtactaggctagtctgggctattatgagttcctttctcaaaacaatagtcaaagttatgtaggtttcccttcttttaaaaatatggctaagaatgacttgtttatttctctcagttttatgtgatagaatatgcagcatgtgatgctacgtataatgaaattgtcacaattgagcgtctacgatctgttaatcccaacaaacctgctacaaaagatactttccataagatcaagctggaggtgccagaagatttacgacaaatgtaagttgatacattaaaaaaatgctatatcagaagggcagtggtggtgcatgcctttaatcccagcacttgggaggcaggggcaggtggatttctgagttcgaggccagcctggtctacagagtgagttccaggacagccagggctatacagagaaaccctgtcttgaaaaaaaaaaaccaaaagaaaaaatgctatatgaaaaaatgctgggaacatgcaagggtgtgtagttttacaaatatacattttatatacacatacatatgtgtatataaattaaaatattatatataggttactgcatatataaattaagatgttatatccaggttactaattcagaatgtaaattttaaaatgatatgttttgtatctttgtcaaaagtagtttggttacagtagtgaaggaaaaaaattttttttcctagttatataatcaagcaagtcctgtatttgtttaaacttacttgatatatggctaaagtgtgtaaatctacactgagttctctaaacaaagattttttttttcataagctttgaagattttgaaaatgatagaattctatcaaaagtcacattgttcatattgttgttccacctatagggttgcagaccccctcagctccttgggtacttactctagctcctccattggaggccctgtgttccatccaatagctgactgtgagcgtccacttctgtatttgccaggcagtggcatagcctcacatgagacacctatagcacggttctttcagcaaaatcttgctggcgtatgcaatggtgtcagcgtttggaggctgattatgggatggatccccaggcagggtagtgtctctagctgcatatgtagcagaagatggcctagttggccatcattgggaaaagaggcccctgggtcttgcaaactttatatgccccagtacaggggaacgccagggccaagaagtgggagtgggtaggtagggaagcagggtagagggaggatatagggaactttcgggatggcatttgaaatgtaaataaagaaaatatctaatacaaatgataaaaggttttttaaaaggtaaaaataaataaatagaaagtcacattgtacactacaaaattttctcctgatgctttcccttttagagaaaatattttcagataaaatacatactaagttaaagctaaagaggcttggaaaagccctgtttctaatcttttatctagaatgatgttaaacaattcagagaagagattaatttttaaaggtacaataagtctgatgtggactactaccctagataaaagtcatattatagttcagaatacatagaaattctatttttaagtctagagatgatgtatgcaagtaatttttatgttttcatctttatttcaacagatgtaactgttcttcttcaagagagaaaggagaggattaagatacccatagcttatctccataatttttcagtttgctcacagaaaatattgacttatgtaaagaaaatcaagaattatacagaaaaaaaagtggttcctataaatgtggcttcttcaacaatctaaccctaatagcaattccttaagagcataactgtttagccagatgtggtacatgtctgttgtctcagtacttgggaggtagaggccagcctaagttgtgtaattgagtttaagactaacctaggataacaccatgcatgtgcatacacagaaacacatgggtaaataaatgcttaaaataatagctaaaagggcacaggagatgggggtcatatagatgcagtgctcaagaataaaattttccaaaaaaataaaatatgttttaattagctgcttttttaccctttattgtgtcaaatgtttgctttatttcacaggtgtacagtaaaagtacataacttgtaaatagaactagcatttacataaaagaaatttagtataaatccttggtttttagtataattttatctgcatatatttgtgctagtgattggtgatcattcatgttaatgatgaatatgttttatttctaggtgtgccaaagaatcagcacataaggattttaaaaaggcagttggtgccttctctgtaacttatgatccagaaaattatcagctggtaattttggtgagtgttttttaattgtctagtttggtttatttcctctggggcatttgctttggtaacaatattgttaactttaaatcactcagtccatcaatgaagtcacctcaaagcgagcccacatgttgattgacatgcactttcgaagtctgcgcaccaagttgtctcttatactgagaaatgaagaagccagtaaacaactggaggtatgttcctttccctagcactgttggtaaggctgtccagaaataactactgtatggttctcaaattcaagtatggacagcttgttttattatttcctatttcctctagtttggaaatttaaattgtacaaaatataagcatactaaaattttcatgcctgaaattacacaacagtcatatattttaaggaaattttagacatttcatttttaccaaaagtttgtcaaagctgctataaagtgagacaatgcttcttctatgtaacatgttatcattaaagtactagagaatatttaaatatctaatcttattcctttcattatgtatgtttatctctgtttaaaagggtatagaacttcttcattctaattggttgtcactctttaaaactcctgtcttcagattcctgccagaggctatttccctaacttactatttcgtctcttaaggtgcattttatctacttttattaattctccaataattgccatcaccatgcatttattttcattgataactatctagtacttccattcattaccatagaaactaaatggagtttgttttaatgtaccaactcaagtagattactgtcaatttaaagagtctccctcatcattattcatttcgttagggagaatcatcagttgatatagcaaaagaaaaggggagtttcaaattgtagtttaagaaaaaaggtagtcaaggctatgaaaattgccaattaccaactttgtgtatgaatgatgaactcttaacagaaaaggaaaaatttacttttgtttgccaaatggctgttgaggtctgtttgattagttttttttctctcattctttattgatgtcccccatgttcacacttttgtggtttagcgattttctcataacttttaggccacagcagccttcttaatttcattgtgagtattatgaacgtgtactcatatatctcttcttaagcatctaattcttcttgaatgttctttaccatacctttggtttacatgtatccataaattatcaatgggaaaaatgaaccagggtaatcacgatccaaaaacgtgacttcttggaaaatcttcgaagattttatatactttactaccattacctttgaaaacaactattgttcttttaaaattgcttacattagatatatttattcattcaaattatctggtgtgttgaataatgataaactatgtgcatgcctattttcttcactactaatattaaagaggttcataaacccttttaagaaatacccattttcaacatgagccactaatctgtttggttttcattaatggcatgctagaactaaacattcagttttgatatgctttttaaagacagtgattatccacataatatggggtatcattggaacatagttttgtcattgctgaatattttaaagagttcatcaagcttttgtggattcagatcacaaagtctaacagactctgaatataaaagtaatataaaattgatatttctgtattctacgagtgttcactttactgttaaaccacagagttttagggatttttttccctgggtttgaggagagagggtgttgtcttaatgtcacatttcagctgaaggatgtttagatccaccatacctggttatatattatgaaaatggcaccatttctagaaaaagtacttatatatccataataagtgcagtgaatatttttttattaaagataccatttttaattgttgcttaaattgaattgagtctgtcagacctagtgagctgttcttaattgggaatattttgtctgcttcttaattattacattgtggatatcattgaataacaaaggcagccttgcaaataggtttgcaaacataaccttgaaaaactgtcaataaactttttcctgttaacaaaaaaaatgttttaaatggcatagaccttcattagcctcaaaagaacttgtgtgattctaaaattagtttttctactatgataatttataggaccctgatatatagggtcaagataatttacatggctgacctaaatgaaattgtcttaataattgataaaacatgttaatcagttgtgcatttctcttcagagttcaaggcagcttgcctcaagatttcatgaacagtttatcgtacgagaagatctgatgggtttagctattggtactcatggtgctaatattcagcaagctagaaaagtgcctggcgtcactgctattgatttagatgaggatacctgcacatttcatatttatggagaggtaaatatttcaccatataatccaacttccccctcatagaaacaaacaaatagtatttcaaatgccaaatcttttgctttgatattacacccactcaaccttctttattaggatcaagatgcagtgaaaaaggctagaagctttctggaatttgctgaagatgtcatacaggttccacgaaacttagtaggtaagtaaaaaataactttatatataccacaaaaaataaaatcctagtacacaacttctatactagttaaacctcgtttcatcactgaaagtgtaatctgattaagtcaatctttgagatgtagcctgttcttacagtgtatagaaaataatactcaaagattatattttcagaagatatacaagaaatagttcagacttatatgtctgaaaggataatttttacctagcctcctcaaggtatttttttaatcatagcattagatttttttctaaaatgactaaaaatttaagcttttatagtttggtgatatttgagaaaatgatagcattcatgtcagttatctctgggttcaaaatctggatatgtctagcatagacatagtttgaaagataaattcacaccaactgtctttggattttatggagtcagtagtagctccttataaattgataaatactgtttcctaatcatcactgtgatggctgttagcataggaacttttcactagtattcccaaattattcagttgtctttagtagaacaaactaaaaccaggtatgggtttattttttaaaatgtgttttgagctgggcatggtggcgcacacctttaatcccagcacttgggaggcagaggaaggcgaatttttgagttcaaggctagcctggtctacagaatgagttctaagaaaaccagggctacacagagaaaccctgtctaaaaaaaaaaaaaaatgtggtttgaatttataaataaatttggggcatattgcttcttaatcctcttgtagaagtataaagtgaacaaacttcctgtgtagtttatgtatatagcttaaaacattcataggctacattttgtcaaaatagaatagtaatcatcttacagtgtcatttaaaattactagcaatagcccagcattcaggagacaggcacaaagatcacaaatttaaggatagtatggggtagggatagcaagatcctgactccaaaatagtgtccaagagtcatggtattttttaccattaattaaaaaaaaacttgaaggtaaagaacaaatgctaatgaaattagtttacatgtatgctgcaacacaagaatgtgaatgtagtgttaccaacacacataccagttgtatagaagatacatgcatagcacaggatgaactaatgattatgatagaaccatggtatccattaaattttgatagtgctatagtaggtgaaaatatttacacatatttgataccattgtgactttgggtgactgacttagctcttgagagaatgcttttccttcacttaacatgatatcaacgtggtattcaaggtctagatgcttaatgaggtgttgttatgtgtagtacttagcacagttctgggtacagaaggaaactccatgttctcttttgtttattcataacttcttcatttcattacagcagatttatagtaaattctgttggaatttggaagtaactgcaatatacaagtaaactagattcaattagattaccaaagaagaaagagattatacctatagtcttgcattaggtgtagaggatgtttaaagttggtttgcaccaaaaaaaaacctattgcagaattgagttttctttacgtttatacttagtaaaacaagagaattctggtttgatgaggaatgctgcaacactaggaatactgggcttcttcagaaatcagtttttgttagttcggtttgctgggcaggtttcagggtgacgtcttaatcactattacttgagtctcatctactgattgattacctatttttcacaagccttcttcagtatgcacaccaatttatcttgcctaaaagtttgtgtgttctatctaaactttgacagtgagtttgtttagacgaagtacttagttatttcttaatagaaacatgctaaagtcctacttttctttatgctaatttgcatctttattaaaatcaactttcatggttatgtaaggattttacagaaaaaaaaaaaaaaacaaactctgagaatactccaggtagggatttttgtacgttcttcatttcatttgaagaagaatagaacagacataatgagatttttagattagaaatcctggtttagtggcatgagttttgttttctaccactgaccaaagagctcaaggtggaagagtatgaaagccacacacagcaataatgtcaaaactgtggctctgattataagaactatgagtccttctgcaagaccttttgctagtttgttatttaaagtagctaggaagcaacttctctcttttcatcaatttgcctgcgctgaggaggcaaaatgagcatatagaagcatttcacccatggcttatctaagtgcttaagtccccctagaatctggtttgcctcatgtgtaggtttctagaattagtagtgcttaatttgtaaattcttgctttacactcatgtatgatagtggctatgaaagcagccatgtcctagttttatatataattgaattttgcacagtggggcaaacaattgctatttagaactactactagatttttctgaatttcaacagatgttactaaagaatacgtataagccttttcatggtagttttggagttatctgaaagtgtgctttacctatgaatatgtatgctactctacattgtgaccaatgcatagaactaatattctgttattaacattggcttgaagaatttttgttccttttagatatttagatagctttctaagctcctgaaacttaagagcatattttcaaatgtgtcatacataattctaaaaatagttcctatgtatatatgaggaaatgtgaatcaaagctagatgagaattgaaattgtcaagtaagcaaatacatttattatccttcttttccttaattccttttgtagagctttacagagtgctaaataccacagtaccagttagtttaaagtatacggtcttatgtgagataaggggttctctttgagttacctttaaattttcagaattacccaatcagttcacaagtattaatcagctgtagtatctgaccaaatgagtttaaaaatgacctaatcaacgagaataatttataattaaactatttttttaaaaagcttctgttttgaatcttataatccagtatgtatatgtatttgaatgtgtaagatagtttatagtggagtgtgcttgtacgatttgagtgatgtcctcgagtcaaacatgaattatttattttaggcaaagtaataggaaaaaatggaaagctgattcaagagatcgtggacaagtcaggagttgtgagggtgaggattgaggctgaaaatgagaaaagtgtcccacaagaagaggtatgtaatagtgcttatttttctggttttgtctaagagaaagagttttgtttgtcttgttttatttttttaatgtattaatacagaggctcctgtattacatgcatataatattttttttctttttgtggtactcagaatcaaatccaggactttgataattgttctgactattggacatgcttaatactatagatactagactatctgttttggtttggcttggtttttgttttttgaagacagaattcctcagtgtagccttggctatcctgaaactcactcttagaccaggctgaccttgaactcagagttctgcctgcctctgctttacaagttctgggactaaaagtgtgcaccaccacccagtgactatgttttctaatgctggactttagataagtaaatttatcctgtatttgtcttcattttgtgatcttataatgggtagtcatgagtttgctattataaggtgtatatcactggttcagccattaatgaatgacaaaaagcgtgcatagacagcctttataaatgcttttgattgagtgttaatgtggtaaagtaagttcattctgtgtgtgctttttctgcacatgatcacttcccccaacatgactttgataactctcagtcctatctacctggacatatgcttattggtgtaaccttgtaagtatttgtatggaaagtggaaagggacagtataacccttgatgcagttgtactctcaaaatgctgtccacgcacaagcttataattttcacattaattagctgtcttttgtgaaagattattttaattgatgttaaatcaatttagtgttttttttaaggtttaattcaataaagtttgtgtgtgtgagtgtttggaggggttgggagaagagctcagttgtgagctgctaagaaccaaacttggttccactgtaagaacagtacatgctcttaacctctacaaaaagccatctctctctaatccctgatttggtttttaattgcataatttttatgctctatgggagctggtgagatggttcagtggttaagagtgccgactgctcttctaaaggtcctgaattcaaaatcccagcaaccacatggtggctcacaaccatccgtaacagaatctgatgccctcttctggagtgtctgaagacagctatagtgtacttatacataattaataaataaatagtgtacttatacataattaataaataaacaaacaaaccttttaaaaaaatttatgccctgtaattttatatgtcaaaacactttatagtaatctatagtcttaaccatcattgttaatgggaaaagatgaacttcaaacattgttcctaatatgttgaattatcagatttctttataaataattaagtggatatgcttaacaaaaaatatcactgacatggtaatagaaccaagttctcataaaattggaattttttgtgttttatgtttttttatcaaggaaattatgccaccaagttccctaccttccaataattcaagggttggacctaactcctctgaagaaaagaaacatttagatacaaaggaaaacacccatttttctcaacctaacagtacaaaagtccagagggtaagaatttgtcacctctaaccacactaaaagtaatttctttgacgcagattccacatttggtatttgggctgttttttctcgttagatttgtaggctactcttactctatattttcacataggtttggtaccatatgagattacaaaacaaagtaatacatattttttcaatttattcacagtgacaaatcttaagctataaacctaatggggtcactttttttctgttgagggtggacttttttttttttcatactataactccttaaattttgcaggtgttgtaactcaaagtgtaccttctattagatgtgttagttacttcttaaagccatattttagaaactgattttcactatttgaactgacctatttagaaatgcatttagaagtcctgcagtgaaagtcctgcgttcaggcttctgtgtatcgttcattatagttaatcacatcacttgcattccttatactgctttaggtgttagtggtttcatcaattgtagcagggggaccccagaaacctgaacccaaggcttggcaggtaggaaactattccttgaaaaatacattttaagttgatattttaatgtttattccccttgttaagaaagactacaaatgagcctcatggttgggggctggtggaggagtatttgtgggtatttggatccacagccctaggctaaatctcaaacatcttcattccacttagaagttcttcccttacatgtccagtgtcattttctaccagtcttcccactgtgtcttataggaagcttgattccttctgaagttcttggaattctctaaaattgaacatactttttgctgctgctttatgtgtgggtttattctacccagactgttctttttcctgtatttgccttatcactttgaccctgttgtatgtgaagctttccttgtgtacttaccacaggtttcctacctgttccatcttcctgtgtgctcacccagagcatgtttttagatgttttcttgttggtctcttcaaccacattgtaagctccttgatgtcagggtcctttgcctggtatatgagaattgcttataataaggatggtataactcagaaaagactaaaagcaaaaatgccattttataccaagaactaaaactgcaagtgaattggacactcctttctgttggacatccctttctcatcttagaaaagagaatcactttgtcctaatattggtattctatattttcaatttattcagatcttctgattagacatttgagttgtccttgggtactctaacagtttgtaccatgttataagagaaaattggtttaaataatgttcttcaaattctacctaattaaatctacagcacaaaattaaaagcttattttggtgattacttggaaagcatgtattatttcgtgacttgatatttggcacttggaaaaagtacaattaatgcctttgtgattatgctattgagaaaaggaataatattgaaggagggcactttttatattgtagtacaaaaaagaaaatctttacaagttcttttcatcccctgatagttcagatagtcactgctactaggaagctgtgccttgcctactatatgataatcagcttacaagcaatactttctgatggttcagttttattgttcatcaacagtagcattctttacaaggatatagaaaatcctgtgtccttcccttcctttcttgaacctactgtatactgaatataaacagggaaagcatcccaacaatagctacatgttctaagaaacgttctttaggaaagagtgacactttgctcgagggacagattcttggcctcctgcatttttgccaaacacttgtaactgtaatacttattacttattagtattacagtattagtgtgtgagtaccaataatcatgtatttcttcagtagcaaaatgattgaactattctcagcttagaatgtgtcttatttatcccctctttaagctagactttcctactggttattatattgaatggtttggggttttttttcttctcttatgctgatgagaaatataaatatttagattatatctttaaaacaatccctatattaaaatgctatacatagaagatcaaagtatttcttatgattgaactttgtaagattatactatatttttgaaattttatggacttattaaatattatgcttataattttgccttggtttttgttcttctacaaactactcagtgtattttaatttaaattctcatttttgttcatgatttggattttgttgatttggttggcaaaattgaggtttttaaatttgtatcattggtatctgattttaaattgaatttgatttaggtagaacttacagtgagtgaattaaagcataactattcatcttgcttaccacagtaaagattgtataattcttagttaaatgtttgttattttgtcaacattaaacagtagtctttaaaacaatgtgatgtctaagaaatcactatattgatctgcccttggttttacatattgatttatattttaaatagatgtttgtgtgttcgccagaccttgtactagggatttagtcattaggtgtttttgtttttgttttcagatgaaccatcactagttctttaggttcactgttacaatttctttttcagggtatggtaccatttgtttttgtgggaacaaaagacagcatcgctaatgccactgttcttttggattatcacctgaactatttaaaggtgaggacaggatgacttttaacttctaatcttcttgtgctgaattattaaaaactgtatagtaaatccttccaaaactaggatccttctaagctgtgcataacagtatatgaccttgtaaaaataatagataaaatacattgtttcagtttatttcttctaaaaacttaatttttcattgtaaatcttacggctaatatcccagttctcaatacattcatatatacatatatatgtacatgtatatatatgtatatatatgtgtgtgtgtatgtatatatatttatttatttatatatagttattctgctaaacccttagattcaatttaggtaatgatgttatatatacatatatatgtgtgtatatatatgcatatatatatatatttgaaccttctagcttttatggatgttttctgatccaaattttgtgtgtacttgcctttgttgtccctcctatgttatttattaaggaaattctagcatttcatgaagtcctctttaaatatttactcttcatacttttctctatattgtgttaatcaaaatataaactacttgtgctttcttgtatatgctcatcttactgattttactgttatgcttccttagcttgcaagctgggaagtaggaacccagaggctattatattagtaaaaatagcatgggattggcaatacatctgtgaagtagctatgtgtactttttcaatttccctttggcccaaatataaaatttaatgaaatgaaatcttaattgtttttagtgttataatgtcttatttgttaaaatatatgccagaattattctataggtctttttttaaagtctacaaaataatctaagttctattttatttatgatactaacttaagaatgtgtttgctgacttaaagaataaaatgtgaatcagtcttctagtaagtaagagtgaaaggaaaaaaaacggtgcagtacctggtcattttgttcattcttaatggtggtcagttaataaataaaagtgggaaggtttcatccagcaaggtttgcatgggtaggatgccactttgatttgcttatttattttttgttggacagtgttttatgtgcaatctgttgtatgttttcctttataatcttcactagaaataattattgtgacctagatagacagagctgcattatatcatgtcccttgttctttcaattaatgctttttcttagatattttatttttctctattgaatattttgtctgttactggcagctgttctgttgccattcttatcatcaccaaatcatcttttggttgggtctagcatctcaccaaaactaagtacaatacctaagtgcaataactggaataccattctcttatgcaatttctagataacacattccattagctagaaatatacctttgcaggaagccactagtctttcctttttcctacccagtttatcacagattctggtttagagagcaagttctctgtggattctcagtctgaccgtttttcaccccccaccccatgtcagaaccaaaatttgacaactttgtttcaatgacctcttcttgattgacacactgaatatttgctgtagttacagatcttatgccctgtagctaataagtgagatgctcatggatatgctagaaaggcaaggattaacgtgaaagtttcatctggattcgacagatcccatgtttttgtacatgctatgtataagggtctatcagtggattctggagttgatatattttgttcaactcaatgtatattgtttgtaatacttgtttaagcagagttttagcattttaaaagtttttcaaggcatgatgtgagaactaggtgttttgatgtgagacctagggatttcctccccttcatataaaggaatattagcatgtttagttcattgaaaataagtgatccgtaattatatctaaaaatactacatgctctttaaaaaatataccccaagtacaatacttagtaaattagaatattaactgacaaaataatttcattgagctcatttatgtgtgatttttaaaggttagttgattaaatcttaaatgtctgtcatttatctgtatttttatactttttagtattgttttagtcaatcttatttcaaaaagtccccaaactaatgtatctctgccttatccatagactaattgaatagcagtgccaaatcactcaaatttattcaatataactttaaaactgagtgtttttgttatatttctaagtcttgacatcagtaagtgtatcaatagtaatctttctttttaaggagaccattcaatttcctaataattctgggttaacagtgtttactataaatttagaactgaagtcgaaatatttccagtatacttttttatctgatgaaaaggagaaaggtaatactaagtaaaatgtcaaattatttttactgttatcttgtatattttaaataggaagtagaccagttgcgtttggagagattacaaattgatgagcagttgcgacaaattggagctagttctagaccaccaccaaatcgtacagataaggaaaaaggctatgtgactgatgatggtcaaggaatgggtcgaggtagtagaccttacagaaatagggggcacggcagacgcggtcctggatatacttcaggtacaaactaagcattttcctcagttactttatctgttcctagacttaatagctgctaatctctaatattcattagaactccattataacaatttctcactacatgttttccaactcacagtgggtcaaattgtgtttcaagagacatgtagaataaaagcccgttaatgacacacatagttcacagggcagttgtgagttctgtccatattctaattggggataaatctgcttaagcccttatgtgttgatgacctaagacctctcctgattttattactgtatagccaaaacttttttcatttgtgtactgtggctcattttttgtcaggcatgtgctggtcatacttgctggatggactgtgtaaatcaggggtctgcatcctatggctcataagatgattttgagtggcatggccaaagtcagccataggcacagtcaagaagtaggggaagtgactctttgccttcccagcttttctatccttgctgcttctttcttttctcccagtaactttcagtgacaccagtgcccagctacgagttcctactgtctttcttgctcgactatgtatctatgtaacttgctaatgatggtataaggtgtaatccatctcacaaatatttgcatttcaaaagggaactctttaagatggaaaagccttcaagatccacaggagtgacgctataatggtgaagctataattgctcattagctccaacagaggaagagagagaggtagtagaggtgatattccagagtggggaaagacacctactcataaggccaatcttgaacctaacccttaaccctcctcctatcagtttgttcttttgaccaatgaatttccatctcactgtggagctcttccccccactcccattccctatatcattaaccccctcagatgtaaacagttgttttatagtgatcttttgtttagcccttcccactgggagtgggagggagattgtggggcatgcatcaggaatgcatatcccctttcattggggataatcccacagtagcccctcccctgagacacaacaatcatggtggcctttattggctgcttttagagttggccaaattgtacatccttctgtccctgtgtctactaaaagctctcattatagaagttttgcttatcaaagtattacattgttatagacaatttttcctctattgatcacagctatttaaaaatatggcacattcagatctgaacttagacagctaacaaaacacctttttaaaagatgtctaacaaaaattacttcaaatatggcaagccttttactttgaatttaaaacacagataagtatattctttggtaggcttctaaattgggaagaatattgaatcacccctgaaacttcatctctggaagcttctgttaaccttttttttaaagtcagacaatggtatataacttttaactctcgataggaactaattctgaagcatcaaatgcttctgaaacagaatctgaccacagagacgaactcagtgattggtcattagctccaacagaggaagagagggagagcttcctgcgcagaggagacggacggcggcgtggaggaggaggaagaggacaaggaggaagaggaagaggaggaggcttcaaaggtatagctgagaagaaaaggttaaggccagtgagatggctcaatggataaaggtactaactgccagtcttaaccctagttcaatctccaggacccacatggtaaaaggagtgaagtgactcctgctacttatctcttagcctatacatcaactatggtatatgtgcctctacaaagatatataagtggttttttgtttgtttgtttttgtgggttgttgttttgtttttttgtttttttgtttttttttgagacagggtttctctgtgtagccctggctgtcctgttactttgtagaccaggctggccttgaactcagcaatccgcctgtctctgcctccaagtgctgggattaaaggcgtgcaccaccactgcccagctgtaagtgtttttaaagagagaaagaaagattaaaagtaaactgttagctgtttgaagctgagtaaagaatcttggtgatatagtctgttttgggcttatcatcatcatagcaaatgattactttttcatttgtttgacagaatattacacagccttccttgtgattttttggaaactatgactaaatagtgataactaatttatattcttcgtagttccttaccagcatctggttgttaatccagacagattgacctgttgaatcaaccttcagaatattttgtttcttgttaccagaatagattatttacttgtacaattggaattggtaggctcttcattacattttagcttctattgttggtctgaatggggaatctgaaaagagagaattttgagcaaatgttttaagagtcactaactgttaaacatttttaaaatatacaggaaacgacgatcattcccgaacagataatcgtccacgtaatccaagagaggctaaaggaagaacagctgatggatccctgcaggtaaaacctagtttccatctaagtagtttgaatatgtgctttatttttcagcatgttcaaagatgataaattcatactatatgaaatatttttcttcagcattacagttgtagacagtctcagtcctctgtgacaaatgtacaagtatgaggatttttccagtgaatatatggttttaagtatttgtgaacactttggcagccacattgtaattctcagactcagtggtggttctcgaaccctctcaaacaaaatattctgaatgaaatgtactaagtggctcaagtcaggtaccctctccctttaactgcagagataacctgttgtccttatctgtcttgtagtcttgataagatcgggcttctggtgtccagctttccatgccctgtggatcagctatttatttatgtgcacaatctagtctgaggatccattttcaagtgagctattgtcagtgcttaaacggttgttaagtaatttcagctttactccctgaatacatccaggcatctttactaagtgcttcatgtgtattttatctcacttaatcttacaataatccactgaggcaagaagttttattatccaatttttaggtgattaagtagaagctgcagttcattgcccacagttacttacctagcatatggtagagtgatgatcattcaaactttggtatgtgatctctttcactttatctgtaatgataactctaaattttttaagcaagtaataagagttcctttctgctgggcagtggtggcgcacacctttaatcccagcacttgggaggcagaggcagttggatttctgagttcaaggccagcctggtctacaaagtgagttccaggatagccagggctatacagaaaaaccctgtcttgaaaaaccaaaaaaaaaaaaaagagctcctttctgcctataaaccaatacacacaattagctaattttaactcaaaatggtacagtagaatcttctgaatccaaaccaactctaagggagtcttaacttcatggcatggtccattctgaaggaccagacagaaaaggctaatattgtttgccattgacacttaaaatagtttataccccttagaatgttatacgttaatcttcataccttccttggatcttagttctacaaatcattgttttcagatttctcctcgtgattctgtttttcaagattcaagttagagagccatctgactcttcttactgaagtacaagttcctagactgatacaaactaaaatcaaaagtgtatgctagaacattatttggaatttcagtgtttttctgtgttttttccatgtatgtatttatgtgtatgagtatgtaggtacatcaggcattggatcctttgaaactggagttacaggtgattgtgagccaccatgtgggcacatgggaactgaacccagagcctctggaagaacaggggctctgaactgctgagccatctcaccagcccccactatttagactttgaaggagttgtaaaagaggtttctaaaggatggggtggaacttttggtatagaaaaacttactgatactataatatatgtgtatgggaactaaaggttagctcatgaatgggttagttgacttttcattcaggtgaagctatcataggaaggcatgctttttttgtctctcttggattttatagttattgctgaataagccattccttttgaaatatgttgttgtgaggtgtgctttgtgtgtgtgcatgtgtatccatatgatctgctgtatactttgcctataccttatatattttctattagccaataatagtaacttaatttgaatggcctcactgatttttgcttagaatataaaggtgacgaatacaaagtgagattttttttcttatagattgtacacagtgagatggctactgttttccagctaaataatattgttttaaaaacctaaaccaataaagaaagagcctaccatgctttaatttcttacagttctattttcatctgcatcctccttctatttttttgagacaagattccacttatgtagcactgggtagcctagaactcagatccatctgcctctgctttccccattaacatgtggcgtatgtattacaggcttaatatttcttgtgaggccatttatataggatctagtgtgtatgtatatataacaagtataacttgttttagatcacagttaactgcaataatgaaaagactgtccatactaaaccattacagagtgcctccagtgaagggagccggctgcgcacgggtaaagatcgtaaccagaagaaggaaaagccagacagcgtagatgggctgcaaccgctggtgaatggagtaccctaaataagctacataattccgaagttatatttcctctaccatttccgtaattcttactccattttagaaaactttgttaggccaaagacaaatagtaggcaagatggcacagggcatgaagtgaacacaaattctgcaaagaatttttttgatattggcaataatcaacaatcttccagatttgcacaaaaagatcttgaaatttgatgcataacttttaagtacacttaacacttcagggcaggattttacttttattttttaaaaatactaagcagtgatctttattaactaggaccattttcctgaattggactatataactcagcagtatgtttcagtctttcggagtaaatcacatttgtgataatcatactagatctctgtcttcagtctcatttaaagtcttcatgaaatgctgtgccatttcatgtcctgtgtcagtttatgttttggtccacttttccagtattttagtggaccctgaaatgtgtgtgatgtgacatttgttattttcattagcaaaaaaaagagttgtatgatctgtgccttttttatatcttggcaggtaggaatattatatttggatgcagagttcagggaagataagttggaaacactaaatgttaaagatgtagcaaaccctgtcaaacattagtactttttagaagaatgcatgctttccatatttttttccttacataaacatcagcttaggcagtataaaaaataggacttgttttttgtttttgttttgttgcactgaagtatgacaaatagtgttattggaagggatgtgtaatttttctgtatagacaggagaagaaataactatcttttcatttgggagaggctaaagatgttttcagctacttgcaaatcttcctggtcgaaagttagtaggatatgcctgctctttggcctgatgacgaatttcaactttgaaacattttcttttgtcctccccaaattttgtcaagttttttcattcatattttacattaaagcttattttggggagatatgaaggtcatcttcataaatacataacaaccctcaaaagtatataggtactttgtctgagaaacattgaaagcaggttaaatgttttgtaactttgaaatacaaagtctaatgcataagcagaaccgaaaagcagaccgacaattggttaacaaataattctttttttttcttttttgatgtgttgagtcttatttttgtggggtttttttctctctttttttttaaatgactgaaattcactgaagaaaaatatgtgaaggaccttcactctgagatgttatatttttttttaaaaataactctgagtaggggtaccactgaatctgtacagagccgtacaaaccgaagttctgcctctgatgtactttgtgaatttgtttctttgaattttcatttttcatttagttttccttgcatacaaataagcatataaaatggcaacaaactgcacatgatttcacaaatattaaaatgtcttttaaaaagtattgccaaacagtaatgttgatttctagttatttattctgggaatgtatagtatttgaaaacagaaattggtaccttgcacacatcatctgtaaactgttcagtttaaaatactgtagataattaaccaaggtagaatgaccttgtaatgtaactgctcttgggcaatattctctgtacatattagcgacaacagattggattttatgttgacatttgtttggttatagtgcaatatattttgtatgcaaacagtttcaataaagtttgatcttcctctgctaaattgatgttgatgcaatccttacaatgattgctttta

SEQ ID NO: 55 - DNA, 38966 bp, mus musculus; identical to SEQ ID NO: 54

SEQ ID NO: 56 - DNA, 496 bp, mus musculus
tcctcggcctccctccctccctcgtgtccagggtggcgggcgggcccctcgggcgcggcgggagcggcgggctgtgggatgtgagggagcggcggagtcggggcctagagcccgcctcagcgttccgactcccgcctgaggccccggcgcctggcggaacgcgcgggttgccgagggcggttgagcggccgagtttgtcagcgaagcgggaatgcgaggacaggggatccgatcggccatggggccggtgccgcgggaagtggcggcagcggcttagtccagctttcccaaataatcctctcccagtgggttcggggcctgacacgcggggagccgtgcgggaaccgggggcgcttcagcccggccgccgccagccctgctggacgaacggccgttacgaggcttgggcggccgttaggaggtttgggctccgcgttcggcccacagtccagactttggagagctccccggttctgggcgaggggtgtgcagggag

SEQ ID NO: 57 - DNA, 548 bp, mus musculus
cgcgcgggttgccgagggcggttgagcggccgagtttgtcagcgaagcgggaatgcgaggacaggggatccgatcggccatggggccggtgccgcgggaagtggcggcagcggcttagtccagctttcccaaataatcctctcccagtgggttcggggcctgacacgcggggagccgtgcgggaaccgggggcgcttcagcccggccgccgccagccctgctggacgaacggccgttacgaggcttgggcggccgttaggaggtttgggctccgcgttcggcccacagtccagactttggagagctccccggttctgggcgaggggtgtgcagggagtagtaagaagcgggcggcagctcggaatcacaatggcaactgctcttgagtggcctctttgtgaatttccaaggagggttttagatctaaaagtttcggaaagaccatgacatctgagagagcggtttcaaacgctagccagagccggtatatccacggcctccgaggctctttctaactgggagcaattcagggataagcatgtcgcggc

SEQ ID NO: 58 - DNA, 2747 bp, mus musculus
cgccccgccccgtcccgcccctttgagctgctacttagtcggtccgaaggcagagccttccaaggtggaatctggattctgctgccaggaagcggccggcgcacgagtggcgcgaggcttggcttccacgtgcgagcctgctccaccaccccgccctctccgagcgcccaagcctgggggatccgtctccatgaacgatacctacgccctgccgtggcactagctgtggccaggacgtccgggtgcagtcgcctgcctctggatctcgctccaggtctctccttttgttctctcctggggtgggtaggagtggggccgagtcagctcttacgggactcgccgaggcccacaacctcggtgaccctcttgttctctgggtcttccgggctttagaggagagccgggccttgaacccaacttctccacacatccaaaattgaacttggggagtgatggagatcagagcaaatgagaaagtcagaaaaggggtgtggagggaactggttttagtcctcctagcacttcagagaccggtagacgcccagctatcttctggggtatgtctcacgaaaactccatgtaagcggggcagggagcagcgcccaagtggcggcagcctcgggtctttttccaggggcgccttccttggtgttctcactgtgggtggagcgcgaggagagaagcaggcggtagaggaatgtccctgcggggacactgaaagcctgccctcaggacaggggttgacttcccgcctcagtagcctgatccacgctgcaggagtagagacaaacttgccctcactccgcgccttgcctctctccacagcacccactgcccgacgtgcaggacgctgcgcgaccatggagagtctgagtcggtcatgcctgtggctgcgtcaggagctgtcgtccccgcgcccacagcttctgctgctggactgccgcagccgggagctgtatgagtcggcgcgcatctgcggggcgctgagcgtggccctgccctcgctgatgctgcgccgcctgcggagggggagcatgtcggtgcggtcgctcttgcctgggccaccactgcagcctcccccaccggcccctgtgctcctgtacgaccagggtagcagtggccagtgccatcgtgaagcagcggaggctgaagcgaaggccgaacctaaggctgaagcggaggccgaacctaaggctgaagcggaggccgaacctaaggctgaagcggagaacgaagcggaggctaaagcggaggccaaagcggaggccaaagcggaggctaaagcggaggccaaagcggaggccaaagcggaggccaaagcggaggctaaagcggaggccaaagcggaggccaaagaagagtgggatgctgactcggtgctgggcgtcctgctccagaagctgcgggaagaaggctacccagcatactacctacagggtaagtgagggtcagtggcctgagagagcactctggagaggcctcaggtcaggagaaaagatccttctttccaaggggatttcataattactttatccttcagcaaactcaatcttattttgtctaaaatatagggtaagcgcctccctcctgataacctgcccaacagcttttggggaggcagagctgaccgtgaccttgggcaagtccttcatccctccaagcccatttataagtctggataatggggagaattgacctgaaacaacctggttcacaggataatgccccaagactaagggctgcattgggcacttatcagccaaagaaacagtcactaatgctgagtgagggtggatggctgtctatagcacagcacatgtggtttaaacaaatctgctggcttatgcgttccctttggcaatatctgcaacccccaccccggagagctgtgtggtgtcagctccctagccccagctagggatacttggctgcccagaggctatattaactagtaagacctcgcccttctttcctgacaggtggcttcagcaagttccaggccgagtgtcctcacctgtgtgaaaccagcttcagtggtcgtgccggctcaggcctgggctcaatgtctagcccagtgcctgtggtggggctaggtggcctgtgcttgagctctgatttctctgatgcagagtctgaggctgaccgtgacaccttgagctgtggcctagattctgagaacaccacatcccctccagctgggctgctaccacccttcccagtccagatcctgcccaatctctacctaggcagtgctcgagattcagccaatttggagagcctggccaagcttggcatccgctatatcctcaatgtcacccccaaccttcctaacctctttgagaagaatggtgacttccactacaagcagatccccatctctgaccattggagccagaatctgtcccagttctttccggaggccattgcattcattggtaagtcctccctactttgtccccctgtccctccccctccacaatctccacccaccagactgattcttggcctctcgtcctcctgactccattcccagagcccacgtgacacttggggaggtgggggtagagctcaggtcaactgccagtgagagagatccttcagatatggtctcggcagggtagggaggcagtgatggtgatcccagaaattcgtatagctttggtctcactcatagtgacccttagggggtgtttctgttctgtcctgttttacctagatgaggccttgtcgcagaactgtggggtgct

SEQ ID NO: 59 - DNA, 2747 bp, mus musculus; identical to SEQ ID NO: 58

SEQ ID NO: 60 - DNA, 937 bp, mus musculus
ggtcgcgtcgggaaagagagggacagttggagtgccaaggcgagtctttgagtccgccgcggcccggagagcggctgtagccgccgccgccgggaaggagggggctagtcgtacccgggaccaccggagccgccagcgccaggagagccgcaagcgaacaggacagccacttggggctgggccggggccgcgggcctcaggccccttgctccggccgccgcttgcagacagtgggcttccgatgccacccgcgacgcgctagggtgagcctccggcagggcgagcagtcctcgctgcagccgccaccgccgcccgagccgcgggcaggagtctcgggagccgccgccgcccggccaggctccaccgccgcccgcgcgctcccgggcccccgacacacatgagattcttcaggctcactttcaagtgcttcgtggactgcttctgactgcgccgcccccgccgtcccgcacccctcccgcccacccgtcgccccgtcccccggcccggccgcccccgaggcccccgggcgggcccgcgctttcggggccctctctccaggtgccaccggagccccctcgcccgcccgccaccctcgaggcgccgcgacccccggcccggcctcacggccccgctggggccatggcgaaaaagagcgctgaaaacggtatctatagcgtgtctggtgacgagaagaagggtcctctcatcgtgtccgggcccgacggtgccccagccaagggcgatggccctgcgggcctgggggcgcctggcggccgccttgcagtgccaccgcgagagacttggacacgccagatggacttcatcatgtcgtgcgtgggcttcgccgtgggcctcggtaacgtgtggcgcttcccctacctgtgctacaagaacggcggaggtgagtgccttgcccctgagcatcctggcttttcat

SEQ ID NO: 61 - DNA, 31409 bp, mus musculus
agctggagacgacagcggcaaaggcagcggcagcggccggccccgcgggcggggagccgtgtggcccacggcccctgacagcccctgacggccccggcgggcaggcgcgctcccgcgcctcctggggtgggggggccgtagccaggcaacgcccggcgcgcccgcccatcccccgccgccctttttttcccctggctgggtgcgaaggagcatgcctgtgtctggcctcggccagcaaagagttaagtcgagaggcttggagctgccttcctcttgggggcgtgcccccctcccccgctaggcggctcggccccccggggtaaggtatggccccgggcccaggcccgggacccgtggtcccacgcactggccagtgaaagataccttcctcttcccgctctcctctttccctcgccggccagcatcatgggatgtaatatgtgtgtggtccagaaaccggaggagcagtacaaagtgatgcttcaggtagggcgcctgggctgctggggagagggtcgcagccggacctaggaaaactgtaaaccccgagggggagggccaggtagagtcaagaaaggcaggtgtgggagggcgagagggctcgagagaaaaaggtagggagctgatctcgccctcagattatgggttgctgggtgctggcgccctgtgggaaccatccagggatggaaggaactgggtgaagaagatatgtaggtgttcaaggcacatcacctggcactccgagtgcgtaacgaccactaaccatgtgtccagatcagcccaggtgggaagttaagattctgtcccgggacagtgaggcgctcagtggcccgcgcgggatggaggttgcatagcaacggtctggattcccggcacatggtcccagggttggagcctgacccaaagaagcagtgaagtgcctgcgggacagaggccgaatcccgggcctggcaggccagatttaaaacgtcgtcaatggagctgggtttgagtacccattttcccatccactctctagactaagtcacgactgtcgatttcagggcctcaggcattttgggtgagtgggtgacgcggggatcgatcggtggtgcccagcacgtgctctgcctgttggcatccgctttggcctgttgggccttgaggacaaggagggtgttgagagcgacgcgtgcggggcggcaggagataccctgctgcccgcttgcaccttgagccaccttctcagccacgagtggggtttccttgcctgtgcgtggcgtgactacgtgagtgcgtgcctgtgccccgtctgtgtgtgcgccgaggcttgccagccccgcgcgtctatactttctgtgtgtgcaccctgagagtactttagtgaaatgtgtccaggatgatgtgcactgaaatatactagggctgagtgtagagaaaagagggagtcgggaccaggagccaaagtgggagcagacaggtgagtctagtgacttgtgccccagctattgaacttgttgatcagaaccagggaattagtgcgcgcaggtgttggctgggggagaacctgtaggttcctggatgaatagaggaaaaaccttcaggaacgtggcgggagtagaaggggagattgtgtcaatcatagtagtgtagtggtattgaggtggcctcgggagcccaaaatttttgctgtgatcttaccttctctattagaaagaataagaggtaatgtgcaagagagggtgggcatggagggccaggttgggggtggtcttgtccaagcctgctggcgtttctggtcttctctatttgactatgtgtggtctcctgttgtctgcacaaagccaaacagaccacatcagtgttgtttctcctctcttgttcctactgtttgaagttctcacctgctcaatgccacacctattggaataagactctgaaattaagccgggcagtggtggcaaacgcctttaatcccagcatttgggagccagaggatttctgagttcaaggccagcctggtctagagagtgagttacaggacagctaggactacagaaaaatcctgtctcgaaaaacaaaaagcaaaacaaaacaaaaaaagagccggacagtggtgttgcacgcccttaatccgggaggcagaggcaggtggatttctgagttcgaggccagcctggcctacagtgtgagttccaggacagccagggctatacagaaaaaccctgtctcaaaaacaaacaaacaatctgaaattacctagctctgggtaccaacaaaataggttcagcagaacccattggatttcaaaactaggactgcctccattgaggtttcaatgggcaggaaggctgaggtgaccctaggtaagagagtccctgtgttcagctcccatgggatgctacttttttaaagtttggacacaaactttcattttcctggttctccttgacccaattagagaccagatgttttttaaaggaagaactatcctttcaaataaagtaaaaacaaaaggaatgaatatagaaacaatatatggaaaacaatgagatctatcaggtagcctgaatgaatagcttatgggagatgaatactcatataggcctcaaggagagtttccttcagagcagaaggcaatttttgctttaaaacccaggtagttttcagaattaatgaattctgcttcctaagatccttaaacatgtgtacttcctccatattgagtactcttctccctgcctctctctttcttaaatgtatttgcctttattttatgtgcattggcatcccacctgcttgcatatctatgtgacagtgtcagatcttggggttacagacagctgtgaggcacccagacccactacatgggcactagacctgaacccaagtcctctggaagagcagtcagcacccctaactgctgaaccatctgtctagccccctccttgtatctttcaaaatgatttcatccatgtatactcatgacctctacaacttgccagtacagactttctcaccatgatacactagaacgtcaaagaaaatcatagcttttagatatcaaattcacagtgatacaatatatcttttcaaagagtacatttcagtgcttttggctattgtggctaatactacaatgaatactggtatatagatatctgaatctctgctttcaattcttttgaataatacctaaaaatggagttgctggatcatatggtaacttacagaagtacagttacttctcagtgatggtaccatttaacactaacacaaggttccaatttctccacatgcttgtcaacacttgtaattttctggtaataaaattgcatctttttgtggattttttgtttgtttgtttgctcagatatagtgctggagatggaagccaaggacttgcacatgccaggcaagagctctaccaaggagccatccccccacctcattgtggatttggcaatttgcatatctattggctaaatgcggtagagcatcttttcttgtgcttattgcccatttacatatctgtatgctattatgatggaacagtctaggaagtttaaagttaggaagtacttagtcttccaactttatctttttttaaaggttgttttggctttattgggtcctttgtttctttccatatgaattttgggatcatcttgttttctgaaaataaactggaattttgatggggtggcattaaatcagattgtagagtatttattgcctgtttatttgggccaagtctttatttcaaatatagcttgtatttcctttgttaaatttgtgttagataaaaaaaattgttaggattttttgttttgttttgttttgtttttgttttttgagacagggtttctctgtgtagccctggctgtcctggaactcactctgtagaccaggctgccctcgaactcagaaattcacctgcctctggctcccaagtgctgggattaaaggtgtgtgccaccactgcctggctatgttaggattttattattatttttaattgtatatgagcattttgcctgcatgaatgtgtgtgtacatcaggtgcctggttctctaaaaggtcacagagggcattagatccctgggactggagggagggactagagggacttctgaaactaccattacaatcattcatgagccatgtgggtgctgagaactgaaattgggtcctctgcaagagcagccaatactcttaactgacaagccatctctctagcccaagtattttattccttttgatgctattgtaaatggaatttcattttaaagcagtgtagctgtatcccaggttagtctagaacttactatgtagcaggctgggcttgagctcattaacagtcctcctgactcaagtcaagtaaatgagccaatatgccaggcttggaattgttttcttatatttttggttgtgagcctagcctttaacggctgagccatctctccagcccggaattgctttctaaatttcatttttgtctttctcattgccaaggcataaaaatgcttatttttttatttttttagtggtggaggtaggaaaaagtgttcacttttctaccataagaaaaaggggccggcgtggtggcacacgcctttaatcccagcacttgggaggcagaggcagtcggatttctgagttcgaggccagcctggtctacaaagtgagttccaggacagccagagctatacagagaaaccctgtctcgaaaaatcaaaaaaaaaaaaaaaaccaaccaaccaaacaaacaaacaaaaaaacaaaaacaaaaaaaagaaagaaaaagggtaccttttaaaattaataatttaatgtatgtgtatgagtattttgcctgcttgaatgtctgtgccccatattcattccttgctgttcctctggccatccatcaaatttcctggaactaggattacatacagatagttgtaagccaaaatgtggatgctgagaatcaaatttgggtcctctggaagagcaacaagtacttggaactgctgagccatttctttatcccctggccttattttattactactactattactactattattatcattcaggatcatattattaagtagaggccctaacctgttgattttccggccttagtattggagtcccaggtgtgtaccaccacactggccttagcaggttgaggaagctcccttctgtctggagtttgttaaaaatttttatgagagattgttattttgattttctgttcatattgtgatgattgtgtaaatttgtaacctatttgataagatctcttacaggccctttagtgtaggatgtcagaacttcatgtccatgtctattcaggctgaatggagtgcaggagtaagtatgcttgtgaaatgtaagacttccctctgacaaaagcgatgactgtatgttgaggaagcaaggaaaggtggaaagattggaagcagtatgtgtctgggaccacgctacaaagcatcttcccagaggttttcctgatgcttctgcttgccacccccattctaaatgagcagaccctcttgtcattgaagtttctaatcagatcccaagttctacatcctggtcttcctaaacctgtcgttccttctgtgatgctgacacatttgcaccaacctttcttgagggagggaaatcactggaggggatgcatggaaaaggggttattgaactttttaaaaagatttatttattttatgtatatgaatatgttgtcactatttttagacaccccagaagagggcattggatcccattgcagatggttgtgagccaccatgttgttgctaggaattgaacctctggaagagcagtcagtgctcttaatcactgagccatctttttagcccccaggttatttagttttaacagctatttttcatgcgtagtcaatctgctttgtaccattatccgaagatattctcttttatcatttttacatacatatatatgtaaaaatatgggtgctaagaatcaaatttgggttctctggaagagcaacaagtactttgaactgctgaactatttctccatcttttggcattattattattattattattattattattattattattattattattattatacaggatcatgttatgaaatagatgccctaaacttttgatcacaatatacaaaatatgtatattgtgtatgtgaggatgcatgtgtggggatcagaggatagcttccaggggtggttttgtttttttgtttttgtttttttttaaccatataggttctggaataggcgcagatcatccattgaaataaattgtgacagaaacacattagcagttgtaggtatgtagacatacaaaacctgtttcacttcacattccaaatacatgcagtaaccatatggtaatcatacctcagtaaacttcaaaactaagaattttgtatttacacagaatatgtatgtttctgtttagccctgagacctgtgggggtatttccatggttgaattcaggttgatgtggcaatagataaaagtagttctgaccccaattcttgtttgtttgggggggggggggttcgagacagggtttctctgagtagtcctggaactcactttgtagaccaggctggcctcacctgcctctgcctctgcctctgcctctgcctctgcctctgcctctgcctcccaagtgctgggattaaaggcatgcaccaccactgcctggcctgaccccaattcttacctgtgggcaagttcctgtatggctgtgtgcctcaatttccccagctagtatgtatgagtgaaagcatttgtttatagtggataagctgatggaagcaccttgcatatatctccttcatggtcaacattgggtccctggcatagcagaggtagaagtaagtcattgttgctgcagcccgttcagttgatccttagacatagaacccctgtaacatccagtgacagaagactgtcttactttattctgagagtttctctagtgagaaagaaaagggaggggaaaaaataaaaacaacagaaaagggctccaaattttgaggacataatagcatgcagggtgagttaggagaggaacagggacaacagtagaggcatagtttgtctttttgcacagaaggaacaggctaagaagttgcagaactagatgccaaaatacttgcttctcataatgcattctgtctgatcttcactaatggttggaacaaataacatcctggttatggctagctgtggaccttgccatcgatttgccaggctggcaggaggtggtgggagatttggctctctgccgctaatatttattgtgcacaagaaaactgaacaaacacccaaagagaatggtttcaggaagttgtctattgaccttataggacattccttcttcctgtctgcttctcaggcaggactacaaggttgtggaggggcagctggcctctgaaaagtcagggagtgggagaatctcagtcaactatgagccagcattacccacactgctgctttggagaagaaagaaggtgctggagcctggtctagtttctaaaggagtttttgtggaggagtcttgtttgtctctgtttctcagggcttgaccccctcctccccaggtttatcccctccgaggccccaggcaagactccacccccaccagaggaagacccttgttcaaatgtaaatccagattaagggatgtaggggtgagtggtggtgggactggctgtttctggagtcttcatttccttctcaaaaactgggagtgaagttgttttcctgatgctgtgagatgggaatttggagaagatcagtgaaagcctcaagttttgtcagtatcagaaggaagtgttaagacctcaccacagacctattaaatctcaaaaccaggccttaagaggaacaatgtattcttcggtgccacgtgcagctggctctctatctaccactcacatttcttcagaacatttaagcaaccctgaagttaccacttccccagctactcaaaaatatcttgcaggtgcttcctgccctggaaagataggtggaaaggatgggtacagagagattaggagtggtgatcagccaaaccctttcccaggttggcagatgtggtgcaatgtgtgctgtgtcagtactagaaattaaggcattcatagctaccagtggaataattcacttaggcaagggtcagcttctgttactgtgaataagaaagaaagtgcaccttatgccaggcgtaatggtacacatatcccaagattaaggaagcagaggcaggaggctagcctgcctgggttttatggcaagaccctgtcacaaagtgcaccttataagagaggtctgcagccactactttgactgtgtaatgaagttgggcatctccaaccttggaatacagtggggtagaagtgaggacattgtcatcacatggctggcattcttgccaaaatgattaacccgctgggcgtggtggcgcacgcctttaatcccagcactcgggaggcagaggcaggcggatttcgaggccagcctggtctacaaagtgagttccaggacagccagggctatagagagaaaccctgtcttgaaaaacaaaaaacaaaaaaaccccacaaaaaacaaaatgactaactcgagtctcatcacagagaacaagtcagcaagtgtagattttgggatatttaggactctgccaaaagccccgtatcatgaaagggtaaaaagaaaaactgcataggttgtttttgactacagtagataagggtcaaaagtgatgtacgttccctaatttgattcatgattagaagaagtaataagggtacaattggagattcagaagtgccgggtgggatctgtggtaaactacatgataaggtggatggagtggtagtttggggttttcaaatgcttccgaaaatatgtaagtgagagcaggtgtgcattctgggaagatctgggtaaaggaaacatgcagctgtttatccttggaagttgacagtttttgaaacacaagttgggaaaacataaaggggaacttctgttgggccactgtgggggataaactcagaatgttgaagactcactgtgtttccttggggtttctttccactctgttgatctgctcacttctatgtcacagtaacatgtgtgagcctaggaagctgcttccaaggtatctccagtaagcagaactgattgatagtccgtggaaactgggggctaacttccagtttcttttcttccccagcctcacagttctcatctgaagaatggggagggcaaactgattctaggttccctagaaataatgtactttcaccagctaccccttgggttatcaagccatataggaagtctcaggtcttgcaagatatcccaacctcttttggccccacctctcccttgtgtttctggagaccccgcactaggaggaaggccaggccaaacaatgcacaacgcagtaggtatccttaggtagggccttactctctggtgaatgaccgatattgggggcctccttgtgcctgcctctgcctctgcctctgcatctatctcgccgctgctgccgccgccacgctccctttgtctgcagcttcggattcagaaggcggggcgagtactcctcaggcctccgcatatctgctgctgcctcgtggccccgccttctcagggtcttggttcctagtcattccccacctttggctttaggaattttttccttcagtaaccattatcagcattaatccccaccccacaaagtgcccccccacccccaccaaaaaacccaaagcaaaacactcaaaaccaaagggagcaggtgccttgagttgtcctcatccacctgaaaaagcttccaaagaagtctgcctactcagactgagctaaaaggtctgtctcactcaggtcagtttcttctccatctatctcccccctcccaagtctggtttcttgtccttggttgtctctctccaacaaatcaatgtcaaaggactccattcttttttccttcttatgaccgcctccttatgatctcaaatcaagaaccattcgtaattaaaacagctaggtgtactgatgctggcctttaatcccagcactcttttaagtttttggccagactgttctacatagtgaattccaggacagccagaggtgtatatatagtgagagcctgtctcaaaaaacaaacctcagcaacaatgcttacaggatactcaagttgctggctcttgttctataactataggtgtaatggagcatcggagacacttatgggttttaggactttcaagctgcagtgaaggaaacaacttagcctataatcttagtacttagatgataaaggaaagagaaacaggagtttaaagataatatccgctacaaagagaatatgtgataagcaagatcttgtctgaaaaggaagcaagcatttccatttccagttaggtctcaaccctagagtgtccctcagccttcctttcttttgtaaggacatccctggtctctgtgtatatcagcaatagctttcacttttattgtggtaaaatacacataatgtaaaatgtgctattagtgacttttcatctattcacaatgttcaaccactagcactgtcattccagagcatgttcattacctccaaagaaaacaggaccattaaactgccacttctcactcaccttcctttagctcctggcaaccactacagttttctgtccccatggatttagctgatggagatgttccatttcaacataaaaggcacatattgtatggaatgctgtacaatatgtgtcttttgcttaatataaaccatttttaaggtccatccatgtttgggcacatctcagcagttcattttccattttgtggtagaataataatccacttgacatggatcacaacatattcatctgttggtcctatgtactcaggggaccccagctgacttagagtcacatgtccatttgccatgtagtgttggatagaactgtctgccctgtcccatcactttccaattgtactgttttttgttttgttttgtttttttgaaacaggatttccctgtggctgtcttggaactcactctgtagacctcaaacttagagatctgcctgcctcccagattcctgggattaaaggtgtggaccaccactgcctggtcaaattatactcttcaacatgggggtggggcagtgtgttccaggccctctgtcccacagagaagtagttgccactggcctttgccttacttttcaactgttttagtctagggtgggagcaggactcctctccatcttccaggggggtttccaggaatcaccagtgctttgcccctgggactatgggctactctccacaagatgcccagtctggctgcctctgacagaacactgaagtaggtacatctaggaccctactttcctcagttattctctattcacaaagcagccacccactcattatctcagcattgggaaggtggagacaggagacaagttcaagggttcaaggctagcctggactactgagaccctctctgaaaattaaaaaaaaaacagctctacgtaatttaaatgtgaaataaaataatagtattgcgttatgcaggtagctgtatagcattatggattcttagttggattaaacatttcttagttgtctatttaaataaaaaaagaaaaaaactcttgccggttgtggtggcacacgcctttaatcccagcactcgggaggcagaggcaggcggatttctgagttcaaggccagcctggtctaaaaaatgagttccaggacagccaaggctacatagagaaaccctgtctcgaaaaacaacaacaacaacaaaaacaacaacaacaaaaaaaactctttagattaaaaaaaattatcattttttgagacagggtctcactgtgtacttctgactggcctggtacttactatgtgaatcaggctgcctttgaacttacagagatctgcctgtgtctgccttccaaatgcttaaactaaatacatgtgccactatgctcaacttggttgtatatttaaaaagtacttttgtgttagatatattctaccataataataacactgatgcaaatattattgcaattaaatttgaataatagttgcctttactcaaaggcctttctagttactttacaaaaggttgactatttatactctgagataaagttctattgactgtgtgtttggagaggatactaaattaggttggaatgaggagtgcctagtgccatgatgtcttgaggtggccactgtgcttggaatccctgtcaggccaaggtttctgtcttagtcatggtttctattcctgcacaaacatcatgaccaagaagcaagttggggaggaaagggtttattcgacttacacttccatactgttgttcatcaccaaggaagtcaggactggaactcaagcaggtcagggagcaggagctgatgcagaggccatggagggatattctttactggcttgcctcacctggcttgctcagcctgctctcttatagaaccaagactgccagcccagagatggttccccctccccccccccccccccccccgccacaaggggcctttccccctcgatcactaattgagaaaatgtcttacagttggatctcatggaggcatttcctcaactgaagctcctttctctgtgattactccaactgtgtcaagttgacacaaaactagccagtacaggttccaaactcagcaacaaattgggaaatgagtagtcttgaatgctgaagggtctgtcatccaaagaaaacagtcctaggccagggagtggtgtttcttatgtggcaattgctggggacttaagtacaaatcttaagatgttctgtatcttctgtgtattgctttgagttcttctattgtttcaaaaaagatgtgactgtgcacaaaagcaatggtgttagtgtaggatgaaggagcaactggtgtgaacaaccttgggacttgtatttgacgaaaacagcataaactatggccagtgcagactaaggccaacaaaggccttggagaatgccagcaatgaattgtattggcagctggagtggattaggaagtataggaagtgttgggaggaaaagtatttttctggattgttataaagtaggtagagattgtatttgataaaggaaacaattttgttttctgacaatagtttcctttagcaagtgccatttttctattactgaaaaccagtccattcctttaacattgttctaaaggagaggcagggttgcatttaatgaaagaagtactttttttatcccccacatcccccagtaatggagatgctagtaggcagtcactctgttgctaaactcctaccagtccagaaacttttcagtgtttgatttttttttttctttcagacagaatctcattatttcaggctgccatcaaactcattattttagccttgaatgcttggactaaaaggtatgggccatgacaacccagctaggtttgaagtcttgatcctccttctacttcctaagtactggcagttagtggtttgagtcaccatacctggctcagaagcaatttctttaatttaattttattttttttaagatttatttttttaattaattaattaatttatttatttattacatgtaagtacactgtagctgtcttcagacactccagaagagggagtcagatctcattacgggtggttgtgagccaccatgtggttgctgggatttgaacttcggaccttcggaaaagcagtcgggtgctcttacccactgagccatctcaccagccctaattttattttttaaattagcacatattagcttcattacagaattttcaaacaattcgatgttgttgattctcttttctccacattctccccattttcctggccttctaacatgtgtactgttctgctttcatcatggtgtgctactgccctcttctttaactctttgtttaccccttatagctgctggtcttcagtccacattggaagtttgaagaagtaggtcataatgccagcaaaggagtgtctctacatcaggatagataaacttgccagtgaatgtgagcgcaatcaggcagcaaggaagaaacctcctttgttttgttaaatcttccaatgtcaaatgatctattcagatgtagtcaagttaacaaccaaaactagccattacacctaatgaaccatctcccagcctccacgttttttaatttataattttttgtggtgtaagcagtatgttgcacatacatgtgtgtttgtgcttgtttgcattgcatgtggaggccagagaaggacaccatatataattcttctatcattcttcaactctcagtgaaccagctaatgagcttctagtatctacctccctcatttccccagttctgggactacaggcacatgctatcactgccagcttttacatgggtactggtcatttgagctcagaaccatctccctagctttctgctttccttcatcttgggagggggggggtggttctggctctcctccacctccttcctcccttctcccccccatcccataaacctcaagctggactctatatcactgaagataaccttaaactcttgatgcttttgcttccatcccccattactgggattatgtgcctggccttccaccttggttttttgtttgtttgtttgtttcaaaatttatttgtgtgagtgctttgcctatatgtctatctgtgtaccgcatgtatacagtgtctgtggaggccagaagtgggtgttgaatcccctgggacaggaatttcagatggttgtcaatttccatgtgggttctgagaattgaatccaggtcctctggaagagcactgttgcttttttttatttttgttttgttttcaatcagttcataaccactgagcaatctagcccacacctctagccctccaccttggtttttgagacagggttttatctggctttgatattcaactgttgatttaactatgctggttggccagtgaaccccaggccagcctcttgtctcacctcctcatctctgggattacaagtgtacacctttcagcatttttcttctttctctctcttcctctttgtctctctgtgtctgtctctgtctaccaccaatccctctgagtcagagcttcgctatacagccctgacacttgagatacatagaccagagtgactttcaacttatagcagtcaacttgcctcttcctctgaagtgcccacatttttcttttttctttttctttttttttaactgtctcctcagatacacttcatcctcacttagaggtcagcagcagaactggcacatttttcataaaatgtggggttttttagggtttttattgtgataaaaaggaaaatggtttattccaacttacactttcacatcacaatctatcatcaaagcaagaacaggaacctggaggcagaaactggagctgaggccatggaagggtgctgcttaatggcttgtttcccatggttttcttttctgtttgttttgtttcaagacagggtttctctgtgtagccctgcctattctagaactcactctatagaccaggcaggccttgaactcagaaatctgcctgcctctgtcttccaagtgctgggattaaaggcatgtgccactactgtccagcctcccatggctttttaaatctactttcttgtcatgccaagaactaccagtctaggggtatcattgtcccctgtgggatgggcctacttgcatcaatcataagtgaaaaaaaaaaaaaacgtgccacaggcttgcttaaagaccaatctggtaaatgacttcagcttctgtcatgttgacattaaaattagcagcacagtattctagcgattgaacttacgtggcaagcactttcagactgagcaatctccccagcttttgtggcccatccctatgaggcatgttgtgtaagcctttatctcgaataattttagagataatatcttgcataattttggaggttctttactgtgctccattcaagtgttcattcaacccacttgcctttctgtttctaggacatagtgcagatcccataacagtttgggtgacagacaggttagttgttttaacaatggaacattacttcctgagcttgcatgatgttgcaaataagaggtaagaagtgacaagcaagtgttgaagagggattctgtataagtgatttttatgtaggttttccattgctgatgcctttaggaagttagatgtgactcagacagtggtgtgtacctttaaccatagaacttggtagaggcaggaagatgaaaacgatttttaggctagcctttgctacagagttaagagaccagccgaggtgctggagagatggctcagtggttaagagcactgactgcaccgggcagtggtggcgcacacctttaatcccagcacttgggaggcaaagacaggcgaatttctgagttcgaagccagcctggtctacagagtgagttccaggacagccagggctatacagagaaaccctgtctcgaaaaaccaaaaaaaagagtgctaactgctctttcagaggtcctgagttcaattcccagcaaccacatggtggcttataaccatctagaatgggatctgatgcgctcttctggtgtgtctgaagataactacagtgtactcatataaataaaaattatttttttaaaaaaagagaccagcctaagtaatttagtgagattatgtcttaactcccctgcaaaaagaaacacatgctcttccagaaattcgcacacttgctgtctgtgtagtgtgcctcttctgccaatgaccaacttgattggttgctgtgaccaggatataaatgcttagtctagatcacacatgttctagtctagaatgtggaatacatacatgctctcgtggtttggtgtctctgtcccaaggatcctaacaggtatccttcttatctagtactggactggtttgggcccttctttcccctgatagctttgctgccctttgatatcctttgctaagtagctactgagttttgttttattattgctgtgtcttatgcagcctcttgtctctactgctgttcccccagttttcatctttggagtatctcctctctctctctctctctctctctctctctctctctcttaagatttatttattttatttatatgagtacactgtagctatcttcagacacaccagaagaaggcatcagatcccattacaaatggttgtgagccaccatgtggttgctgggaattgaactcaggacctctggaagagtagccagtgctcttaacagcttagctatctctctagccccatcctctcttttctataccccatatatactgtttacttatcccccgaggcagggtgtttactttgctccaattatatctctggtctattttgatttgtttggtggagcttgtattgggtgatagtaacagatatgtgagtgcagagagcatcctgagtgtcttacagttaagttccagcatttgaattgtcttagggttttactgctgtgaagagacaccatgaccacagcaactcttataaaggaaaacatttaatttggggctgccttacagttccaaggtttagtccattattgtcatggcaagaaacatggtggcagggaggcagatacggtgctaaagaaggaactgatctacatcttgatctgcaggcagcagaaggaggctgttccactaggcctagtgtgattgtatgagaccccaaagcctgcccgtacagtgacacacttcctctcacaaggccacacatattccagcaaggtcataccccctaatagtgccactccttatgagccaagcattcaagcacatgagcttatggggcccacctatttaaaccatcacatggatactgttgcctgtgaggccaaaggggaggctggtggaagcacacctgcatttttctttctttctttctttctttctttctttctttctttctttctttctttctttctttcttccttccttccttcctttttctttctttcttcctttctttcttccttccttcctttcttcctttcttcctttcttcctttcttcctttcgtttttaaagatttatttatttatatgagtacactgtagctgccttcagacacactagaagagggcatcagatggttgtaagctaccatgtggttgctggaaaaggacttatggaagagtagttagtactcttaaccactgagctatctctacaggactagatttctatgccatttttgttccgaccctggaaatggaacccagggccttgtgcatgctaagctacactcctaggcctgaatactttgtacagaatggtactctgaagatcagaaatgcctcataccagttgggaaccaggcagaattccatgcagaagagccgctgtcatctctggtcatgtctttgcactactttgcacaatgtctcatgtatttccctcttattaggaaacctgttcactctaaaagaacttctttttttgtcagtttttctctttcctatctacctccactagttcttaagaatcactatgacctgatgaagaaaggggaatagaatccagtgggtatgaccacaacttgggccaggagagttctctggcctgtccctctgatggctccttttctaaggtggtaagactgtgtgttcccagcccccacatgcctgtcctgcaagctcttcccagtgcctggttctggtttccatagtaacgctgctgctgggtaacttaatgattctagggaaaaaggcattcctgcagttctgtgttacctgaacacaaccctgtgcttgtgcttgtctttctgccctaggattttcagggtaacttcttccacactgaaatcctcagatcatctctaacatcttctgcttctttgtttccacttgagtagtgatgagctagcaaatattacaaaacaaaactaagaagtgatctggaacacttgctgatttttgtggtgtatcctctactaaagccaatttcaagccactactatgagctaccactgagcagggtgaagaaatgtacagccacataccatcgagtgtttacttccagacatacagaatggaaatgatgccaagcacacagatgacagcaaagtgtaagaaagcgattagagagccagaaggctttttagtctttattgcttttgtttttgtttttgttttttggctttttttttttttggtttttttttttttttttttttttgagacagggtttctctgtgtagccctggctgtcctggaactcactcttgtagaccaggcaggcctcgaactcagaaatccacctacctctgccttccaagtgctgggattaaaggcgtgtgccaccacgcccagctactcctgtagtcttaccttaaaccaggcctctgatctctcccaagacccatgactgcttttgtttttaattccattcattcagttacaagtttctcagtcacaatgctgatattaaaacccgtgtttaacagctagctggttctggccattgctgtgaagaccattcctcatgtgtcaaaggcctttcccagcacttcttggctgatgtccagctggtgtcctgtgcttagccctttcctagcctgcctgctatgacctctatagtagtggatgcagtgcttttctgaccttcccctatcttcctctctatcttcccatcccctatccccttttttgagtcaggatctcatgtagcctagactaatctctaattccccatataaaggaagctaaccttaaagtcatgattcctctgcctcctaagtgctctgtgccaccagacctagctccatgtattttttaaaaaatactttcctagaaaacatttttcctgggggctggagagatggctcagtgattaagagcactgactgctcttccagaggtcctgagttcaattcccagtaaccacatggtggctcacaaccatctgtaatgggatctgatgcactcttcttgtgtgtctgaagacagctacagtgtacacatatacattaaataaataaatcttaaaaaaaacaaaaaaaaatgtttttcctgaaagaaatggtttcccttgaagatgtttcaataattctacttaaagaaagacttatctaggccctggcatagtctcacaagagacagctatatctgggtcctttcagcaaaatcttgctagtgtatgcaatggtgtcagcgtttggaagctgatcatgggatggatctctggatatggcagtctctagatggtccatcctttcgtctcagctccaaactttgtctctgtaactccttccatgggtgttttgtttccatttctaagaaggggcaaagtgtccacactttggtctttgttctcttgggtttaatgtttttagcaaattatatcttatatcttgggtatcctaagtttctgggctaatatccacttatcagtgagtacatattgtgagagttccggagtggggggggggtatggggacttttggtatagcattggaaatgtaaatgagctaaatacctaataaaaaatggaaaaataaataaataaataaggctgctatgaaaaaaaataaaataaaacaaaataaatgaaaaaaaaagaaagacttatctagtgggataactatagattacacagatacacaaaaattaccctaaaatagacctttgctatactctttatatcaaaaaactggaaaggttttcttgctatatagtaggatctaggccagtagggtttaaaggacctaccactacctcattatacacataaagaaaagactgagagtatgcctgcagggccacagcataacatacatccctgagagctctagcaattttgattttctatagttttaaaatgttccacaatagactggtgcctcttcagacaaagtggaagttttgttgttgttttaagctttgggttttttgtttgtttgtttgtttttgtttttgttttgaggacctcatgtatcatgtagcccgggttgaaattcaactcttggtcttcctgctttcacctcccaaatgttggaattataggtatgacccacaataaaaatggatgtttttataaattgcattttagaacatgaaattcagggtaggtacttaaaaagaatccagtcatggtacaacacacctttaatcctaacacttgggaagaagaggcaggcagatctctgtgagttcaaggctagtctggtctacagagtgagttccaagatagctagggctacatagagaaactctgtctcaaaacagaaacaaagagacaaacaaacaacaacaaaaagttcaggggagaaaggagacagaggaaacaaatttacctacagtgacatcataaaatagcatagggaagaagtcttgaatgttgaagagtgaaatagagcgaggggaatgaatatagtaaaagatcagttgctacatgaagggcagtactctgatatacaataacagaacagatttaatttgatgacactactatagaacaatgttgatagagatcttggcatctgaaaatgtgaatactgaatgtaaaaaagttattagatcattcaaggagttagcatagcctatggacgagtggataagggatacgaccaatattggttctaacacgtaccatgctaatataggtgaagttatagctagaggtctctaatatcaattcaggaaatatggtcatttgtgaagagactaattgtgatcaagctgctaaaggtttcagatctcaaaatgtacagtgctttgtgggagaatttggtcatttgtatcaaaattatgaacaaggcatttctttttttaaacatttatttatttaatgcatatgtgtacactgtagctgtcttcagacacaccagtagagggcatcggatcccattacagatggttgtgagccaccatatgggtgctgggaattgaactcaggacctctggaagagcagtcagtgctcttaactactgagccatcactccaacccaaggcatttctaaaagcagtaatttttctaaatataagccagaaagaaggtctaggcttccaggggtgtacaggtgatgaggcaagagttgccactggagtaatgaatatagatccaaaggaaattacccaagataatttattatgtttataattttccaatacacacagcataattaatggcttaaaacagaaggggaaatatagtaagaatttgttttctttaaaagacacagaaataggtatgtgtgttcgttttaatcccagatgtagggatatggggtgttgcctgtgccctggactgttcactgccacaccctacctgtccttgggggttggaggtgagatgtcgcagagtcaacgatacagactccaggagcaagtggaaggtattaaaggagcttgcagcagtggggtgcttcaggttgtccatagcagctgactataatttacctcctgctctagcaggggcatggttttgccagttgcagatagttcctgcaattgtgtgacatttggaattctgagaatttttcagagggtatataaatggtagagacctgataggtaggttattggttggttggttgttggtcctgatttgttaaataaagaagaaacaacaagaagaaatcagatatcctgatggcgaagatcaaatttgccccaaggaacttgatgtctttagtcagcaagaagtagtctaatgataatgtctcgccctttccagactctgcctttagtcagggatctctatcttttcctctttatccccaccccccaaatctagtgttatggggttgaaagggcagaagaaagaagaaacagacaggtgctgatgctgtgagggtctttgcagatattggggcaactaggcaaagcagagggcttacaactgcattttctacaactgcatgtagccacagtcatagcaagggagtcatctctaatcctttccaagtgctttcttccttgttcagtatcctaagaaaactagccttctcacttgtttggtttttcttccctccctcttccttcttttttctatgtctgacaggttttcttgtaacctatgctggtttgttatgtagcttaggatgactttgaactctttctgaggtcttgtattaaagccataagccaccatacctagctcttctccaccccccaccctgggagggagaataggggagtatgtcaggctgacctcaaattcacagtgatcctctctagcctcctaagtgtcacctctgtttttggcccatcactttctttgcaccaaatcaaggattctgcctaccttccttctaggtcgggggaggggggattgctggctccatgctcatcccagtggggaccaatgggtgtgctcttgctcagtccagaatgttttccagtaactgccatctctagacactgcttcctgcattttttttgctggactttgacaagtaccctgaattctggtggtatctgtttttttatgtcctcgttctttcttttctttctttctttttttttcttttttcttttttttttggtcaatttccaaggaagacctaaggagtaaagcaaactgctcagaacttaacagattctggttgggctgaggtcagccttttaccaaggggcacttgcttgacacccagctgagactgcttgcccactcagtaatgggctttttcctttctcagccagggtctcagcctgcttctgtctgaaagacacccccatgccccatcattctgctcttcccagtcctgcttttgcctcaggcatcctccctgtataggcactgggcaaactctacttgactcaatttgttcacctggctgagcctcacttttctcatctgctcaacagaagcaatacctgtgtgtgtctcccttaaatttgccagggctatggatttggtgaggactcactttaaagggccttgcctgcaacctggtgtatagcaagtgccccaacaaattgtgttggccaccatttggcaccttttaaaagacactttgcaattctagacctttttagtgtcaggagaccttcttctcttcagcaagtcagttgtcatcaaaaggaacagccttgtacattttactcttttctccattaccccttccctgtgtttgttgctttgttcaactcagtcatcctctggccccagtgttgggtagtacaaattgacagtccctgaggttggctagtttgtctcagttattattaaggaaatttgcagtgcagtcttctagttgtctctggcctcggtgcagccagaagagaggaggatcctatgggaggatcaaggagctgcggatggttcttgatggaggagggactgcaaatgtttcaaggtgataatagaactttcacactctgtacaggtactcagtcacctggctttgagggaatttcagcaacacacagacagaactctgggttgaaggctgataaatggggtctgcctgggaaggagggcactaagggtagccagggctgtgggtggagagcacatttctcggttgaacaggtctgggtgctggttagcaactcagggtcctgctggacttcacttccagaggggagaagtcggctcttgagggttctcacagaggcatatctctgccacaggtgaacggaaaggagctctccaagctgtctcaggagcaaaccctagaggccctgcgtgcctccaaggagcccctggtgatccaggtgctgagacgcagcccccgtctgcggggggacagctcctgccatgaccttcagctggtggacagtggcactcagaccgacatcaccttcgagcatatcatggcgctgggcaagctgcgcccgcccaccccacccatgggcatcttggagccgtacgtcctctctgagctgtgagttgccctcaggagggcctgggccctgcctccagagaggacatgccacctgggcagctgtccccatgtgacccacaggcggctttcagctctagccatggtggggagacacaactcagctgccactcttgggcattaagcaggcttgatcactagagctgaccatggcactcaggctcagaacctccaggcctctggcctcaggcttggcaccagctggcagaaaggctgaagtgacacctatgttcctgggacctggctgctccttcatcctctttcctcttctgctgccatcgtctctgcctcctcacaagcatctctctttgaatcttcttgcatcccttgtctgtcccattcttctacttgctctgaatttcctccatcccttcggcttgtttctttggccttctaagaagaagggcctttcatcctggcctggtggctgtgaccatgtgagcagcactgactcattctgttaatcctacggggctatagggaggtggccctgggaacccttttgttcagagaggtaggccatagagcagtgagctgtcagttttaatgttaaggcaaggaggacaaccccttcctggaggcagaagaataatgctgctttgtagaagacctgggtaactcctgaaggttctgcatgagtgggtacagtgccagaggcagcctgggaacttagagctttggagaaatcagctcttggtctgggagttgggatggggagagctaggtgtacctgcctaggtccttaggatggacccctgtgagctcgtttgaggagcatttccaatccttccacagccatttgtgtcgatcaaagaggagggttctaaaagcagcttggccaccttttctagaaagtacatctagaacagggttctttgtttactgtactgggactagccagcttggagctggggctagggtgccaaggaagcagatggcccatctgacccccccttctcctgggcagcccccccatcagccatgagtattatgacccagcggagttcatggagggcggcccgcaggaggcagagcgaatggacgagctggagtacgaggtgagcctagtggctggcctgcctggccggaacctgcagccaccaagagtctgcaggcccactttctgcagctctgcccaggcttggctcctgccgccccctggtggctgggcctcatgacctttcccagtagagagcagcctgagtcagggagggtgtgggtgaggtagtgtgttccttatgtctctgttggtgactctgtgtcccatgcatgtctgtgtcctgtgtgttctgtacatcttgtgtcttgggcgtttcctggtagggaaaccactgaacactcgcacatttaggatggtaagagaagggaaccctcaaagggaagggctacacactcagttcagataactgaagcagaaggcaagggggtgctaggggcaagggcctgggccaaggctgcaggcgtccttgcttatacacttcagttctttatacctctacttcctcccctacctcttgtggcaggaggtggagctgtgtaaaaacagccaccaagacaagctgggcctgatggtgtgctatcgcacagatgaggaggaggacctaggcatctacgttggagaggtatggagaggtgctgcagcaggctttggcacaccgagccccagagctgttctagtccagctctgtggtctttccacaaagtctttccaggctttagggctgcccagaggtcctaactacccactaggtgtcacagtaggttgttggtgtcaaggccagggtggctatggtttcagtatatccaaggagacagccctgctgacctgtacgcaggcatcaaggatttaatggggcccaccttctctccccattttcttccctttggcagatgtctatgtatgctagcactatcctactaaagctactcttccaaatggaaaaggtcccactgcccagaacacacaactttatgtattttcattatgaagaagcatctagccacatgccagtgcctagttcctgtcccctcaccgccccccaaaagaaagaaagacctctgagctgggtgtggtggctcaggccagattgtagcattagtagttcaaggtcaccctgaacttctggagaccctatttaaaaaacaaataagttgggtgtgggtaactcagaggcacttagaaggcaaagacagatttctaggagcttgcggttcattagagctacatagtgaaactgttttaaaggggagtatgcatgtgggaagtgttttaggaggatgattcttactgcttcttcaaaggacccaagttcagttcccagaaatcacatagatgtctcacaaccacctctaactccagttccagaggatctaataccttcttctggatttaaccaatacctccatgcagctgtgcacatacatgcaaaaaaaagaaaaagaaaaagaaaaaataggaaggaaggaaggaaggaagaaaagaaagaaagaaggaaagaaaggaagcaaacaaaaagaaaataaagcttcaatgaagttgggggtatagctcaatagtaaaatacttttttaacatatacaaggctgtaggttccttaacactgaaaaaaaaagactttgatatatacagtatagtagtacaagggatagaggcaaaaccactgaagtgttgggtagggactagggaactgtttctggtcaccctgtatctcccaagctgatggaacaaactgccttggctcactgtcccactcctgcttcctaaagcttagaagctgctagtctgaggtgaagtgggaaagtgagcaagactggcattttccccgcttacacacacacacacacacacacacacacacacacacacacacactgaaaagggcatcaaagttgccaaagtccccaagatgcatgtgtcctgcaggtaaatcccaacagcattgcagccaaagatggccggatccgtgagggagacagaatcatccaggtgagcactagaaatcaggctgccgtgcctgccctgccttcttttcaaccccttcctagatcttttctgctgagaacctggccttctaccctggaatctaccatgtcctgagccaaatctcatctctgttctgctcaacttccctgagagctcccatgtattcctgccagcacctccctgccctcttctacttctccattctctgagcacatatgctcttatacaggccaggccatcctttcccccaatgcattctgctaatttatgccttcccagagttcaacaccctgtccttggcacagccagagtcccccactagcattcttgttgactattctctaaacctctgcagattaatggaatggatgtccaaaatcgagaggaggcagtggccatcctgagccaggaggagaacactaacatctccctgctggtggcccgacctgagagccaggtgtgtatgtctttatgaaagggcgacacagggctcctcacaggctttctgtcttgaaggctgctggcctgttttactttactgagtgcgcagggtctagggcaaggtggaagggcattggggagggctttaaagtgttgactatctcatgcttgtctctgcagctagcaaagcggtggaaagacagtgacagagatgacttcctagatgactttggatctgagaatgaaggggaccttcgtgctaggaagctaaagtcacctcctgtccagcaggtaaggaaggaagaaggcctgctaactgggtagggaaagagagggaggaaggagaaaggaaatgtgtctactgtcttccagcatgggcctggagaggagcaagctgtgaactttctagtccttctgcagcacacttgtctgtgagaacctaactgagtatgtttgtcatttctgtcccagattggaaatgatgagaagggggctcctgatgggggcccaggcttaaacaacagccaggacctggacagcggggtgggtcggactgatgagagtacccgcaatgaagagagctctgaacatgacctgctgggggatgaacctcccagcaccaccaacactcctggaagcctacgcaaatttggtctacaaggggatgccctacagagcagggacttccacttcagcatggattctctgttagctgagggggcagggctgggaggggctgacctacctgggctcactgatgaggagtatgaacgctaccgggagctgctggagatcaagtgccacctggaaaatggcaaccagctgggcatcttcttctcccgggcctccagtggcaacagtgccctagatgtcaaccgcaatgagagcctaggccatgagatggccatgctggaggaagagcttcggcacctagagttcaagtgccgcaatatcttgcgggcacagaagatgcagcagttgcgggagcgctgtatgaaggcctggctgctggaggaggaaagtctctatgacctggcagccagtgagcccaaaaagcatgagctgtctgatatctctgaactgccagagaaatcagacaaagatagcaccagcgcttacaacacgggggagagctgccgcagcactccacttcttgtggagcctctgcctgagagcccgctgaagcgatctggtgctggcaattccaacttgaatcggaccccttctggccctcctgtcaccacccacctcaagggggctccttcaccagggagcccagctaagttccgatcactctctcgggatcctgaagtgggccggagacagcacacagaagagcgtgtccgccggagcaccaagacaagtgttactctggagcgtgtgggccctgaaggcagcccttacctctccaggcgccatcgtggccaggagattgagcagtaccacagctgtgtgcagttggccccgccacgcaccctggaggatctgggccatggctccttgagcttggctagtggtcctcgggtgggtggggtggcagctgcagctgtcgaagcaccccgcatggagtggaaggtgaaggtgcgaagtgatggaacccgctatgtggccaagcgacctgtgcgagatcggctgctgaaggccagggccctgaagatccgagaggaacgcagtggtatgaccactgatgatgatgcagtgagtgagatgaagatgggccgctactggagcaaggaagagaggaagcaacacctgatccgagcacgggagcaacggaagcggcgtgagttcatgatgcagagccgtctggagtgtctaagggagcagcagaatggtgacagcaaacctgagctcaacatcattgcgctgagccaccgtaaaaccatgaagaagcgaaacaagaagattctggacaactggatcaccatccaggagatgttggctcatggtgcccgctcagctgatggaaaaaggatctacaaccctctgctctctgtcaccactgtctgagctgctccagcaggagcccagcccaggtctagaaagcctgaccctcaccctcccttagaatctagtgtgtgtcgatgtgtgtgcttgcacgatgtgctcatgcacactccttacctgtatgttatgtgtgcacaggaccttggtaatagaaagccccaagaagggacacttctcttacgcctagttccttttccccaagaagctatgctaacaaccaacatagaggcatacccataaagggcacctctttgtgtatacacatggtattcttgctattttcttggagacagggaaatcagtgcagagaggtgaggtggactatcctaagcacaagagaatgtccagcttcatgctgagcacgacctctcccctcctaggagctgcaattatttgtagacaaaggcaaccctgaattttgtggtttttcttcttttctgtgcttgccaatagttgttttctgttttgtgggcctgctctgggggctggcagctcctttaggcagcctgacaaaggtggaccccaccgagtgctggctggaaaggaggttggggggaggaaaagagggagggttgggtgggagggaaaggaaaaagatggggaagaataaaaagcagctgtcctggtggcctctaggggctctgccttggctttcaaggcttaaccatggaggcccacctctcttgccagtgactgaaggaaagtgagatcacagggatttggggcacagtatccatgcaaaagaatctgtctatgccatctggagcagagtcactcttctcagtggcttaagcaaggagggccaaacctaatgagtctagagaggatgtggtgggagttggaaggcctgggcccaatgaaaggaaggtgggctgactgagagatgcctagaaccttttccaggtgatggaactttaaaatgtttggtgcctgtcaggcttggtgaagctcattggatgctacaggatgcccctgctccccacctacatacaccccaagaataaagcaagctgcctttttgctgtt

SEQ ID NO: 62 - DNA, 4280 bp, mus musculus
tgtcttcctagggccttcagggacctgagctgcccatctctgctctgttctcagctggaatggaacatgaagctgtggtggccacacagtgaagccatgattgccttcctcatgggttatagtgacagtggggaccctgccttgctgcatctcttctacaaggtggctgagtacaccttccgccaggtaagtgctctctccttgtcccctggaagcccaggcagcaggagagggagaaacaggggctgtgtgtaagggggtccaggaggctttccctcagcttcttctagcccattcactagatgttgctctcagctgctctgagagtcccaagactgtcttttgtttggtgaaccaagaagctctgcctcaaggaatacacctttctggatgatcagattctaatcgagtaaacaagcaaacagagaccaatgagctgtggaaaacaaagcagatgccaaatgatacagaactttcttatagagggggcagagaagaccttgtgagcaaggatccaaagcaaaggagggcagggtgtatctgtgtctattcaacagaaaggaaactgtgagggtacaaccatgtgggttccacgtagcaggaacatccttgatctgccagggccagtaaacctgagccttgacagggaatccaacagctaggatgtcaggctggtaaatcaccagttggattttcctccctgtcccctgcacgagctcgtgtgagagagaaagacatacacacagtaggttagaggacaatctcaggtggtattcctcaggcactacatacctttttgttgagaagatagggttgtgaactagctacactgacaaactagctacggaggtgaatccttagaatactctatctttgcctctccagtggtgggattataagtatgctatccttgacttgttttcatatggtttctgggaccaaattcaggtcttcctgtttgcaaggcacttttttgtttgcttttggttttcaagacagggtttctctgtgtagccctggctgtcctgaaactcactctgtaggtcaggctgacatccaacttagagatctgcctgcctctagcctccctggtccctgggattaaaggcgtgtgccaccactgctcagttagtttgtaaggtactttactgactgaagtatatctcttagtacagcagatgagtttaagaggctatagttcagagagagaaatttggcttgctacaaagcctagttgtcataaaaaaaatgtaggtgacccgggcatggtggtacatacctgtaatcctagctattgggtggctggaaccagatcacaacatagagaccagcctggtctacaatagtaagtttgagactaaccagctatatagggagatttttcttttctttttctttttgactttttttcgagacagggtttctctgtgtagccctggctgtcctggaactcactttgtagaccaggctggcttcgaactcagaaatctgcctgcctctgcttcccaagtgctgggatcaaaggcatgtaccaccaccaccgcctggcaggagatcttgtctcaaacaaataacaacaatagatattatggagagccaagagtaaggtaatttttttagtatagaagataaagaggagaaagaatcagggctagtgaagactagaatcagtcatgaactaggaaagaaaacaaatcaagggcctccagagggtagtgttcctaatggagatagtgttcttgaagactaccggtgtatttctaaagtcactattccagtggtttccctacaactgtagcagggactctttaattctacagttgtggctttggttctagaaaaaaatgacaatttgtgtgattatttttttagatatctcatgtaacctaagctggccataaaaattcaatatgtagctgaagttcctcctacctcctctcccttgatccctgaggcctgggatgacatgtgtatgtcactacacttggctagtttgtactaactgtaactgaaatctagcatggttttattgtgattagaggcaaaaaaatccaagccatgtttctattacattgtatctaaacaagcaactggagctgtctcagatagtcacccctacttccaaatgacatcacccattaggttgaatcactgcctgaatactgaatacattcattaagggtatggattagaagccaccaatcttaaccataaaaggaaataagaatgcacttgaacaagatggagatgacattaaacaattctaagagcccactgtgcatccctgtaatattagcacttgaaaggtctcaaatgagaacaagaaaaatgaattgcaaaagttataatcaagccaggtggtagtggcgcacacctttaattcccagcacttgggagacagaggcaggtggatttctgagttcgaggtcagcctggtctacaaagtgagttctaggacagccaaggctacacagagaaaccctgtctcgaaaaaaaaaaaaccaataaaataaaataaagacaatgaggcagttatggtgcatgactttagtgtcagcaatggggagatctcaagagagaactttttaccagggcagcctgagccacacagcagattccaggacagccagggatacacagtgagacttctcaaaaataaacacacaagaagggacaaggccactcaaaagttataaagaatagatacagaactggttatacctcacttggagaatgtaccaccaaccactctttgagacaaaatctggactgctcttgaacttaattctcctgcctcagcctcctgagtgctgagattatagacatgaaccatcacacagcttaaaatgtacaactcatgtcacaatttaaagggaacattttggtagtaaactttaatgcaatttggtttgttctataagccttctaagaaggggttctacttaattattttatcagtaggagcaaaattggaagcaatggataaggatctgggctatattttgtggaggtgaaaagcctcagtgaaagaataatggggtgtacaatgaatgggtctgtccagccacctgagctgctgctccccatatctgaagcatcagacacactggacaggttcaaaagaagtgagagatgtgttcagaacctatggtcaagacaggcagaagaccaggttggcatgaaccttatagaaatgtgtcaagactttgcctcctgaggactgggactaagggcatgccccattacatagggctaaaggaaagactgtgagtcataataaaaaccttggtacgcaaggacaggagctatgtgtctctgcttgtaatccaaagatcttttagactaaaggcctgtgaagtagatgacatgaactccagggaagtcactagttgtaaagtttgctgaaacgtcaatctaggattctttttattatttttatttatttttaatttttttggtttttcgagacagggtttctctgtatagcccttgactgtcctgtagaccaggctggtctcgaactcagaaatccgcctgcctctgcctccggagtgctgggattaaaggcgtgcgccaccaccgcccggtttaggattctcaaaaaaaaaaaaaaaaaaaaaaaaaattcagataaggtaaaatgtatccatttttaaaattttcaattttaagtgttatctaacaaaccacaactgaatatagaacacctgttctctcagtgtagcagcacacagcctgcaacccctccccccatcaggttacatgctaaggcaaactgcctactacccacagctttcatctttttccaggatacggtccactaaaagtactgatttgtgaaactgcgctttttactctaaccattggtaccggtgcaaaagggacagcgagggccccttcctcaaccggtgacattcgagtgggtcctaccagacacgaactgtcattgtctctttattctagtttcgtgatcctgagtatggggaatggtttggctacctgaaccaagagggaaaggtggccctcaccatcaagggaggtccttttaaaggtgagcgaggaacggggcgagactgtaggggtttgtggcacccggctcgccggatcctccctaccccggggttcattctccccacaggctgcttccatgtgccgcggtgcctggccatgtgcgagcagattctaggagccctactccaacgccttgagcccgcccccctcgactcctcgcccgctgtctctacccatgaaggctcgaaataaagatgaccctgttccac

SEQ ID NO: 63 - DNA, 23909 bp, mus musculus
cggactcaagggagaggtgcaaaacctctcgagccatacgggtcggggcttcgagcagcaactgagagttggagcccgttccgccagcctctgacacgcctttattacttaggaacgttggggttctgcgatcggtggttgtactaagtgctgggtggggaagcaggacggtttcaagatggcggcttccacaattgtggtctgactgtcggcgaagttgagacaaccgcggcatttgtggctcttttccacccgccccggaagccagccagtgctggggacggggggtgtgggaaccgggccggggctccgccatttccggcgggggagggctacgactgaggaagggaggagagagaggcggctcaagatggcggctcccagagcctcctgctcgaggttctaagcgggaacacccaggcaaatagttagagcgacggcgctcagtggcctccagcttctcgggaataggtgctctgcagttctgagaagcttttaaggatacgagctgagtgagaagggggggaagagccaaaggaaggaggatagttaagatggcggcctccatggagtcgtccaccgctgtgtaaggagccgcttcttcgtgagagctgccttagacgaaagggggtgtgtgaagaattaagggtatcctcccattcagtgacctcttcccactgcatccttaaccggaactatggcttcggctgtgtctcccgcaaacttgccagcggtgcttctgcagccccgctggaaacgggtggtgggctggtcgggtcccgtgccccgaccccgccacggccaccgtgcagtggctatcaaggagcttatagtggtgtttggcggcggcaacgaggggatagtggacgaactacacgtgtacaacactggtaagtgctaccgccctgggtttctcaaagtcttccctccatctctctcctaacccttcttttccctatcttctcttttcctatctcactcccctgatgtgttttccttctctctttgcacttattgccatctttgctttctccctgatttttcaacccccgttcttacacccccgtactcttctgtgtttaaaggttgcatttcggtacttagagaaaccctctactccgactggtgagggggaggggatgtcgcgggcgacagtgacttcagacgtacaccgttacccagtgggctggggctggcgcggcagcggatgtgttctcttggcgcaggcggaatcctcccccctcctgcgatagtcctcatctccagcgcccatgctcgttcgggagaaaagataatatttagatcacagatccgttctctacacccagaaaaaaagagggaagcattctttaaggtgcaggcttttaacagactaatgagaccctcgtggcaaatacgaatggcatgatgactatactgcccccccctacacacacatgggggtattgtaccagttgtgaatttttgtagtttttttttccttcaaattatttcttttcctaatctggtgccttaacaattgagttcccccaccccgccccccatagcagactggagggctcagtgtgtcttttgtgtgtgtgtgtgtgtgtgtgtgtgtgtgtgtgtgtgtgagagagagagagagagagagagagagagagagagagagagagattgaaggggttaactagtgcctccttccccaaacccaagcccttgcaaattgggaggagcctatctgcaggtatagctgatctaaagcctggcctctgtcccctcccttatgggagccacatgttgttccttgcttgcttcccttgctctgtctttagggcagaaagctttgagtccttctctggtagcctcttggcactttctgcacatgtagtacgggggattggcctgagtcgccggttgactgcccaagagccttcaggaccttttccttgccctaagggaaaagaagtgctggggcttgccaaagctgaaagtatgtgccagttgtgtccaggtgagagccagcccccttgcctctggtagactagaagcttccctctgctgcagtaggtgcagcctgcagtgcttcctcccttgccagctccttagcctcttccgtgcaccctcatcctttctgggcccctgcggtcccaggcacctcctcttcatttgagggcaggaccaagtgtgaagcaattgaccccaccctccatctcacacactccacactgaggaggcagaaagtaggcaggagatcgtggtctggggtagttcatggaacaagaattggagccagactctcctggcagcttctcagcacctcccctgccaggctgagtatacaggcctgcctctgcacctctgaactattccccctcccaagttgactctgaaagactggtgggttcaaccctcttgagttccttgtctctccacacctgttgcctgcagggagctgggcttttctcagggcctctgcagaaaggggggtgggaaggttggtgatgcttatgtcagcccaggcagctgtggtggcagaaattagcccagtaaggtaaggctaagggcaggggtacaacttgtgtagtagtagagctgtttttagagatgtcttccacaggagcagcagcaacaccttctccatttcctggaccacctttcttctactaaggcccggagcagactttctggcagggaaatacaattttagaaagtagggcaggggcctaattacagtcagctccaaagtccattgcaggcctatgtcttagcttcctgggacctctacatattcattagtttactgaaaacaattgaccactttggtgttaatttgttaccattttgcagaggttggatgttagaaggtaaccaggtttctaaaaagtcaagttcccttacaacaaaggcctagaatcctccaaaacaaagttttcaaattgttctgatcaagttttaggtggcttgagagagcaactagcagaccctgctataccctcttcttcaccttaataggtgtaccccttgtgttgatggtgacagggtctcgtgtatttggcaggctcagagttctaacagttcttgtgctattctggctgcccatccttcattacaactgcctcttttgcttaccttcgttttgttttcaaagaggcctaagttcataatctgttcatgcctctgcctatagccctttgcttttgtgggatcagtacttacccctttaaagagtatgctcttctagaaactcctcttttcctctttgaaagaggaaagagattcagggtgtgtgtgcacttggctgtattggtcagctcttcagtttgcaaggggtggagtataattcacccaggggttacccaatggaattactgggtttgtgtgtgctagagagtgcatgcatacatgactttgcccctttagaggcagtcaccatgggggctgagagacccttcactggcttttggtaggtcttggggttgcaactgcctgtgaaggaattttatttccatgaggcaattcagattactcaagaggcctcaagctcgaggatccatacaggctgaggtgaaatgtgctgtgttgaagctgggtgtgtatggtccctcttccaggctgtttttgccttggtggatattggaagtaaccacccccaccccccagggttgggtgtggatcagagccttgagcaagttctgtaccactgagccacatctccaatccctccatagactggagggggggggcggtttacaaaatatctaatgggacttcctacttataaggaaattggagtctaagaggggaagtgacaagtccaaactaggacactgcactggctactagtagaagtgggccagagtgtgaaccttaatagacttagaaacacatccatttacctctgtccatatacctaaattttattaattcaaatgggtatcacatctgttcccctgtctatttcaggccctccttaacaggctcacttccttattggttagttttgctgattaggaaatagcctacttactcttcaaagctctgtcttaaatgttttctactcagagaaacctccttcagttatgtcctttgtcacccttgctctgctcccaagggttgggcatggttccaggctctttcagcttttcttcctatcagtggagaggttcacagcctacctaccagatgggaaataggaggtctgggccttctttgtgccttccagcatggggcctgcctcatcggaaatgattttggtataaccaatcacactgaaaggaaaataatttcttgaactgcaccgtgttctttgcttcatgggtgttatcagtctatatggtgatggggagacaagctacaaatgacgttggactgaagaaagggaaggtaaaaaagtatcttgagctggagcctgaagacaggtggactcctttcctcaaattcccctcttctgatgagggtcaggctagagggccagggacatgcctaggtatatcaacaatgagggacccaaggattgggttacatgataccccactgggtgtttgagggcaagggagagcagctgttagatttacaaggtagacagagaaattcacatacttccacacttgtagggcgtaaaatggggatttgtaggtgagatgagatggtatgttatctccataccaagagttttactccctaacagactcttgatggaagttgggaagggctgcttctgccttaccagaagaagagacattctagagccagattaggtcctcttaggtctcaataggagaagctgctaatctgggaggctcaagaacatcatagttaacttctggcctggtcgtttgggtcagaggatcagcatgataggaaagctgtgggcaagctaatcccatttgccatttaacttttactcaagactccctacctgttgctttaacacaagggtttttagctgagtgagggactgcccatatatgtgacagataatgaatcagtggattttattctgaattcaggtgagtttcccttcgtgtgtgtgtgtgtgtgtgtgtgtgtgtgtgtgtgtgtgtgtgtgtgttttgaaacagggtcttttataacccaggctcaccttcaactcctgatcttcctgcttccacctttcaaggcctaggattacaggtaactggggactggattgaggctgcctcagaggtttcctgttagcttttcttttgtaatttggatgaaactccttccatggattatttacttgtgcaaagttgatttacctcagtattggaagctcctacatttcttgattcatgtttacactaggagtaaggacataggtcaagagccaacgtttggatgtgtgggcacatgcgtgcatgcatgtccacaagcagtacaagctgcatcactccagcagaaaaatggcagagaggatggggactatagtattgtctttagtgactcagctaaaccactgaggagtcttaagagctagctggttgttccaggtgcacctggggagaccctcctccctaaagcaaggcagggcacagttgttgcctatatggccttagagttgagaaacaggattttacaaatggtgtctgaggagagaactttgtcctcgaatgcatctaaataaagggagcagaaaaagcaaaacaagcagtttccctctttctcagtacattggtctccaaatcaaacatctatttcttgtagagatacaccttttcccctgcatggacaatatggctgagaagcagattaacaacttagactggtccacaaaagcctcctgtgtcccctcctccaaaacaacctgacttcccatctacttcttggaggggggctggtcttgactttgaagcctttcctcacagtagctgcagcctccttctccagatccaggacttgaaatccttcctacttccttctcagatctcacctgactgacatgcagcaggtctgcctctgggccctggtcttagattttggggacgaacaaacggactgactgagcacttatcctttaaatgtgtggcatggtaaaaggatgtgtttgcctataacataaccagagcccttgccactgtaggtatgacagacataggagcctaggtgaaagagcaaactgccagcaaactagggaagagctccattccagctgaaggcttgaccactgtctaatactgtctttgggaaaccaggaggtacctgagggatgatttccctttcttggtgacttctcctttgccccagttagaagtgtgagtggctcctgagaactttctgtcacagacactctgctttggttgccacttcaggcttgagaacattgtgcgtgtggggaaggggcactgccccagagcctgtggaccatcacctaggagatgagtggggaagtcaaagcagaggcagctaggctttcgtggtcagcagagactgctttttgcctcgggctcttctgagccagcaatctctttcctgtctgtcagctgcctgcatgaagggaaggcatcagcctataatagtttctaggaccacctacaggtgcagctgtaggctctggctgtctttaactctggtacagagagaatcatgggctctgaataggaggaacatgagctttagggggcatttggggtatagaagtttaatgatcatgtaaacagtgggggaaggaagtcatggtctactagattctcagaggctggtgaattatcttggtgactttactgctttctgagatgaccttaatgagaagttgtgcaattgtttgaaagccagggttctgcagatggtttgaataaaatgactagagatttgtccataatgctctaaaaggatagtgtgctggctcagcctcttctctcttggctacatttgaagactaggagttgtagagtacaagacttaaggaataagaattgtggggtggggggcacttggattctagaagctcccggatgttttgacttttgtttccttttcttcagcaaccaaccagtggttcatcccagctgtgagaggggatatccctccagggtgtgcagcctatggctttgtgtgtgatggtactcgcctattggtgtttggtggaatggtagagtatggaaaatacagcaacgacctctatgaactccaggtaataacatagagcctctgtgggcctgggttgttacactgcctcgggccctatggaactctccatagtgttcattgtgctggtttgtgaggaaaggcagtggaaggggttacttgagagtctaccaaggctgttcgctccttgaacagtgtcagaggagagaacaggaccaaactctttagaacttacatgtttcagcaatgtgctctctcactcccgacaatcttttccttgtgccacaaatagcccctggcccctaaccagtgacttctcatctcttaaatattattgattttgtaggcaagtcgttgggaatggaagagactgaaggcaaagacacccaaaaatgggcctcctccatgtcctcggcttggacatagcttctcccttgtgggcaacaaatgttacctgtttgggggtctggccaatgatagtgaggaccccaagaacaacattccgaggtgaggctttgtcctatttttttctctgaagcgtcccaccagagtgggtctactttccccaggtataagattcatctgaaattctaaagttggttgtgccagctgactccaccagagcctctcctgtgctgggttgtcaatgagagaatacagtgccctttcaagacattctcatctttgagatctgaacccctgggtaggtcttgtaggagaaacctaggcaagaggtagaattggcctggtccctatcccacaggtcgaaattagaccttgcttcctttgaagcttttgctacttaaacatatctgaggcctatagccaaagctcctaatacgtggaggtagttccaagctgacaccctcttactctagggaagcccacatataatgcctggtattgtggacatgattgcctaaaaggacctgcctctgagtctgaacttaaggctgccatcatagctttacacatacaccctttccattgctccaattggactcaaactgtaagcttctagcagtctcttttgggggaaaggatagtagagtgtgtggtttccatggcctttgctcttttgtgttctagtaaatctactgctcattgagataacctggaaaaacctgtggtgcatgtgttcaaggtttgctatgactgatcttcctcaggtacctgaatgacttatatattctcgaactacggccaggctctggagtggtagcttgggacatccccatcacttacggtgtcctgcctccaccccgggagtcacatactgctgtggtctacactgaaaaagataacaagaaatccaagctggtgatctatggagggatgagtggctgcaggctaggggacctttggaccctggacattggtaagaaattgctgctattccagtagcttcagagcaaggccaatctcctggatagctagccttgagtggctgttgttgcccggtgaggtgggactcatgggaagctagtgttccccttagtcttcttatcagtggtggataggaaacagagtaaggcttggtgcactactaacatggacttttgagagaatagggagagagtacagtcttttcacaatggaattccctcaatctaggtagagttttgactcacttttcagtggacagtctatatgtggaatggtatattctgatataactagtgtgataaaatttattaccctagataagattttttacttgggctataaagtgggtgatggattaggtggaggtagatattggttatagtgccctgtgggtcgcagcacccaaacatttgaacataagcaaaagttgagtttttgtctagtgctaaaatggcatggaggtaaatatgctctacagggagtagaagtacaaaggagaggttggggtgagcttgatacccccatgtcatccctgagaatggtgatgccttatagcaggtgcctcctacttttgggaagaaacctccttgcccagatcatctgaacagctttacaaatgctgaaatatacttgtgaggatagtaaattagagggcttgctgagggatttagaaagacaaagatgcagttttatgttggtttagggcccagttggcccaagtactgggactgtggtgtctgatccagcataggtaatctttccatttctgcagagacactgacatggaataagcccagccttagtggggtggcaccccttcctcgcagcctccactctgcaaccaccataggaaacaagtgagtgtctgctcttttcttctttgacctgagctgcccctaagtcctgaaggtttctcaagtcagttttgtcaactgtccctcaatcccaaggaggcctttttctggtgggtctgtcattaaacaaccccataccctccttattaaacattttttaaaaagacagattaagggtagagggactgcatgtaatgcagcctgagaccctttcttgacctgtaaggcctcatcaaggtatagacagtgtagctcttcattgaatcagggttctttgtgaatgccaaggtctagcgtccatggaggcatcttagatgaacaaaacaatgctctccttacaaagaaataacgggctggagagatggctcagcggttcagagcactgactgctcttccaaaggtcctgaattcaaatcccagaaaccacatggtggctcacaaccatctgtaatgaaatctcacgccctcttctggagtgtctgaagacagctacagtgtacttacatataataaataaatcttaagaaacaaagaaacaaatttgtaagagtaaaccatcaggtaataagtgccatattaaacagttccatgcatccttggggactcctggggccttctagaaaactgaatgtgttcagaactttctaggtaaaagaggtagcctctagcttggtgcttctcttcaatcctctcttgctttttctttatcctcctagaatgtatgtatttggtggctgggtgccccttgtcatggacgatgtcaaagtggccacacacgagaaggagtggaagtgtaccaacacactggcttgtctcaacctgggtatggccttctcaggcttagaatggccagggatggggtggccctgggaaattattagggtgtccaggaagcaaattcgggctcatggatattaccagaaatatccaatgggtagaaaactctcaggtagtactccttttagtatgaatgggctcttcatatgtgcctgacatccataagtgcaaaagcacatatagtgcagaagtgtttcttatactccatttgtagggactctactaataggctatagctctaggaccttagcttgccatacacagggccaagtagcccttttcccttactatcttggagatcatttcatacccatgcatagttcttcatattctttaatatgctgtacagctttaattctagcatctaggaggcagaagtagatggaactcttgagttcaagaccagccagatgtttgtgaaaccccatctcgaaaacaaaatactaaacaaaaaatttgagttgctttaattttgactggatgcacacattatcttaagatttttacttgagccaggcagtgatggcacacacctttaatcccagcacttgggaggcagaagcaggtgggtttctgagtttctggtctacagagtgagttccaggacagccagggctacacagagaaaccctgtctcgaaaaaaaaaaaatcttgattttttttttttcatgtattgtttccctttgcccatctcttaggattgtattatttttatgtacaaggagttatcttccaaatactttcccaatatgtggcttaattttttatgcctctttgcctcatttttgttttctcttaatttgatactccaataacttgaccttccctgacaatgaaagaatagagggcaacttgggagttggtggaacaggttccttttgtcctctgtgtgacctccagcacctgtgcacctctagataccatggcctgggaaaccatcctgatggatacattggaggacaacattcctcgagctcgagcaggccactgtgctgttgccatcaatactcgtctgtatatttggagtggccgtgatggctaccgcaaggcctggaacaaccaggtctgctgcaaggacttgtggtatttggagacaggtaaggtacttagccactgacattccccactgctgaagcctctctattccctatcttaacagttgctttgttgtattacagaaaagccaccacccccagcccgagtacaactagtacgagccaacaccaactcactggaggttagctggggtgcagtggcaacagctgacagttaccttctacaactccagaaatatgacattcctgccacagctgctacggctacctcccccactcccaatccagtcccgtctgtgcctgccaaccctcccaagagccctgcgccagcagcagctgcacctgctgtacagccactgacccaagtaggcatcacacttgtgccccaggctgccactgcacccccaagcacaaccaccatccaggtcttgccgacagtgccaggcagctccatttctgtgcccactgcagccaggactcaaggtaagccatgagggccataggcatttgtgtgaggcttaatcactggagacattcattgcctgaatggtggctgctgctttgttcttggttgatttagctttggttttgttcttaaaataggggataaaagtgctgtcttactgatgcgatggtcttgggggcatagaaaagtcatacataaaaacatgtaggtcaaggaataggtcaagtctaccttaagtctgacagagtagaagagtatctcctgatgatcaacccttttccttatcaggtgtccctgctgttctcaaagtgactggtcctcaagctacaacaggaacaccactggttaccatgagacctgcaagccaggctggaaaagctcctgtcactgtgacttccctgcctgccagtgttcgaatggttgtacccacacagagtgcccaggggacggtgaggacatctctctgtgtgtgtgtgtgtgtgtgtgtgtgtgtgtgtgtgtgtgtgtgtgtacacgtacatacacacacatatctctatccctgggactgagggtgtagcttacttgttagaatgtttgcctagcatgcatgaagcccaccagctcccatcataggctcttgtttgtaagatgctactgcattaaaaatgccacaggcctttgatcccaagactcaggagacaggagttcaaggacagccagggctatacagagaaaccctgtctcaaaaaaccgggggtggcaaaggtggagggatccttgacatgttcattgtggttttcctgatttggaaggtggaggagaatatctagttagttgcatttgacccaagtctgtgagaataagctgtatttaactcaaaggttgtgttttgttttgggtaggctatctactatttagagattgtcctgcctcagcctcccgagttctggaattataagcatgaacaatacccagcagtgatgttgatagtgttgtatgtgaaacccatcactgccttgtgctaagtatgtgttcttatactgagtgagatatgtaaaatgaattatttttattataaatatatgtagtaaattaatctagtggcctagcttgattatggttctttgattaaaaatctacttaggggctaggggtgtggctcaatcgtttgagtgcttggttagtgtgcacaaagctctaggttcaatttctaacattgcattagccatgtagttgcatgtcagtaatcccaactttcgagaggtggaagcaggaagatcagaaattgagggttatctttagtgtgagtttgagactagcccgagctatgtgagaacctttctcaaaagaaaggagcacttggcgagcacctgcctacttgttgtttgcactaggagagaggagcccgaattaggaaaaaacaatatgctgctgagcccttctggcaggttctgaaagggtcattgaatttggaagcaggtggcaggtggaacccttgcagctcacatgctttgtgtccgtcacaggtgatcggcagcaacccacagatgagtgggatggccgcattggctgctgctgctgctgccacacagaaaatccctccatcctcagcacccacggtgctgagtgtcccagcagggaccaccatcgtcaagacagtggctgtgacacctggcacgaccactcttccagccactgtgaaggtggcctcctcccctgtcatggtgagcattgatcttctgggcctggtaatcgaacaagcagtgaccgtttgttctgggtttgggccaacctttcgggccgtcggtttacgatcagtactggcatgggctatggaacatgcagttacctttaagggtgtccagccttagattagacctgtggagagttcaggctgttctcttgctgctcagccaaccaaactggatggacaggtggtcagcagagctacagccattatgttgctgctatgttcataactcatctctgcttctccaggtgagcaacccagccactcgaatgctaaagactgcagctgcccaagtggggacatctgtgtcctctgctgccaacacatctactcgccctatcatcacagtacacaaatcaggaactgtaacagtggcccagcaagcccaggtggtgaccacggtggtaggtggagtcaccaagaccatcaccctagtgaagagccccatctctgtcccaggaggcagtgctctggtgagtgacagctaccacctggccgtgtatgacagttgctagcctttggtgaatgccactggtgactcgctatcttgtgccaattccaatatagttctagcccaggccatgcccttgtttggttccagattactgcctgctccatcctttcctttttagatttccaatctgggaaaagtgatgtcggtggtccagaccaaaccagttcagacatcagcagtgacaggccaagcatctacaggtcctgtgactcagatcatccaggtgagcactcactctctcaggcccaagaggatgaattgacactgggaaacaaggccttgctgataccacagcacccacagtattcagaatattctctgagttatagtagctcaacctaatgttcctttctggcagtatttcctgttaatttataacttctcctttttagaccaaaggacccctgccagcggggactatcctgaagctggtgacatcagcagatggcaagcccacaaccatcattaccaccacacaggctagtggggcagggaccaagcccactatcctgggcatcagtagtgtttctcccagcaccaccaaacctggcacaactaccattattaagaccattcctatgtcggccattatcacccaggcaggtgccacaggtaaacaggcagctttcaaaaggcctttgctggtttgctggtgagtataaatcaaaaagataagtcctcacagcttattttctctgaatccttccccaatgcaggtgttaccagcagtcctggcattaagtccccaattacaattatcaccaccaaagtgatgacttcaggaacaggagcgcctgctaaaatcatcactgctgtccccaagattgctactggccatgggcaacaaggagtgacccaggtgaggcacacatgacccctcttcacttcagtctagcatagaccacatgtgtcatcctaacaggtctgagaggggcagcacagtccattcagcctgaaagtgacattggtggcactttgctctgctgttccaggtggtgctaaagggggcccctggacaaccaggcaccatcctccgtactgtgcctatgggcggcgttcgcctggtcacccctgtcaccgtctctgctgtcaagccagctgtcaccacattggttgtgaagggtaccacaggtgtgtagcctgcaggccaggtcctcagcaatggctgggggaggataacaggtcctctctccagagccttctgtccttggtggctacatggcagggctcccattccctagccctcgagagagagacaggctgctagatagaaagtggtagcaataggcctcattctgcctttgcctttccctccatttaggtgttacaacgctaggcacagtgacaggcactgtctccaccagcctggccggagctggggcacatagcaccagtgcttccctggctacacctatcactaccttgggcactattgctacgctctcaagccaggtgatcaaccctactgctatcacagtgtcagctgcacagactacactaacagctgctggtgggcttaccacacccacaatcacaatgcaggtaagtgggtcctaagggtgtaccaccatacacagcagcactcccacatgaaagtagggggcattttagcctttctcccctttccagattcagttctatagacctatataattatgacagcttttctgcacatggtgtgatctctgtctcagtctttcctggtgacacatttgagctatgtccagtttgcagacactaggatctcataatgtacatacagtatttgttctcttgtcatcttttcttcttaactggacaagaagtggtaagggaacttattttactggcctttgtacactgtctggaaaaaggcttgactatcgtacaactcctcctgccccagctctgcctcattgtcccttcatcctcggctctaagtaagtcattgttttgagatcacgggccaaacttttcttagatttgccttggatagttaacagagttggtggtcccagtcaacatgggcgagcataggatagtaggagaggtaaatgcaaaatcacatagtccaggcactaactcctctgttctctttccccagcctgtctcccagcctacccaggtcactctgattacagcacccagtggggttgaagcacagcctgtacatgaccttcctgtatccattttggcctcacctactacagagcagcccacagcaacagtcaccatcgctgactcaggccagggtgatgtgcagcccggcactgtgacactggtgtgttccaacccaccctgtgaaacccatgaaacaggcaccaccaacacagctaccaccactgttgtggctaaccttgggggacatcctcaacctacccaggtgcagtttgtttgtgacagacaggagacagctgcttcacttgtgacctcagctgtaggacaacagaatggtaatgtggtccgtgtctgttcaaaccccccctgtgagacccatgagacgggcactaccaacactgccacaacagccacctccaacatggctgggcagcatggctgctcgaaccccccctgtgagactcatgagacaggcaccaccagcactgccactacagcaatgtccagcatgggcactgggcagcagcgagacactcgtcgtaccactaacacccccactgtagtgcggatcactgtggctcctggggcattggagagagtccagggtaccgtgaagcctcagtgccaaacccagcagaccaacatgaccaccaccaccatgactgtgcaggccactggagctccatgctcagctggccccctgcttaggccaagtgtggcactggagtctgggagccacagccctgcctttgtgcaactagcccttccaagtgtcagagttgggctaagtggccccagcagcaaggacatgcccacagggcgccaaccagagacatatcatacttacacaactaataccccaaccacaacccgctctatcatggttgctggggagcttggtgcagctcgggtggtccccacatctacatatgagagcctccaggcaagctctcctagcagcaccatgactatgacagccctagaggcactgctgtgcccttcggctactgtcacccaagtctgctccaacccgccatgtgagacccatgagacgggtaccaccaacaccgccactacctccaatgcgggcagtgctcagcgagtatgctccaacccgccttgtgagactcatgagacgggcaccacacacacagctaccactgccacatcaaatggaggtgcaggccagcctgagggtggacaacagcctgccagtggccatccctgcgagacacaccagaccacttccactggcaccactatgtcagtcagtgtgggtaccctgattcctgatgctacttcctctcatggaaccctggagtcgggcttagaggtggtagcagtgcccactgtcacctcccaggctggttccacattgctggcctctttcccaacacagagggtatgctccaaccctccttgcgagacccacgagacaggtaccacgcacacagccaccactgtcacctctaacatgagctcaaaccaaggtaagtagaagtgtccggtagaggaggtacagatagtctatttttgcgcgggggggggggggtgaatcctaggaaacctgtggtggtaaaagcaaagagagtcaactgatctcccctttgacacacccacagaccctccaccagctgccagtgaccaaggagaggtggcaagcacccaaggtgacagcacaaatatcaccagtgccagtgctatcactacaagtgtgtcttctacattgccacgagcagtgaccactgtgacacagtctacaccagtccctggtccctctgtgccggtaagcctcaccccaaaggatcctttctgtggccttttgcccactttcatctgtgctgtccataaatggacactagatgtcgcccttgttccagaatggtattgttccttggttgttcttctagaccataaaagggcaatcttggtgcctgggaggcaggaggcaaacagtcccttagaggagcgttggtactttatctccactgttggtttccttctttgctgttccccatcatttgtctctacagtgaagtcttctgggcatgagtggaaacttgacccaggggctttcctcttgtcacacccttgctgatgcttcttgactcacattcctcatttacatttacccaagataaatgttgtgggtgataccataggcctacagggacaaaacaaaggctatcttgtttttctgccccactgcctggttctagcctttgtctcctcccctctccctctgacgggggcttctctccctttctagaacatctcatcattgactgagactaccccaggggctctgaattccgaagtccccatcccagccacgataacagtgaccatagccaacacagaaacttctgacatgcccttctctgctgttgacatcctgcagcccccagaggaactccaggtctcaccagggcctcgccagcagctgcctccacggcaactcctgcagtctgcctccacacccctgatgggggagtctactgaggtcctgtcagcctcccagacccctgagctccaggccgccgtggatctgagcagcactggggacccatcttcaggccaggagcctaccacctctgctgtcgtggccactgtggtggtccaaccacccccacccacacagtctgaagtagaccagttatcacttccccaagagctgatggctgaagcccaggcgggcaccacaacccttatggtaacagggctcactccagaggagctggcagtgactgctgctgctgaagcagctgctcaagctgcagccactgaagaagcccaagccttggccatccaggctgtgctccaggccgcacagcaggctgtcatgggtaggtatcagctggcagatttgagggataggccccttaggatgagtgacagacagccttacagagagggctaaggcaccatttgggggctacttgagatctgcttcctgtgagggtgtacaatgtaactcaagagagtcaagagaggcttatgtagaacgagtagtccagggaggagacatgggacctagtggtgaggggtataataaggtgtgggcaggataaaaatgcttagggaaacgaaatctcggggacgccattgctgcccattgggctaggcacacttgtgttcctttttgaatagtagttttcttggtcctggagcaggcactggggagcccatggatacatctgaagcagcagcagcagtgacacaagcagaactgggtcacctttcagctgaaggccaagagggtcaggctaccaccatacccattgtgttgacacagcaggagcttgcagccctggtgcagcagcagcagcagctccaggaggctcaagctcaagcccagcaacagcaccatcttcccactgaggctctggccccagctgacagtctcaatgacccatccatcgagagcaactgcctcaacgagttagctagtgctgtcccaagcaccgtggctttgctaccctcaacagctaccgagagtaagctgggctgctttttggcaggggtaaatcattaatagagttgaacggatgggaggtgaacacagtgtaacaaagtggcgtggaggttctgcctcaaaacagtaccttctcccagctgatactttgtttctttccaggcctggctccatctaacacatttgtggctccccagcctgttgtagctagtccagcaaagatgcaggctgcagctacccttactgaagtggccaatggcattgagtccctgggtgtggtgagtctgggtcactggccctaggagatagggcagcactgcctttgggccacaagggcttgatattatctcatttctgttccccagaaaccggacttgccacccccacccagcaaagcccctgtgaaaaaggagaaccagtggtttgatgtgggggtcattaagggtaccagtgtaatggtgacacactattttctgccaccagatgatgctgttcagtcagatgtaagtattgcccagtaactggtacccttggatagtggggtggaacctgctgtgcctgtgagagtttgtcataaaaacaaactttagtttccctgccttgtgagaggagctcacagaactccatctttgccacttgaaaagttaggaagtacaagtaagaaagtcaaactgatccttttctaacagcaccaagccccagttaaccttaccatgtccctagggcctcgctataaaagagacagccatgactgaactttcttttggtcccatgttactctaggacattggccatcctagacaagcactctagaactgaactgccccctcgtccagagtattctttgtgactgtaggcctcaagccattttcttctttactaattttccacctcttgccttaggatgactcaggcacggtcccagactataaccagctaaagaagcaggagctacagccaggcacggcttacaaatttcgagttgctggaatcaatgcttgtggccggggacccttcagtgagatctcagcctttaagacttgtctgcctgggttcccaggggctccttgtgctattaaaatcagcaaggtgagactttctatgggccatctttctgttttctgttggtctgctgtctgctctagggtggtacatatgaacagagccaggaggtgactggaccaggagtataccagataagctcaagtagcctacattcacccttaataaacaagatacatgccaggtgctccgttggtaaatgtttttgtctaatcctgaaggtcccaaggagacctgggtcttgttagtctattttcagatgcagaaactgaggcaccaagaagctaagtgacaagttatggattagatgatgggttggggagggtgttataaaggctctttaaagtcctttaatatttgatgtggggtatctgggttgttttgggttttttaaaattttttattacatttgtatttagttggggggtgcatagctgtgacacggtgctcatttgaaggtcagaggaggtcatgtgggtcttggaaattgaactcagtcatcaggcttggtagcaggcatgtttaccatactgttgagccatctcaccgaaccctggaatagctgttggattgggggaggtttttttttttttttttagggattattagcagttctaataagcgtctagccctcttgctcttgagtacaggcagggtgggctgtgaagccacagtggctgaagaagacaaggcttgactttatgtcctgggttctagagcccagatggtgctcacctcacctgggagccaccgtctgtgacctccggcaagatcatcgagtactctgtgtacctggccatccagagctcacaggccagtggtgagccaaagagctccaccccagcccagctggccttcatgcgagtgtactgtgggcctagcccttcctgcctagtgcagtcctccagcctctccaacgcccacattgactatactacaaagcctgccatcatcttccgcattgctgcccgcaatgaaaagggctacggccctgccacacaagtgaggtggttgcaaggtaagtgttcacaagccttttggggcaatttttagggaaggtatgggaaagcactgagtggaacaaagatacacctagctagactagggatgcttcagacattggatgagagcatatagggtattatagaggatgctcttgtgttctaggggtgcacagaagatactctaggatgtctaaaagtaaaggttaggaggaggggcttgaagaaagcaaaagctgttaggctcaagaacaacatgtcctaaagcccttaaaatgggtagctgaggctaggtcccggaaggtatctgtctcaggagggatattgagaggcaggaactgaacccgaaggatggcatgggcagtcaagactgtgaaaagtggggtacacccaagtgcttctgccttttgcctggctgctcaccatcccattcctttcagaaactagtaaagacagctctggcaccaagccggccagcaagcggcccatgtcgtctccagaaatgtaagtaatctctttgaggaatcttttgtggggagtacttaagagtggaagtaagctccgtttctcatcagctgcttgggattatatctacacaaggtcctgagttggtgtttttgtgatgctcttgggaccctctataattatttcttctcttttctcttatataaggaaatctgctccaaagaagtctaaggctgatggtcagtgaggaagctggccagcaactggatcctccagacccctctgcttcaggaaggccctatagggcccaccttcccgccctgcccacctggcctttgcacttcaccctcaccagctactggccaccattcagtctcccccttttcctctgtttttacaataaagaaagcacattttaccattgctattgggaggaagcagaaggcagattggaaagaacagcgagtaagtgcaagttgtgctccttccttttccctacctggtaccctccctgggttgagtatgaatggacagctcagagactttgggaagagaaattaaaactgaaaacaaaggagataacacccatacttaagcctgcacttgtttgtagttcatcgcccttggcctgagaggcagccaaggactagagggggaaggatatcccccaagttccctcagaggcttttcccagcaggtaccccattctgggtatctgtctggttctattttgttttgttattatccttgtatttccagccacctcccatcccttcttcaagcttagccagatcctatctcgcccagtgaaatcacaggaagtttaacgtatctcagaggcctttgagttcccactcaatacctctccctctttacagaagagaggggtggggggagccttggttggtctgagcagtggctgtgaaatcctcccaatgggcacagaatggcccccaggaaccctggccttggcctacttttttgagcctgggggccacatcaccaactgctgcatatgttgtattttttaagttgaaattaatgaagttaacatttttattgtaattttagccttagcgtgtgggggtttatccctttttgttagctgtgtacagaatgtgtatcctatctcctcccctccttggctaatcattggcaggggtcttcctggggaaaagcttaaagagcagctagggaaggagagaaacagtgtcctgggtgagacttggtagatactgctccaatatcctgttgctagcccccacctccttctggaacagtgtgagacaattaaacttcattccctgtgggttagcacttaatatgtagaagcttgggcttgaaggtgatgtccaccttaatcagcatcacttgcagagactgaccctaaacaacacagcaggggcagggaacgggtaggacttgaccctcttgaaggcagcccaggatgggagtagggtatgccatatcccacaggggctatgagtaggtaccagataccaactcagtaattaattttgtagcattgtccccaagctctggatttttttctctccaggacccaagttttaggcagtgagtaatgcttataagcaaattactgaaggatttaaaaatggacagccaatgtgttcagccgctctggcctgtaccccctggggcctctagtgtattgtattatatttctgtggaaagtcatgtttagtcaaattggaatccactcacctgttccctttgttttccctatcccttctcctgagcaccctttgatttctgaggacagtactacccattcatctattgtagagtaacccttgtgactcaatattaccatagtgcgatgttgttttgtgctattttgaacaattaaaaagactttttttgaaataacca

SEQ ID NO: 64 - DNA, 841 bp, mus musculus
ttgaaggggttaactagtgcctccttccccaaacccaagcccttgcaaattgggaggagcctatctgcaggtatagctgatctaaagcctggcctctgtcccctcccttatgggagccacatgttgttccttgcttgcttcccttgctctgtctttagggcagaaagctttgagtccttctctggtagcctcttggcactttctgcacatgtagtacgggggattggcctgagtcgccggttgactgcccaagagccttcaggaccttttccttgccctaagggaaaagaagtgctggggcttgccaaagctgaaagtatgtgccagttgtgtccaggtgagagccagcccccttgcctctggtagactagaagcttccctctgctgcagtaggtgcagcctgcagtgcttcctcccttgccagctccttagcctcttccgtgcaccctcatcctttctgggcccctgcggtcccaggcacctcctcttcatttgagggcaggaccaagtgtgaagcaattgaccccaccctccatctcacacactccacactgaggaggcagaaagtaggcaggagatcgtggtctggggtagttcatggaacaagaattggagccagactctcctggcagcttctcagcacctcccctgccaggctgagtatacaggcctgcctctgcacctctgaactattccccctcccaagttgactctgaaagactggtgggttcaaccctcttgagttccttgtctctccacacctgttgcctgcagggagctgggcttttctcagggcctctgcagaaaggggggtgggaaggttggtgatgcttatgtcagc

SEQ ID NO: 65 - DNA, 194 bp, mus musculus
ttcacacaagatggcggctcccagggaggaggcatgatcgccctgccgttaccgcttcttctgccgtacaattgtcacttcgggtcttaactcctgctctttcgagcggctcctgtgggaaggagtcttaaggagggaagcgaggattggacgctgccttgcgtttggtttgctgtggaagaactgtccaggaa

SEQ ID NO: 66 - DNA, 801 bp, mus musculus
gcagtgaatgtgtactcgcgatgtctgtcgccagtgataacataagtcgacatgacatgctggcttggatcaatgaatttctgcaattgaatctgacaaagatagaacagttgtgttcaggagctgcatactgtcagtttatggacatgctcttccctggcttcattgccttgaagaaagtgaaattctaagctagaacatgaatatatgcagaacttcaaaatactacaagcaggctttaagaggctgggtgttgacaaaacaattcctgtggataaattagtaaaagaaaaatttcaggacaattttgaattcgttcaatggttcaagaagttttttgatgcaaattaagatggaaaagaacgtgatcctgcagctgccagacaaggtcaggaaactgcagtggctccttctcttgttgctccagctttgagtgaaccgaagaaacctctcggctccagtactgcagccccacagagacccattgcaacacagaggactactgcagctcctaaggctggccctgggatggtgcgaaagaatcctgatgtgggcaatggagatgtcgaagcagctgaattgatgcagcaggtcaaagtattgaagcttactgttgaagacttggagaaggagagagacttctacttgggaaagctaaggaacattgaactgatttgccaggacaatgaggggggaaatgaccctgtactgcagaggattgtagatattctttatgccacagacgaaggctttgtgatacctgattaaagggtcccaccggaagaacaggaagagtattaa

SEQ ID NO: 67 - DNA, 801 bp, mus musculus; identical to SEQ ID NO: 66

SEQ ID NO: 68 - DNA, 180 bp, mus musculus
tgcgaaccgctacgcgcccccgcccgcagcgccttgctggcctgctcccaggctgagctcacatcctctgtaggccgcgcccccaacgctgcacccgaggtgggacaggcacagactaggcttctgcctctgagagccgcaccccatccctgggatacccatgctttccacctacaacaa

SEQ ID NO: 69 - DNA, 135 bp, mus musculus
accactaggccccttagccgccttgttctttgaggtcctcgagaacaaaaggctggcctggcgagcatgcgaaccgctacgcgcccccgcccgcagcgccttgctggcctgctcccaggctgagctcacatcctc

SEQ ID NO: 70 - DNA, 411 bp, mus musculus
gtttgccagcccagcctgttccctcagctagaccggtctgcaccggccgttctggctagtttgggcctgccctgaggagcgcgcgcaacctgcgtagccgcggctgtgacgcaaatgtgacggcggcgtgacgcgcccacagccgctcttgaggctctggcgcttcttcttctaggctccgagcggttggtttcttgggccctgtctgtaggccccggccgcccctggcgttcaacaccgcttccaggtgccggccttgtctgccatggacgactatgcggttttgtccgatactgagctggccgcagtgctacgccagtacaacatccctcatgggcctattgtgggtatgctgcacccggtggcgctcagaacctctcttggtccactgctttcccgcgctcctccctg

SEQ ID NO: 71 - DNA, 925 bp, mus musculus
aggagcgcgcgcaacctgcgtagccgcggctgtgacgcaaatgtgacggcggcgtgacgcgcccacagccgctcttgaggctctggcgcttcttcttctaggctccgagcggttggtttcttgggccctgtctgtaggccccggccgcccctggcgttcaacaccgcttccaggtgccggccttgtctgccatggacgactatgcggttttgtccgatactgagctggccgcagtgctacgccagtacaacatccctcatgggcctattgtgggtatgctgcacccggtggcgctcagaacctctcttggtccactgctttcccgcgctcctccctgagcgttctccccacctctccctcccctcaagtcccctccccgtgttcccttgtgctcttggggtgctcggctcacgccctctgaccgcttcgcaccctgtgtctgggcaggttccactcgcaagctctacgaaaagaaaatcttcgagtacgagacccagagaaggagactcttaccccccaactcgtcatcttcttcattctcctatcagttctcaggtgagcccttaactgcagagccccaaagagcagcttggggcacacgtcttagggagggagggtgtggccgaagctattgagggagtagggggaaggctggagatcgaatggtcctgtccctcctccttcacatgcagacttggattcagccgccgtggactcagacatgtatgatctgcccaaaaaagaagacgccttactttaccagagcaagggtaaggcaggtatagggtgggcactgatgtttttatcccatgcttccgggatttgggcacagggaaaccccagacctccctcacctccttgtaccagttctcagtggcttcagaggggagaaactgacacagcacacacaggctggggagggaga

SEQ ID NO: 72 - DNA, 954 bp, mus musculus
tgctcgacgaatccgcctgaaagcaagtcgaggaagcgtccttgcttgttgtcgcaaacatgcctactatcacccgtgccaagaagcagcagtctatcattgaacagttacctggacctagggaaaaaggtgaggtaggcttgctcattctttggccagttcccctgcagcaaagagcagagcagaggcagtcttctctcagggtcctcaggccctgaaccacaatgttggtgcgcactcccaaattaagtttgcctgtgtgacgactgctcagaaaacccaaagcaaaggaccttatgcacaggatgggtagcgcgactgacctgttcaggtccccactggagtggcagtttagaaaaatgcctcatggcagaaatttgttagttctggtaccacatgaatactaggcaaatgctctatcgtggagataaccaaatgccccaacccccagatcactgggagaaatagtacaataaaaggcagagaataatagacgcggacacccgatgcccttttccggtctctgtgtgagccttcagaagcatgcataaccggatacacatcgggtgggacagggaaagagaacaagtaaaaagtttccaccagcctacgacttgcgtagcttcaggtaatggtgctgtgtagctaatgtcgcctgtagacactagaattatggaatcaaagagacgcagcactgcttaaggcggtttggagccaaaaccttgacgggggaggggccggagcgaggctggcgtagacccgccctggcagccgtcaagcaacctaggcatgttttgcgacaacaggcaaggacgcttcctcgagttgctttccggctgattcgtcgagtgaggccgtcaagacttggtttctagtgcgcattgctttgtacagcagtcccgtctcgtcgcctgagcagcggctcttctctatccagagaacagtgctagggag

SEQ ID NO: 73 - DNA, 1004 bp, mus musculus
tgctcgacgaatccgcctgaaagcaagtcgaggaagcgtccttgcttgttgtcgcaaacatgcctactatcacccgtgccaagaagcagcagtctatcattgaacagttacctggacctagggaaaaaggtgaggtaggcttgctcattctttggccagttcccctgcagcaaagagcagagcagaggcagtcttctctcagggtcctcaggccctgaaccacaatgttggtgcgcactcccaaattaagtttgcctgtgtgacgactgctcagaaaacccaaagcaaaggaccttatgcacaggatgggtagcgcgactgacctgttcaggtccccactggagtggcagtttagaaaaatgcctcatggcagaaatttgttagttctggtaccacatgaatactaggcaaatgctctatcgtggagataaccaaatgccccaacccccagatcactgggagaaatagtacaataaaaggcagagaataatagacgcggacacccgatgcccttttccggtctctgtgtgagccttcagaagcatgcataaccggatacacatcgggtgggacagggaaagagaacaagtaaaaagtttccaccagcctacgacttgcgtagcttcaggtaatggtgctgtgtagctaatgtcgcctgtagacactagaattatggaatcaaagagacgcagcactgcttaaggcggtttggagccaaaaccttgacgggggaggggccggagcgaggctggcgtagacccgccctggcagccgtcaagcaacctaggcatgttttgcgacaacaggcaaggacgcttcctcgagttgctttccggctgattcgtcgagtgaggccgtcaagacttggtttctagtgcgcattgctttgtacagcagtcccgtctcgtcgcctgagcagcggctcttctctatccagagaacagtgctagggaggtgctgagctgttccaccaggtgaccttagtctagtcctctgccagtctg

SEQ ID NO: 74 - DNA, 7511 bp, mus musculus
gggaggggccggagcgaggctggcgtagacccgccctggcagccgtcaagcaacctaggcatgttttgcgacaacaggcaaggacgcttcctcgagttgctttccggctgattcgtcgagtgaggccgtcaagacttggtttctagtgcgcattgctttgtacagcagtcccgtctcgtcgcctgagcagcggctcttctctatccagagaacagtgctagggaggtgctgagctgttccaccaggtgaccttagtctagtcctctgccagtctgttggagatccttctcctgagtggtagaggacatcggctggcctggggcaagaggaactctgggctccgggggcggggccggagccggaggagatgcccctccatgtgaagtggccattccccgcggtgccccggctcacctggactctagccagcagcgtcgtcatgggcctagttggcacctacagctgcttctggaccagtgagtggcaaaaggccaaggcagagtctgttcacaggcctctggcctggctgggggttttcggactgggaatatggcaggggcttttctggcacagtaagaagcctcgggcaggtggaaatgacctagagcttgggactgacttctcttcccagagtacatgaaccacctcaccgtgcacaacaaggaagtgctgtatgagctcattgagaaccgaggccctgccaccccccttatcaccgtctccaaccaccagtcttgcatggatgaccctcatctctggggtatggtgccagtgtgctgggttcagggaggcaaaacaagaacaggcccccaccaaagacagattgacttcccaccaggctcttttgaaaaactttaccttgtttgggggatatactgcctaactgctggaagttttgtgtgtcccccttaggattcctccagggaatgtgatttagacaggatatcagaaatttaaaaggagtgtggaagtagccatgtcacatcaaggactttactttttcacagggatcctaaaactccgccacatctggaacctgaagttgatgcgttggtgaggaggaatgggccccttgaagtgacccatccatttctgcccagatttgcctttctctgctcaggagttggcatccagccttccaggaagggcatgggtggggctccttagggccttctcttggagcttcattctgtatggcagtgatggcaggcattatattgggtggggagagttggggacaagcaatgggaagtcttggaggcagggatgattgggtctattgctgctctaggaccccagcagctgcagacatctgcttcaccaaggagctgcactcccatttcttcagcttgggcaaatgtgtgcctgtgtgtcgaggtgagctgctcctctgggaggcatgtccaggcctcccttggggacaaggaagctggtggtcaatgcgtctgtcttagaaggacttaggggagccatgatatggcagtatagttggcagagaataggaagagggatgatcacttagaatctctgcagtccaaaactctggtgtgagaattcaaggaagctgtatttgcagtcccttctgaatctaccactcctgtcagggagaacagtgtggtgttaccactttataatggcagtggggtacatgtatagaaggctaagggttttgtttttgggagaacaaacagtggtaagatgaggaggctcagattgaccactcagtacctttcacaaaccccttagtgtaggggccatcttgaccccattctctagatagggctcagattctctagacaaagcttagaagtccaaggtcatagactaccatgtggcaaacttaagattcagatccacattgccctttcatctgggtatgtagattccttttcaagcaaagaatgaaagaaagggtggtctaaaaataagagaagagaaggttagagaatgtcagaagggtagaagattgtatttccacctttctaagcattccagaagagactatattattttgttgaatgatatagtctcagtgccatttcctctcagatcctgctctgatatgtcagcattctgataatttacacctgtccctgactctaagctcctttactctgcaaactcaaaagtcttgtgtgtatgcatctgttttcattctttaaaaaaaaaaagattaattttatgtgtgagcaccctgttttcagacacaccagaagaggccatcagatcccattacagatggctgtgagccaccatgtggttgctggaaattggactcagactctttggaagagcctttgttcagtgctctgaactcctgagccatctctccagccctttcatttttttcttttttctttcgttttcagtttgagggatagaacacagaggcttgtatattttaggcatatactgtacctatggcctatacagatagttctgttcttcttgaactgattctagactttcttgcagttaaaagccgatctgagtggttggagaactatctcagtggttaagagcactgcctgctcttccaaaggaccagagttcaattcccatcagtcacatggcagctcatgcctgtaattcggttccaggggatcctacacccttacatagacatacatgcgggcaaaacataaaaattaaaaagaaaaaaggatctgagatgaacatggtgatatatgcctctaatcccatcccatcactcagtaagcaggggcataaggattgaggccagcctggtctatacagcaagttccagactgaccagaactataggactacatggtaatctttctctctttgttattgttgttgttgttttaaagacagtttgtctgtgtagtcttggctatcctggaactagctctatagaccagatgaggcaactcatcctccagtctcttccttccgagtgctgggattaagcctagcatgataccctatcttatcaaaaaaaaataataatatagaagctggtcatggtcgcacacaccttaatcccagcacttgggcagaggcaggtgaatctcttgagtttgaggctagtatggtctacagagctagttacaagattgccaagactacaaagaaaaatcctgtcttagaaaagaaagaaagaaaaaaagaaagagagaaagaagctagttattatgcctgtagtcccagtatttggtttgttaggttggggtaggtgaattaccatgagtttgaggccaactagaaaccaagaccctgtctcaaaaaaaaaaaattaaagttgtgtgtgtgcacatacatacagagaaactgagagctggaagtgtgacacagtggtatagtttttacttaactggcacagagccctgagtactatccccagcattgtaaaaatatagaacaaaaactagaagatggaacattattttcaaggaaagcaaagatctaattacatgtgactgaaacaaacagagtttgggatactttgtttctgtttttaaacaaaccatttttctctaagcctaggactttgtaggttcacctttaagcactgaagtgattttgtacaagtgcttgcagtagctaaaaagtatgccaaagatacgctatccttgctgggagtggtggtacacgcctttaatcctagcacttgggaggcaaaggcaggcagatttctgagttggaggccagcctggtctacagagtgagttccagggcagccagggctactcagagaaaccctgtctcaaaacacacacactcttttacttcacagtttcaagctcaaaggttatttttccaacagtggggtttactagaggagcaaacacctgtgatgaacacccctgctgtgtactaccatcccaagtagggcacctgtggctctctctgtttcctgagatcatcccaacttctggcccctaagtgagctgccagatcaggtccctgttgagggtgggctgagactttttttttctttggttttatgagacagggtttctctgtgtagtcctggctgtcctggaactcactctgtagaccaggctggcctcaaactcagaaatccacctgcctctgcctcccaagtgctgggattaaaggcatgtatcactattgcccggcctttttaagattttattttatgctctttccttcttttctttcttgaagcacatcatttctctctttctctttccctcccctacatccccttcccacatggtgacttacctggctttggtccttgggtctagtgaactagctcacctgagaacagcttcccaataaacctgtcttcagtaaaataaaaaataaaaattttattttgtatatgtttgtacactatagctttcttcagacacaccagaagagggcatcagatcctattacagatggttgtgagccaccatgtggttgctgggaattgaactcaggacctgtggaagagcagtcagtgttcttgaccactgagccatctctttaacccttgaaaggcaattctcaatgcactgacctgagatagccccagtgttgctctttgtcctccagcctcttcccttccactttctgattctgtccaccctgtggttattcttccactattgtatgtccaggtgactccaagttgctagcccacaagaggtgttaggtcacacttcttgaaatattaatcagttttcccaagttttccaatcttttctgtgttttctacttcctgaagtgttctcccttagcccagaaacctgagggaaggtggaagctctggagctgatttgtagtcagcaaatgggtgtgtgttaggggggcaggttccagcaaggcaggccgtagggcagagggaggttgagttgccatgattatcatttcagtgagagatactgtctagctaagtgtcttgatacatgcctgttatccagcaccattaaagctgaaacaagagaattactataactttgaggccaacctgggctatatagtaatatctgtcacaaaaaaagaatgtgctatttgcatttgacaggcactaagaagttgagggaatattgttttgttttgatacaggatcttactgtgttgcccatcctgacctcaagctcagagcaatcttcctacctcagcttcccaaatgctgagattacagacatgagccaccatttccatcttaagaggaagatatggtcaaaccaaaaatgtgaagggccagggtagcaaagagaaacaggctctagaaatagatgttgatgtgtctatggatggtgctatgggaaatgaactgctgcctccatcctaaagtggatagaccaggagtgagccagaatctacttcactagggtttggagagtttgatttcttctccagagaatggattaaggagaacagacctttctctacaggagatggtgtctaccagaaagggatggacttcattttggagaagcttaaccatggggactgggtgcacatcttcccagaaggtcagttgggtgcttgatcagggccctccagcattcatggttctaggcccaagctttttctctgtgttctctcattagggaaagtaaacatgagttctgagttcctgcgcttcaaatggggtaagtattgctggccagcctgacacagctaacttccccatccaaagatggccccttgggtccttggcttcgttcctctctcaggtgggtgtgtcaggagcagtagaaaagggacaggcggtgagtcaaggactaagttccattgagagactgtagaagtgacattggccagacgttggcagggaagtttggcccagcttgtgccaatgctttggcatttctccgaagtaggaattggacggctgattgctgagtgtcatctgaatcccatcatcctgccactgtggcatgttggtgagtcatggattgggggtagggaggggactgtcttagatgtcgttaagggggatttcaggttgttgggtagctgagagaagtacctgggattctctctggtaccctgcttctcccaatggctggctttctatccactgtggtacaggaatgaatgatgtcctccctaacagcccaccctacttcccccgctttggacaggtgggtaggcactgctgactcttgtctatctatttccctgctaactgccctgtgtttccttgtccatactatacaggattggttgaagatttgctgagcatgagcatgtagtaggggagctaagtggggcttttctggaagcaagacctttagaaaaagaattgaaatcaggcgggggtgagggacaaggtagagtgggacaaattattgataggatattgactagactggcccttggataccatcaagcccaattgcctgttttgaagagggagagtggctttcaggaacgtcaagcccatcaggtacagagcatagctctgaatccccgcattgtttgggctggaactataggttccttgtcacccttgatggcctgccttcttacagaaaatcaccgtgctgattgggaagcccttcagtacactccctgtgcttgagcggctccgggcagagaacaagtcagctgtgagtttcctcccagggtcccctagctgtccttggccttctcagtccctcagactcccagggtaccccagacatggtccttgaggaatgcaggccagaaccatccttgctcttaggtggagatgcggaaagccctcacagacttcattcaagaggaattccagcggctgaagatgcaggcagaacagctccacaatcatttccagcctggaagataggctttgcctgcccagtctgtgccctgcagttcttagccaaaggaacactgggtccttcaggatttgggaagtggtggtacaggaacctgaccaagcttgcttggctctttactgcttttgagattcttccctgtacaaaactgaggctgggaaatggactgatgcttttaattcagatagattggctcccaattcctgctggatacccttttttattcttgaacatctgactcctctgggtcttgagctaaaagaagagccttggctgtcccttatacttggtggagaaggaagggacactcttaggcaggggcccccttctcacctctcagggagggaacagagcaggtagtcaagcaaatagttgggtaggagaacaggtttcttggtcataggtacagaaagaagactcaattggtcccttggatgggctactacttgcccactgctcacaaacctcatcagggatagctgtcagccaggtcattctacctgagctactgctacaaggtttgtccttgggtggcctgtagacaagaagagaaggtattggccaggattcaagcacagctaaacttaactagatgtttcttgtatatagcagaagaaggacccccaagacctgaccattaacccccagtgtcagggcctacctgcttctctaatcttttttgccttgtcatcctctatatcctgggatctgggttttaatgtttttagagtaataaaacatttgtgttgtgccaccata

SEQ ID NO: 75 - DNA, 5286 bp, mus musculus
gattcgtcgagtgaggccgtcaagacttggtttctagtgcgcattgctttgtacagcagtcccgtctcgtcgcctgagcagcggctcttctctatccagagaacagtgctagggaggtgctgagctgttccaccaggtgaccttagtctagtcctctgccagtctgttggagatccttctcctgagtggtagaggacatcggctggcctggggcaagaggaactctgggctccgggggcggggccggagccggaggagatgcccctccatgtgaagtggccattccccgcggtgccccggctcacctggactctagccagcagcgtcgtcatgggcctagttggcacctacagctgcttctggaccagtgagtggcaaaaggccaaggcagagtctgttcacaggcctctggcctggctgggggttttcggactgggaatatggcaggggcttttctggcacagtaagaagcctcgggcaggtggaaatgacctagagcttgggactgacttctcttcccagagtacatgaaccacctcaccgtgcacaacaaggaagtgctgtatgagctcattgagaaccgaggccctgccaccccccttatcaccgtctccaaccaccagtcttgcatggatgaccctcatctctggggtatggtgccagtgtgctgggttcagggaggcaaaacaagaacaggcccccaccaaagacagattgacttcccaccaggctcttttgaaaaactttaccttgtttgggggatatactgcctaactgctggaagttttgtgtgtcccccttaggattcctccagggaatgtgatttagacaggatatcagaaatttaaaaggagtgtggaagtagccatgtcacatcaaggactttactttttcacagggatcctaaaactccgccacatctggaacctgaagttgatgcgttggtgaggaggaatgggccccttgaagtgacccatccatttctgcccagatttgcctttctctgctcaggagttggcatccagccttccaggaagggcatgggtggggctccttagggccttctcttggagcttcattctgtatggcagtgatggcaggcattatattgggtggggagagttggggacaagcaatgggaagtcttggaggcagggatgattgggtctattgctgctctaggaccccagcagctgcagacatctgcttcaccaaggagctgcactcccatttcttcagcttgggcaaatgtgtgcctgtgtgtcgaggtgagctgctcctctgggaggcatgtccaggcctcccttggggacaaggaagctggtggtcaatgcgtctgtcttagaaggacttaggggagccatgatatggcagtatagttggcagagaataggaagagggatgatcacttagaatctctgcagtccaaaactctggtgtgagaattcaaggaagctgtatttgcagtcccttctgaatctaccactcctgtcagggagaacagtgtggtgttaccactttataatggcagtggggtacatgtatagaaggctaagggttttgtttttgggagaacaaacagtggtaagatgaggaggctcagattgaccactcagtacctttcacaaaccccttagtgtaggggccatcttgaccccattctctagatagggctcagattctctagacaaagcttagaagtccaaggtcatagactaccatgtggcaaacttaagattcagatccacattgccctttcatctgggtatgtagattccttttcaagcaaagaatgaaagaaagggtggtctaaaaataagagaagagaaggttagagaatgtcagaagggtagaagattgtatttccacctttctaagcattccagaagagactatattattttgttgaatgatatagtctcagtgccatttcctctcagatcctgctctgatatgtcagcattctgataatttacacctgtccctgactctaagctcctttactctgcaaactcaaaagtcttgtgtgtatgcatctgttttcattctttaaaaaaaaaaagattaattttatgtgtgagcaccctgttttcagacacaccagaagaggccatcagatcccattacagatggctgtgagccaccatgtggttgctggaaattggactcagactctttggaagagcctttgttcagtgctctgaactcctgagccatctctccagccctttcatttttttcttttttctttcgttttcagtttgagggatagaacacagaggcttgtatattttaggcatatactgtacctatggcctatacagatagttctgttcttcttgaactgattctagactttcttgcagttaaaagccgatctgagtggttggagaactatctcagtggttaagagcactgcctgctcttccaaaggaccagagttcaattcccatcagtcacatggcagctcatgcctgtaattcggttccaggggatcctacacccttacatagacatacatgcgggcaaaacataaaaattaaaaagaaaaaaggatctgagatgaacatggtgatatatgcctctaatcccatcccatcactcagtaagcaggggcataaggattgaggccagcctggtctatacagcaagttccagactgaccagaactataggactacatggtaatctttctctctttgttattgttgttgttgttttaaagacagtttgtctgtgtagtcttggctatcctggaactagctctatagaccagatgaggcaactcatcctccagtctcttccttccgagtgctgggattaagcctagcatgataccctatcttatcaaaaaaaaataataatatagaagctggtcatggtcgcacacaccttaatcccagcacttgggcagaggcaggtgaatctcttgagtttgaggctagtatggtctacagagctagttacaagattgccaagactacaaagaaaaatcctgtcttagaaaagaaagaaagaaaaaaagaaagagagaaagaagctagttattatgcctgtagtcccagtatttggtttgttaggttggggtaggtgaattaccatgagtttgaggccaactagaaaccaagaccctgtctcaaaaaaaaaaaattaaagttgtgtgtgtgcacatacatacagagaaactgagagctggaagtgtgacacagtggtatagtttttacttaactggcacagagccctgagtactatccccagcattgtaaaaatatagaacaaaaactagaagatggaacattattttcaaggaaagcaaagatctaattacatgtgactgaaacaaacagagtttgggatactttgtttctgtttttaaacaaaccatttttctctaagcctaggactttgtaggttcacctttaagcactgaagtgattttgtacaagtgcttgcagtagctaaaaagtatgccaaagatacgctatccttgctgggagtggtggtacacgcctttaatcctagcacttgggaggcaaaggcaggcagatttctgagttggaggccagcctggtctacagagtgagttccagggcagccagggctactcagagaaaccctgtctcaaaacacacacactcttttacttcacagtttcaagctcaaaggttatttttccaacagtggggtttactagaggagcaaacacctgtgatgaacacccctgctgtgtactaccatcccaagtagggcacctgtggctctctctgtttcctgagatcatcccaacttctggcccctaagtgagctgccagatcaggtccctgttgagggtgggctgagactttttttttctttggttttatgagacagggtttctctgtgtagtcctggctgtcctggaactcactctgtagaccaggctggcctcaaactcagaaatccacctgcctctgcctcccaagtgctgggattaaaggcatgtatcactattgcccggcctttttaagattttattttatgctctttccttcttttctttcttgaagcacatcatttctctctttctctttccctcccctacatccccttcccacatggtgacttacctggctttggtccttgggtctagtgaactagctcacctgagaacagcttcccaataaacctgtcttcagtaaaataaaaaataaaaattttattttgtatatgtttgtacactatagctttcttcagacacaccagaagagggcatcagatcctattacagatggttgtgagccaccatgtggttgctgggaattgaactcaggacctgtggaagagcagtcagtgttcttgaccactgagccatctctttaacccttgaaaggcaattctcaatgcactgacctgagatagccccagtgttgctctttgtcctccagcctcttcccttccactttctgattctgtccaccctgtggttattcttccactattgtatgtccaggtgactccaagttgctagcccacaagaggtgttaggtcacacttcttgaaatattaatcagttttcccaagttttccaatcttttctgtgttttctacttcctgaagtgttctcccttagcccagaaacctgagggaaggtggaagctctggagctgatttgtagtcagcaaatgggtgtgtgttaggggggcaggttccagcaaggcaggccgtagggcagagggaggttgagttgccatgattatcatttcagtgagagatactgtctagctaagtgtcttgatacatgcctgttatccagcaccattaaagctgaaacaagagaattactataactttgaggccaacctgggctatatagtaatatctgtcacaaaaaaagaatgtgctatttgcatttgacaggcactaagaagttgagggaatattgttttgttttgatacaggatcttactgtgttgcccatcctgacctcaagctcagagcaatcttcctacctcagcttcccaaatgctgagattacagacatgagccaccatttccatcttaagaggaagatatggtcaaaccaaaaatgtgaagggccagggtagcaaagagaaacaggctctagaaatagatgttgatgtgtctatggatggtgctatgggaaatgaactgctgcctccatcctaaagtggatagaccaggagtgagccagaatctacttcactagggtttggagagtttgatttcttctccagagaatggattaaggagaacagacctttctctacaggagatggtgtctaccag

SEQ ID NO: 76 - DNA, 7399 bp, mus musculus
gattcgtcgagtgaggccgtcaagacttggtttctagtgcgcattgctttgtacagcagtcccgtctcgtcgcctgagcagcggctcttctctatccagagaacagtgctagggaggtgctgagctgttccaccaggtgaccttagtctagtcctctgccagtctgttggagatccttctcctgagtggtagaggacatcggctggcctggggcaagaggaactctgggctccgggggcggggccggagccggaggagatgcccctccatgtgaagtggccattccccgcggtgccccggctcacctggactctagccagcagcgtcgtcatgggcctagttggcacctacagctgcttctggaccagtgagtggcaaaaggccaaggcagagtctgttcacaggcctctggcctggctgggggttttcggactgggaatatggcaggggcttttctggcacagtaagaagcctcgggcaggtggaaatgacctagagcttgggactgacttctcttcccagagtacatgaaccacctcaccgtgcacaacaaggaagtgctgtatgagctcattgagaaccgaggccctgccaccccccttatcaccgtctccaaccaccagtcttgcatggatgaccctcatctctggggtatggtgccagtgtgctgggttcagggaggcaaaacaagaacaggcccccaccaaagacagattgacttcccaccaggctcttttgaaaaactttaccttgtttgggggatatactgcctaactgctggaagttttgtgtgtcccccttaggattcctccagggaatgtgatttagacaggatatcagaaatttaaaaggagtgtggaagtagccatgtcacatcaaggactttactttttcacagggatcctaaaactccgccacatctggaacctgaagttgatgcgttggtgaggaggaatgggccccttgaagtgacccatccatttctgcccagatttgcctttctctgctcaggagttggcatccagccttccaggaagggcatgggtggggctccttagggccttctcttggagcttcattctgtatggcagtgatggcaggcattatattgggtggggagagttggggacaagcaatgggaagtcttggaggcagggatgattgggtctattgctgctctaggaccccagcagctgcagacatctgcttcaccaaggagctgcactcccatttcttcagcttgggcaaatgtgtgcctgtgtgtcgaggtgagctgctcctctgggaggcatgtccaggcctcccttggggacaaggaagctggtggtcaatgcgtctgtcttagaaggacttaggggagccatgatatggcagtatagttggcagagaataggaagagggatgatcacttagaatctctgcagtccaaaactctggtgtgagaattcaaggaagctgtatttgcagtcccttctgaatctaccactcctgtcagggagaacagtgtggtgttaccactttataatggcagtggggtacatgtatagaaggctaagggttttgtttttgggagaacaaacagtggtaagatgaggaggctcagattgaccactcagtacctttcacaaaccccttagtgtaggggccatcttgaccccattctctagatagggctcagattctctagacaaagcttagaagtccaaggtcatagactaccatgtggcaaacttaagattcagatccacattgccctttcatctgggtatgtagattccttttcaagcaaagaatgaaagaaagggtggtctaaaaataagagaagagaaggttagagaatgtcagaagggtagaagattgtatttccacctttctaagcattccagaagagactatattattttgttgaatgatatagtctcagtgccatttcctctcagatcctgctctgatatgtcagcattctgataatttacacctgtccctgactctaagctcctttactctgcaaactcaaaagtcttgtgtgtatgcatctgttttcattctttaaaaaaaaaaagattaattttatgtgtgagcaccctgttttcagacacaccagaagaggccatcagatcccattacagatggctgtgagccaccatgtggttgctggaaattggactcagactctttggaagagcctttgttcagtgctctgaactcctgagccatctctccagccctttcatttttttcttttttctttcgttttcagtttgagggatagaacacagaggcttgtatattttaggcatatactgtacctatggcctatacagatagttctgttcttcttgaactgattctagactttcttgcagttaaaagccgatctgagtggttggagaactatctcagtggttaagagcactgcctgctcttccaaaggaccagagttcaattcccatcagtcacatggcagctcatgcctgtaattcggttccaggggatcctacacccttacatagacatacatgcgggcaaaacataaaaattaaaaagaaaaaaggatctgagatgaacatggtgatatatgcctctaatcccatcccatcactcagtaagcaggggcataaggattgaggccagcctggtctatacagcaagttccagactgaccagaactataggactacatggtaatctttctctctttgttattgttgttgttgttttaaagacagtttgtctgtgtagtcttggctatcctggaactagctctatagaccagatgaggcaactcatcctccagtctcttccttccgagtgctgggattaagcctagcatgataccctatcttatcaaaaaaaaataataatatagaagctggtcatggtcgcacacaccttaatcccagcacttgggcagaggcaggtgaatctcttgagtttgaggctagtatggtctacagagctagttacaagattgccaagactacaaagaaaaatcctgtcttagaaaagaaagaaagaaaaaaagaaagagagaaagaagctagttattatgcctgtagtcccagtatttggtttgttaggttggggtaggtgaattaccatgagtttgaggccaactagaaaccaagaccctgtctcaaaaaaaaaaaattaaagttgtgtgtgtgcacatacatacagagaaactgagagctggaagtgtgacacagtggtatagtttttacttaactggcacagagccctgagtactatccccagcattgtaaaaatatagaacaaaaactagaagatggaacattattttcaaggaaagcaaagatctaattacatgtgactgaaacaaacagagtttgggatactttgtttctgtttttaaacaaaccatttttctctaagcctaggactttgtaggttcacctttaagcactgaagtgattttgtacaagtgcttgcagtagctaaaaagtatgccaaagatacgctatccttgctgggagtggtggtacacgcctttaatcctagcacttgggaggcaaaggcaggcagatttctgagttggaggccagcctggtctacagagtgagttccagggcagccagggctactcagagaaaccctgtctcaaaacacacacactcttttacttcacagtttcaagctcaaaggttatttttccaacagtggggtttactagaggagcaaacacctgtgatgaacacccctgctgtgtactaccatcccaagtagggcacctgtggctctctctgtttcctgagatcatcccaacttctggcccctaagtgagctgccagatcaggtccctgttgagggtgggctgagactttttttttctttggttttatgagacagggtttctctgtgtagtcctggctgtcctggaactcactctgtagaccaggctggcctcaaactcagaaatccacctgcctctgcctcccaagtgctgggattaaaggcatgtatcactattgcccggcctttttaagattttattttatgctctttccttcttttctttcttgaagcacatcatttctctctttctctttccctcccctacatccccttcccacatggtgacttacctggctttggtccttgggtctagtgaactagctcacctgagaacagcttcccaataaacctgtcttcagtaaaataaaaaataaaaattttattttgtatatgtttgtacactatagctttcttcagacacaccagaagagggcatcagatcctattacagatggttgtgagccaccatgtggttgctgggaattgaactcaggacctgtggaagagcagtcagtgttcttgaccactgagccatctctttaacccttgaaaggcaattctcaatgcactgacctgagatagccccagtgttgctctttgtcctccagcctcttcccttccactttctgattctgtccaccctgtggttattcttccactattgtatgtccaggtgactccaagttgctagcccacaagaggtgttaggtcacacttcttgaaatattaatcagttttcccaagttttccaatcttttctgtgttttctacttcctgaagtgttctcccttagcccagaaacctgagggaaggtggaagctctggagctgatttgtagtcagcaaatgggtgtgtgttaggggggcaggttccagcaaggcaggccgtagggcagagggaggttgagttgccatgattatcatttcagtgagagatactgtctagctaagtgtcttgatacatgcctgttatccagcaccattaaagctgaaacaagagaattactataactttgaggccaacctgggctatatagtaatatctgtcacaaaaaaagaatgtgctatttgcatttgacaggcactaagaagttgagggaatattgttttgttttgatacaggatcttactgtgttgcccatcctgacctcaagctcagagcaatcttcctacctcagcttcccaaatgctgagattacagacatgagccaccatttccatcttaagaggaagatatggtcaaaccaaaaatgtgaagggccagggtagcaaagagaaacaggctctagaaatagatgttgatgtgtctatggatggtgctatgggaaatgaactgctgcctccatcctaaagtggatagaccaggagtgagccagaatctacttcactagggtttggagagtttgatttcttctccagagaatggattaaggagaacagacctttctctacaggagatggtgtctaccagaaagggatggacttcattttggagaagcttaaccatggggactgggtgcacatcttcccagaaggtcagttgggtgcttgatcagggccctccagcattcatggttctaggcccaagctttttctctgtgttctctcattagggaaagtaaacatgagttctgagttcctgcgcttcaaatggggtaagtattgctggccagcctgacacagctaacttccccatccaaagatggccccttgggtccttggcttcgttcctctctcaggtgggtgtgtcaggagcagtagaaaagggacaggcggtgagtcaaggactaagttccattgagagactgtagaagtgacattggccagacgttggcagggaagtttggcccagcttgtgccaatgctttggcatttctccgaagtaggaattggacggctgattgctgagtgtcatctgaatcccatcatcctgccactgtggcatgttggtgagtcatggattgggggtagggaggggactgtcttagatgtcgttaagggggatttcaggttgttgggtagctgagagaagtacctgggattctctctggtaccctgcttctcccaatggctggctttctatccactgtggtacaggaatgaatgatgtcctccctaacagcccaccctacttcccccgctttggacaggtgggtaggcactgctgactcttgtctatctatttccctgctaactgccctgtgtttccttgtccatactatacaggattggttgaagatttgctgagcatgagcatgtagtaggggagctaagtggggcttttctggaagcaagacctttagaaaaagaattgaaatcaggcgggggtgagggacaaggtagagtgggacaaattattgataggatattgactagactggcccttggataccatcaagcccaattgcctgttttgaagagggagagtggctttcaggaacgtcaagcccatcaggtacagagcatagctctgaatccccgcattgtttgggctggaactataggttccttgtcacccttgatggcctgccttcttacagaaaatcaccgtgctgattgggaagcccttcagtacactccctgtgcttgagcggctccgggcagagaacaagtcagctgtgagtttcctcccagggtcccctagctgtccttggccttctcagtccctcagactcccagggtaccccagacatggtccttgaggaatgcaggccagaaccatccttgctcttaggtggagatgcggaaagccctcacagacttcattcaagaggaattccagcggctgaagatgcaggcagaacagctccacaatcatttccagcctggaagataggctttgcctgcccagtctgtgccctgcagttcttagccaaaggaacactgggtccttcaggatttgggaagtggtggtacaggaacctgaccaagcttgcttggctctttactgcttttgagattcttccctgtacaaaactgaggctgggaaatggactgatgcttttaattcagatagattggctcccaattcctgctggatacccttttttattcttgaacatctgactcctctgggtcttgagctaaaagaagagccttggctgtcccttatacttggtggagaaggaagggacactcttaggcaggggcccccttctcacctctcagggagggaacagagcaggtagtcaagcaaatagttgggtaggagaacaggtttcttggtcataggtacagaaagaagactcaattggtcccttggatgggctactacttgcccactgctcacaaacctcatcagggatagctgtcagccaggtcattctacctgagctactgctacaaggtttgtccttgggtggcctgtagacaagaagagaaggtattggccaggattcaagcacagctaaacttaactagatgtttcttgtatatagcagaagaaggacccccaagacctgaccattaacccccagtgtcagggcctacctgcttctctaatcttttttgccttgtcatcctctatatcctgggatctgggttttaatgtttttagagtaataaaacatttgtgttgtgccacc

SEQ ID NO: 77 - DNA, 7399 bp, mus musculus
attcgtcgagtgaggccgtcaagacttggtttctagtgcgcattgctttgtacagcagtcccgtctcgtcgcctgagcagcggctcttctctatccagagaacagtgctagggaggtgctgagctgttccaccaggtgaccttagtctagtcctctgccagtctgttggagatccttctcctgagtggtagaggacatcggctggcctggggcaagaggaactctgggctccgggggcggggccggagccggaggagatgcccctccatgtgaagtggccattccccgcggtgccccggctcacctggactctagccagcagcgtcgtcatgggcctagttggcacctacagctgcttctggaccagtgagtggcaaaaggccaaggcagagtctgttcacaggcctctggcctggctgggggttttcggactgggaatatggcaggggcttttctggcacagtaagaagcctcgggcaggtggaaatgacctagagcttgggactgacttctcttcccagagtacatgaaccacctcaccgtgcacaacaaggaagtgctgtatgagctcattgagaaccgaggccctgccaccccccttatcaccgtctccaaccaccagtcttgcatggatgaccctcatctctggggtatggtgccagtgtgctgggttcagggaggcaaaacaagaacaggcccccaccaaagacagattgacttcccaccaggctcttttgaaaaactttaccttgtttgggggatatactgcctaactgctggaagttttgtgtgtcccccttaggattcctccagggaatgtgatttagacaggatatcagaaatttaaaaggagtgtggaagtagccatgtcacatcaaggactttactttttcacagggatcctaaaactccgccacatctggaacctgaagttgatgcgttggtgaggaggaatgggccccttgaagtgacccatccatttctgcccagatttgcctttctctgctcaggagttggcatccagccttccaggaagggcatgggtggggctccttagggccttctcttggagcttcattctgtatggcagtgatggcaggcattatattgggtggggagagttggggacaagcaatgggaagtcttggaggcagggatgattgggtctattgctgctctaggaccccagcagctgcagacatctgcttcaccaaggagctgcactcccatttcttcagcttgggcaaatgtgtgcctgtgtgtcgaggtgagctgctcctctgggaggcatgtccaggcctcccttggggacaaggaagctggtggtcaatgcgtctgtcttagaaggacttaggggagccatgatatggcagtatagttggcagagaataggaagagggatgatcacttagaatctctgcagtccaaaactctggtgtgagaattcaaggaagctgtatttgcagtcccttctgaatctaccactcctgtcagggagaacagtgtggtgttaccactttataatggcagtggggtacatgtatagaaggctaagggttttgtttttgggagaacaaacagtggtaagatgaggaggctcagattgaccactcagtacctttcacaaaccccttagtgtaggggccatcttgaccccattctctagatagggctcagattctctagacaaagcttagaagtccaaggtcatagactaccatgtggcaaacttaagattcagatccacattgccctttcatctgggtatgtagattccttttcaagcaaagaatgaaagaaagggtggtctaaaaataagagaagagaaggttagagaatgtcagaagggtagaagattgtatttccacctttctaagcattccagaagagactatattattttgttgaatgatatagtctcagtgccatttcctctcagatcctgctctgatatgtcagcattctgataatttacacctgtccctgactctaagctcctttactctgcaaactcaaaagtcttgtgtgtatgcatctgttttcattctttaaaaaaaaaaagattaattttatgtgtgagcaccctgttttcagacacaccagaagaggccatcagatcccattacagatggctgtgagccaccatgtggttgctggaaattggactcagactctttggaagagcctttgttcagtgctctgaactcctgagccatctctccagccctttcatttttttcttttttctttcgttttcagtttgagggatagaacacagaggcttgtatattttaggcatatactgtacctatggcctatacagatagttctgttcttcttgaactgattctagactttcttgcagttaaaagccgatctgagtggttggagaactatctcagtggttaagagcactgcctgctcttccaaaggaccagagttcaattcccatcagtcacatggcagctcatgcctgtaattcggttccaggggatcctacacccttacatagacatacatgcgggcaaaacataaaaattaaaaagaaaaaaggatctgagatgaacatggtgatatatgcctctaatcccatcccatcactcagtaagcaggggcataaggattgaggccagcctggtctatacagcaagttccagactgaccagaactataggactacatggtaatctttctctctttgttattgttgttgttgttttaaagacagtttgtctgtgtagtcttggctatcctggaactagctctatagaccagatgaggcaactcatcctccagtctcttccttccgagtgctgggattaagcctagcatgataccctatcttatcaaaaaaaaataataatatagaagctggtcatggtcgcacacaccttaatcccagcacttgggcagaggcaggtgaatctcttgagtttgaggctagtatggtctacagagctagttacaagattgccaagactacaaagaaaaatcctgtcttagaaaagaaagaaagaaaaaaagaaagagagaaagaagctagttattatgcctgtagtcccagtatttggtttgttaggttggggtaggtgaattaccatgagtttgaggccaactagaaaccaagaccctgtctcaaaaaaaaaaaattaaagttgtgtgtgtgcacatacatacagagaaactgagagctggaagtgtgacacagtggtatagtttttacttaactggcacagagccctgagtactatccccagcattgtaaaaatatagaacaaaaactagaagatggaacattattttcaaggaaagcaaagatctaattacatgtgactgaaacaaacagagtttgggatactttgtttctgtttttaaacaaaccatttttctctaagcctaggactttgtaggttcacctttaagcactgaagtgattttgtacaagtgcttgcagtagctaaaaagtatgccaaagatacgctatccttgctgggagtggtggtacacgcctttaatcctagcacttgggaggcaaaggcaggcagatttctgagttggaggccagcctggtctacagagtgagttccagggcagccagggctactcagagaaaccctgtctcaaaacacacacactcttttacttcacagtttcaagctcaaaggttatttttccaacagtggggtttactagaggagcaaacacctgtgatgaacacccctgctgtgtactaccatcccaagtagggcacctgtggctctctctgtttcctgagatcatcccaacttctggcccctaagtgagctgccagatcaggtccctgttgagggtgggctgagactttttttttctttggttttatgagacagggtttctctgtgtagtcctggctgtcctggaactcactctgtagaccaggctggcctcaaactcagaaatccacctgcctctgcctcccaagtgctgggattaaaggcatgtatcactattgcccggcctttttaagattttattttatgctctttccttcttttctttcttgaagcacatcatttctctctttctctttccctcccctacatccccttcccacatggtgacttacctggctttggtccttgggtctagtgaactagctcacctgagaacagcttcccaataaacctgtcttcagtaaaataaaaaataaaaattttattttgtatatgtttgtacactatagctttcttcagacacaccagaagagggcatcagatcctattacagatggttgtgagccaccatgtggttgctgggaattgaactcaggacctgtggaagagcagtcagtgttcttgaccactgagccatctctttaacccttgaaaggcaattctcaatgcactgacctgagatagccccagtgttgctctttgtcctccagcctcttcccttccactttctgattctgtccaccctgtggttattcttccactattgtatgtccaggtgactccaagttgctagcccacaagaggtgttaggtcacacttcttgaaatattaatcagttttcccaagttttccaatcttttctgtgttttctacttcctgaagtgttctcccttagcccagaaacctgagggaaggtggaagctctggagctgatttgtagtcagcaaatgggtgtgtgttaggggggcaggttccagcaaggcaggccgtagggcagagggaggttgagttgccatgattatcatttcagtgagagatactgtctagctaagtgtcttgatacatgcctgttatccagcaccattaaagctgaaacaagagaattactataactttgaggccaacctgggctatatagtaatatctgtcacaaaaaaagaatgtgctatttgcatttgacaggcactaagaagttgagggaatattgttttgttttgatacaggatcttactgtgttgcccatcctgacctcaagctcagagcaatcttcctacctcagcttcccaaatgctgagattacagacatgagccaccatttccatcttaagaggaagatatggtcaaaccaaaaatgtgaagggccagggtagcaaagagaaacaggctctagaaatagatgttgatgtgtctatggatggtgctatgggaaatgaactgctgcctccatcctaaagtggatagaccaggagtgagccagaatctacttcactagggtttggagagtttgatttcttctccagagaatggattaaggagaacagacctttctctacaggagatggtgtctaccagaaagggatggacttcattttggagaagcttaaccatggggactgggtgcacatcttcccagaaggtcagttgggtgcttgatcagggccctccagcattcatggttctaggcccaagctttttctctgtgttctctcattagggaaagtaaacatgagttctgagttcctgcgcttcaaatggggtaagtattgctggccagcctgacacagctaacttccccatccaaagatggccccttgggtccttggcttcgttcctctctcaggtgggtgtgtcaggagcagtagaaaagggacaggcggtgagtcaaggactaagttccattgagagactgtagaagtgacattggccagacgttggcagggaagtttggcccagcttgtgccaatgctttggcatttctccgaagtaggaattggacggctgattgctgagtgtcatctgaatcccatcatcctgccactgtggcatgttggtgagtcatggattgggggtagggaggggactgtcttagatgtcgttaagggggatttcaggttgttgggtagctgagagaagtacctgggattctctctggtaccctgcttctcccaatggctggctttctatccactgtggtacaggaatgaatgatgtcctccctaacagcccaccctacttcccccgctttggacaggtgggtaggcactgctgactcttgtctatctatttccctgctaactgccctgtgtttccttgtccatactatacaggattggttgaagatttgctgagcatgagcatgtagtaggggagctaagtggggcttttctggaagcaagacctttagaaaaagaattgaaatcaggcgggggtgagggacaaggtagagtgggacaaattattgataggatattgactagactggcccttggataccatcaagcccaattgcctgttttgaagagggagagtggctttcaggaacgtcaagcccatcaggtacagagcatagctctgaatccccgcattgtttgggctggaactataggttccttgtcacccttgatggcctgccttcttacagaaaatcaccgtgctgattgggaagcccttcagtacactccctgtgcttgagcggctccgggcagagaacaagtcagctgtgagtttcctcccagggtcccctagctgtccttggccttctcagtccctcagactcccagggtaccccagacatggtccttgaggaatgcaggccagaaccatccttgctcttaggtggagatgcggaaagccctcacagacttcattcaagaggaattccagcggctgaagatgcaggcagaacagctccacaatcatttccagcctggaagataggctttgcctgcccagtctgtgccctgcagttcttagccaaaggaacactgggtccttcaggatttgggaagtggtggtacaggaacctgaccaagcttgcttggctctttactgcttttgagattcttccctgtacaaaactgaggctgggaaatggactgatgcttttaattcagatagattggctcccaattcctgctggatacccttttttattcttgaacatctgactcctctgggtcttgagctaaaagaagagccttggctgtcccttatacttggtggagaaggaagggacactcttaggcaggggcccccttctcacctctcagggagggaacagagcaggtagtcaagcaaatagttgggtaggagaacaggtttcttggtcataggtacagaaagaagactcaattggtcccttggatgggctactacttgcccactgctcacaaacctcatcagggatagctgtcagccaggtcattctacctgagctactgctacaaggtttgtccttgggtggcctgtagacaagaagagaaggtattggccaggattcaagcacagctaaacttaactagatgtttcttgtatatagcagaagaaggacccccaagacctgaccattaacccccagtgtcagggcctacctgcttctctaatcttttttgccttgtcatcctctatatcctgggatctgggttttaatgtttttagagtaataaaacatttgtgttgtgccacca

SEQ ID NO: 78 - DNA, 3304 bp, mus musculus
gcggggcggggcgcgcgcggctcccgcgcaaggatctttcggaggactcagcacctgctgccggcctgccccgccccgtatttttctgggctcacgaagagccccgataacccctgcagtcattctggtgctgggacccaggtgacagaagccctcccagaaaacaagcaaggaaatgatgactggttgggcggggcggggccagcggagagagagagggactcattaacgctgcgtagggatcaggagacaaccgacagacgccatctttggttcagtgcggcggcagtgacagaagcagcggcaggggcagcagcagcagcggcagtagcagcagtagcaatagtagaggtagtggtagcggctgctgtggtgaaggaggaggagcagagcggacgctggtaccaaggcctgatcatggatgaggaatacgatgtgattgtgctggggacaggtcttaccgtaagtgccacttcaggctctcatagccctgcatcatgccatccctccccaccccacgccatccctccccaccccactccatcccgcattgatgcagagtccggtatccgatccatcctcccatcatcctagctccagccctgggaaaaccaaccccatgcccaacccactacctcaccctaggatgtcgattccagttcccaattctctgtagagggccccactttgtcctgtgttcctgcactctagtacttaacctcagacccctattcttccctatctctatcaccgaggtggaaaactcacccccccacacacacagtggaaccattgcacccagcccccaccctttgcctgaactcatcacctgctccaaggccttgattagcatcccttaccatcttgtgatcaaactaggggatggaatatgaagatgggtatggggacattacaagggtgggccctcatcatgcttttctgctttttgggatgggataggaaacccatggaatgttccagagacagcaggagtgtgtgtgtggggggtgtggggggggggtagtgaccactttacctctgccccaacttggtttcccatggagatctcagactgaatatatatcctcagcctttgtccttgggttagtgactgactggtgagggtgtttgtctcttccctgcccccgccccccccaacccccacccccggcctaaatctttttagtttgaaccctgagtctagaccagtggatagggccagaagagagtcaggggctcctgccctttgaaggaggagcagggtggggcctgggatttcaaggacttggccttctctttcaaaggtcctttgaattggttcttcttgtagactcattgtctttttgtgggctcagagaagtagatacttctcttggcttgttgatgctggaagacttggaagctgaaagctctgccccccaaacctcctttaatgctccagtagtttactcagcagggttgtaaaggaaacatcatatgaagccatcttctcctccccagttttaggcactgaaaagagctgcattataaaattggtggtgggcatgaagcaagttggagggttatggggtatagctgcaaatgtcactccttccccaggaatgcatcctgtctggcatcatgtctgtgaatggaaagaaggtgctgcacatggaccgaaacccctactatgggggtgagagctcttccatcacacccctggaggaggtaagatttcttattcttagacctgggcttagacccagatccttgttagtcttccacataggtataagggggcgaagtaattctcaggtactgggcaggagagtgggaaagggcgacaggtccttgacatttttctttctttcctgtcctgcttacagctatataagcgctttcagatactggaagggccccctgaatcaatgggccggggccgagactggaatgttgacttgatccccaaattcctcatggccaatggtgagagagattaaaaagatgctgtatatggttttgggggtggtgagtgggaagacggagtggggagagattggtcaatctcaagaatatggtcagtcagactactgagagtttttgaaggaaaacacaacaatgtcccttatttcctctggacacaggtcagctggtaaagatgctactatatacagaagtgactcgatatctggacttcaaggtggtagagggcagctttgtatataaggggggcaagatctacaaagtgccatccaccgagactgaggccttggcttctagtgagtatgagtctccttaaccagagaataatggggctggatgagacagactattttcaggacagttaggcaaaaggctcatctttgcctgaaactaatcttagctctgtgtagtcctagaggacccttactttatagtgtattgattggacagtgctacccatcctggcaagttgccagaaagttcacagaacaggattcctttttgtcagagggcctacttgccctgtagcatccctacgtggaactagaagggtttcttcctacaaaaagaaaattgagatcaagaagggtggggtagtgttacatgatagagtattggtgggagccaatactctacattacatacaaccagctttcttggcctgctctggtggaaagaggagttctatgtcccagtaatgctaagggtcttctcaatacctttctttcagatctgatgggcatgtttgaaaaacgacgcttccgaaaatttttggtgtttgtggcaaactttgatgagaatgaccccaaaacctttgagggtgttgatccccagaacaccagcatgcgtgatgtctaccggaagtttgacctgggtcaagatgtcatagatttcactggccatgccttggcgctctaccgcactgatgagtgaggggaaagctggctggtgatgggagccccttctctggctcacaccttgccctccccacacctgcctattgtacctactgcccaccctgcatgtctcttgtgctcagctccagactcacctgttccatttcagtccctctccatttgacccacatctttgccaggtcacaaagggtggtgggaaggttggctggtgtctttgtaggtgagcaaggatgccgctgccaaagcatcttccttggctcttgttccccagctacctggatcagccctgtcttgagactattaaccgcatcaagttgtacagcgagtccctggcccggtatggcaagagcccctatttatacccactgtatggcctgggtgagctgccccagggctttgccaggtgaggatctgtctttttcgga

SEQ ID NO: 79 - DNA, 6883 bp, mus musculus
gcggggcggggcgcgcgcggctcccgcgcaaggatctttcggaggactcagcacctgctgccggcctgccccgccccgtatttttctgggctcacgaagagccccgataacccctgcagtcattctggtgctgggacccaggtgacagaagccctcccagaaaacaagcaaggaaatgatgactggttgggcggggcggggccagcggagagagagagggactcattaacgctgcgtagggatcaggagacaaccgacagacgccatctttggttcagtgcggcggcagtgacagaagcagcggcaggggcagcagcagcagcggcagtagcagcagtagcaatagtagaggtagtggtagcggctgctgtggtgaaggaggaggagcagagcggacgctggtaccaaggcctgatcatggatgaggaatacgatgtgattgtgctggggacaggtcttaccgtaagtgccacttcaggctctcatagccctgcatcatgccatccctccccaccccacgccatccctccccaccccactccatcccgcattgatgcagagtccggtatccgatccatcctcccatcatcctagctccagccctgggaaaaccaaccccatgcccaacccactacctcaccctaggatgtcgattccagttcccaattctctgtagagggccccactttgtcctgtgttcctgcactctagtacttaacctcagacccctattcttccctatctctatcaccgaggtggaaaactcacccccccacacacacagtggaaccattgcacccagcccccaccctttgcctgaactcatcacctgctccaaggccttgattagcatcccttaccatcttgtgatcaaactaggggatggaatatgaagatgggtatggggacattacaagggtgggccctcatcatgcttttctgctttttgggatgggataggaaacccatggaatgttccagagacagcaggagtgtgtgtgtggggggtgtggggggggggtagtgaccactttacctctgccccaacttggtttcccatggagatctcagactgaatatatatcctcagcctttgtccttgggttagtgactgactggtgagggtgtttgtctcttccctgcccccgccccccccaacccccacccccggcctaaatctttttagtttgaaccctgagtctagaccagtggatagggccagaagagagtcaggggctcctgccctttgaaggaggagcagggtggggcctgggatttcaaggacttggccttctctttcaaaggtcctttgaattggttcttcttgtagactcattgtctttttgtgggctcagagaagtagatacttctcttggcttgttgatgctggaagacttggaagctgaaagctctgccccccaaacctcctttaatgctccagtagtttactcagcagggttgtaaaggaaacatcatatgaagccatcttctcctccccagttttaggcactgaaaagagctgcattataaaattggtggtgggcatgaagcaagttggagggttatggggtatagctgcaaatgtcactccttccccaggaatgcatcctgtctggcatcatgtctgtgaatggaaagaaggtgctgcacatggaccgaaacccctactatgggggtgagagctcttccatcacacccctggaggaggtaagatttcttattcttagacctgggcttagacccagatccttgttagtcttccacataggtataagggggcgaagtaattctcaggtactgggcaggagagtgggaaagggcgacaggtccttgacatttttctttctttcctgtcctgcttacagctatataagcgctttcagatactggaagggccccctgaatcaatgggccggggccgagactggaatgttgacttgatccccaaattcctcatggccaatggtgagagagattaaaaagatgctgtatatggttttgggggtggtgagtgggaagacggagtggggagagattggtcaatctcaagaatatggtcagtcagactactgagagtttttgaaggaaaacacaacaatgtcccttatttcctctggacacaggtcagctggtaaagatgctactatatacagaagtgactcgatatctggacttcaaggtggtagagggcagctttgtatataaggggggcaagatctacaaagtgccatccaccgagactgaggccttggcttctagtgagtatgagtctccttaaccagagaataatggggctggatgagacagactattttcaggacagttaggcaaaaggctcatctttgcctgaaactaatcttagctctgtgtagtcctagaggacccttactttatagtgtattgattggacagtgctacccatcctggcaagttgccagaaagttcacagaacaggattcctttttgtcagagggcctacttgccctgtagcatccctacgtggaactagaagggtttcttcctacaaaaagaaaattgagatcaagaagggtggggtagtgttacatgatagagtattggtgggagccaatactctacattacatacaaccagctttcttggcctgctctggtggaaagaggagttctatgtcccagtaatgctaagggtcttctcaatacctttctttcagatctgatgggcatgtttgaaaaacgacgcttccgaaaatttttggtgtttgtggcaaactttgatgagaatgaccccaaaacctttgagggtgttgatccccagaacaccagcatgcgtgatgtctaccggaagtttgacctgggtcaagatgtcatagatttcactggccatgccttggcgctctaccgcactgatgagtgaggggaaagctggctggtgatgggagccccttctctggctcacaccttgccctccccacacctgcctattgtacctactgcccaccctgcatgtctcttgtgctcagctccagactcacctgttccatttcagtccctctccatttgacccacatctttgccaggtcacaaagggtggtgggaaggttggctggtgtctttgtaggtgagcaaggatgccgctgccaaagcatcttccttggctcttgttccccagctacctggatcagccctgtcttgagactattaaccgcatcaagttgtacagcgagtccctggcccggtatggcaagagcccctatttatacccactgtatggcctgggtgagctgccccagggctttgccaggtgaggatctgtctttttcggatagtattactagtaagactaaggccaagaatgaaaattaccttgaatatttttgaggcatctcctactttcccatctaattttcatgtatattattccatccctgggtaatgggggcactgcgctagtgcattaaaaagcagagtagaggctggagaaatggctcagcagataagagcacttgtttataccgaggatccaggttcagttccaatgtgaacatacatggtagttcacaaccacccataactccagttttagggaatccaaaaccttcatctggcctccacaagcatcaggcatacatgtggtgtacagacatacatgtaaataaaacacacatatgaataaataaatataaaaatttatttaaaaaatagatgaaatacaaagtaaaggactaggtcaccatgaacatagcttcccttagctcttggtagtaccaggtctaagtctaggaccccagaaccttgagtctgggcttccctgggagctggctcttttactgacagttctttattcttgactcctgggccatttctgtgtggagctactccttcatgctgccttccattgacccatttgcagaacagagtattatggatggaaacagcagagaagaaggaatatgccaaaaatgggcccaaatttatgggggagacacctgaaacagttggaattgaactctgtctacctgtgtagtttctttaccccactggtggggtggggagagtagagtaggatcggtcaccattctcctgagaagactcccttgtcattttccttactatagattgagtgccatctatgggggaacatacatgctgaacaaaccagtggatgacatcatcatggaaaatggcaaggtggtgggtgtcaaatctgagggagaggtaagcctgccatatacatttgtattaccgtggtttggtctttttcagggctatgttcttagggagccttattactggtgagtttgctgctgcttaaccctgagaagcttacagctagggactgggtggtcagggaaactctacatagttattcctgttggcaagaaatacccttcaaaatgccaggtgtaatggcacacagctgttttccagtacttgggagccaaggcagatgaatataaatcaatcaagaagtatccttcagaagtcacatattttgtattcctgaaagtattcttttggaaagggtgccctgtaccccgggctggcgtcagatgttgaatgtagctgaggatgaacttttaatccttgtgcttccaccttcttgatgctggattacaggtgtgtgtcaagagacctgctttatgcattgcgggaatctaacctggggctttatgcataacaggcaagcactctaccaactgagataacatgcctccccccaaccatccttcagcctgctgtggtggggcatgagaattgaggctgctagtgaagaagatcctgaggttgagattagtttgggtcaaacagtctcaaataaaaactccagcagcagaaaaaaaaaagcccatttttgtgatcattgtgttttagcagtagggtcacctagccctgtatatgagggctgatctctctgagcttcaaagaaagggacagtgatgacagctcagagctgcctggcttgcctttccaacaggtacaaacccttctggtaccttcacaggtggcccgctgcaagcagctgatctgtgatcccagttacatcccagaccgtgtgcaaaaggctggccaggttattcgcatcatctgtatcctcagccaccccatcaagaataccaatgatgccaattcctgccaaattatcatccctcagaaccaggtcaacaggaagtcaggtaggccaggctgttatgcatctcttctcacaagaaatcttagggcttcttgtgacattttgttacagaatccctgcggcttggatggcttgagctcttaccttgttcatgaaaatgacagtttgaatgctgtttacatgttgggttgggagcaggagcatgtgggccagattcctgtctagcctctaggaactactttttgtgtgtggccattttcctctggtacatgttaaccaattggcttcccatggtcagacatctatgtgtgcatgatctcctatgcgcacaacgtggccgcacagggcaaatacatcgccattgccagcaccactgtagagactgcagaaccagaaaaggaagttgagcctgcattggagctgttggaacccattgaccagaagtgagaggctgaaccaaactttatggggaggttggggattaggaatgggcaaggcccattatgagacttttctcttctttcttttcttttatttgccccttaggtttgtggctatcagtgatttatatgagcccattgatgatggttcagagagtcaggtaaaaatgctgtcccagtcagccttggttcttgcagtctatccaagatcctctgcctgacttccgtgagccctggggttctgtctatttacaggtgttctgttcctgctcctatgatgctaccacacactttgagacaacctgcaatgacatcaaagatatctacaaacgcatggctggttctgcctttgattttgagaacatgaagcgcaaacagaatgatgtctttggagaagctgatcagtgattgctgactcccctcctccagcccctgttcccctctccccaacttgtatgtccttctctagggcaggggagatggtatggctaggcatccttgtttccagcatcttctgcttcccctaccacattccaatcacccaccttattgattttattcactgaccatatccttaaccttagggatggtttgggagatgggagttggatagtatcctctttcttggtctgtccttgttctagggaaagagaactttgtgtgtgtgtgtgtgtgtgtgtgtgtgtgtgtgcgcgcgcgcgtgcgtgtgtgtacgtgtgtgtacgtacgtgtgtgtgcgtgtgtacatgtgtgtgcatgtgtgtgtgcatcgtgcacccccaattttgctgtttgggaaggagtggaggaaaagctgacccccacccccactgctcttagtcccaaatgtagtggcctttggagatacccatctcctcccccaactcttaggtgttggagagaagggaccctcccagcacaaaattgcattcctcctcctcctcctcctccttataatttattctaatttattaactttggagtaattgtctgagccctcagcctttctgtgcagcctagggctgtagagtgagctgccctggcctctcccagtgctggcaaagcctgggatgggagaagatttaggtgtgaccccctctggaggttgatctgttttgaatttcttttgtgttgtgttcactgagaaaaagtaatgtgagcaaagcagaaggaggtaggaaagtggatccaaaccccagtgtaccctgccccatgccttttcctttagtggtgggaaacccttaccttgcaaagtgaatgtgtccccttccccaagctctagtatatttcacagaaaacaaaaacctcccaataaaactattgaaacttaa

SEQ ID NO: 80 - DNA, 3287 bp, mus musculus
ggctcccgcgcaaggatctttcggaggactcagcacctgctgccggcctgccccgccccgtatttttctgggctcacgaagagccccgataacccctgcagtcattctggtgctgggacccaggtgacagaagccctcccagaaaacaagcaaggaaatgatgactggttgggcggggcggggccagcggagagagagagggactcattaacgctgcgtagggatcaggagacaaccgacagacgccatctttggttcagtgcggcggcagtgacagaagcagcggcaggggcagcagcagcagcggcagtagcagcagtagcaatagtagaggtagtggtagcggctgctgtggtgaaggaggaggagcagagcggacgctggtaccaaggcctgatcatggatgaggaatacgatgtgattgtgctggggacaggtcttaccgtaagtgccacttcaggctctcatagccctgcatcatgccatccctccccaccccacgccatccctccccaccccactccatcccgcattgatgcagagtccggtatccgatccatcctcccatcatcctagctccagccctgggaaaaccaaccccatgcccaacccactacctcaccctaggatgtcgattccagttcccaattctctgtagagggccccactttgtcctgtgttcctgcactctagtacttaacctcagacccctattcttccctatctctatcaccgaggtggaaaactcacccccccacacacacagtggaaccattgcacccagcccccaccctttgcctgaactcatcacctgctccaaggccttgattagcatcccttaccatcttgtgatcaaactaggggatggaatatgaagatgggtatggggacattacaagggtgggccctcatcatgcttttctgctttttgggatgggataggaaacccatggaatgttccagagacagcaggagtgtgtgtgtggggggtgtggggggggggtagtgaccactttacctctgccccaacttggtttcccatggagatctcagactgaatatatatcctcagcctttgtccttgggttagtgactgactggtgagggtgtttgtctcttccctgcccccgccccccccaacccccacccccggcctaaatctttttagtttgaaccctgagtctagaccagtggatagggccagaagagagtcaggggctcctgccctttgaaggaggagcagggtggggcctgggatttcaaggacttggccttctctttcaaaggtcctttgaattggttcttcttgtagactcattgtctttttgtgggctcagagaagtagatacttctcttggcttgttgatgctggaagacttggaagctgaaagctctgccccccaaacctcctttaatgctccagtagtttactcagcagggttgtaaaggaaacatcatatgaagccatcttctcctccccagttttaggcactgaaaagagctgcattataaaattggtggtgggcatgaagcaagttggagggttatggggtatagctgcaaatgtcactccttccccaggaatgcatcctgtctggcatcatgtctgtgaatggaaagaaggtgctgcacatggaccgaaacccctactatgggggtgagagctcttccatcacacccctggaggaggtaagatttcttattcttagacctgggcttagacccagatccttgttagtcttccacataggtataagggggcgaagtaattctcaggtactgggcaggagagtgggaaagggcgacaggtccttgacatttttctttctttcctgtcctgcttacagctatataagcgctttcagatactggaagggccccctgaatcaatgggccggggccgagactggaatgttgacttgatccccaaattcctcatggccaatggtgagagagattaaaaagatgctgtatatggttttgggggtggtgagtgggaagacggagtggggagagattggtcaatctcaagaatatggtcagtcagactactgagagtttttgaaggaaaacacaacaatgtcccttatttcctctggacacaggtcagctggtaaagatgctactatatacagaagtgactcgatatctggacttcaaggtggtagagggcagctttgtatataaggggggcaagatctacaaagtgccatccaccgagactgaggccttggcttctagtgagtatgagtctccttaaccagagaataatggggctggatgagacagactattttcaggacagttaggcaaaaggctcatctttgcctgaaactaatcttagctctgtgtagtcctagaggacccttactttatagtgtattgattggacagtgctacccatcctggcaagttgccagaaagttcacagaacaggattcctttttgtcagagggcctacttgccctgtagcatccctacgtggaactagaagggtttcttcctacaaaaagaaaattgagatcaagaagggtggggtagtgttacatgatagagtattggtgggagccaatactctacattacatacaaccagctttcttggcctgctctggtggaaagaggagttctatgtcccagtaatgctaagggtcttctcaatacctttctttcagatctgatgggcatgtttgaaaaacgacgcttccgaaaatttttggtgtttgtggcaaactttgatgagaatgaccccaaaacctttgagggtgttgatccccagaacaccagcatgcgtgatgtctaccggaagtttgacctgggtcaagatgtcatagatttcactggccatgccttggcgctctaccgcactgatgagtgaggggaaagctggctggtgatgggagccccttctctggctcacaccttgccctccccacacctgcctattgtacctactgcccaccctgcatgtctcttgtgctcagctccagactcacctgttccatttcagtccctctccatttgacccacatctttgccaggtcacaaagggtggtgggaaggttggctggtgtctttgtaggtgagcaaggatgccgctgccaaagcatcttccttggctcttgttccccagctacctggatcagccctgtcttgagactattaaccgcatcaagttgtacagcgagtccctggcccggtatggcaagagcccctatttatacccactgtatggcctgggtgagctgccccagggctttgccaggtgaggatctgtctttttcggat

SEQ ID NO: 81 - DNA, 15645 bp, mus musculus
caggcggccgcaggccagcccagtgtgtgggcggcggcggttgcagattttgcagcgtgcgaggcgaggctgcggggccaagcgaggggggcggctgttgggcacggggcgggggggcacgtccacgtggccacgggtggccaccccgagtcagtcgcggtggagggacaggtaggtggtcgccatccttaaagcctgtgcgccaatagtctgctggatggcagaggtttcagacagcctgggggtccagatggtttctggggtcaggccctgtccctccctacctctccagaccaggcttgccaagcactccgtaccctgagcgggaagagacagccaactcgatcatagtcctattggttgatagaacccttttgtagaggaggagcagcatctctgagcattgctgtagcctctgtattgactaaggtatctgcgggtctgctcagggtgcccccattgggggcaggactggttgggttcatggcatagaggggagcattgtggaagagcgggctgtggacctgcatatttatatggagctttcctcatcatcgcgctctttgctggcaggactgtagcagaggggctgggtgcgactgtgatgcttgaggttgccacttagaggtgggggctggggtggggtcttgggctgccaattaccactttccaggtctcctttccaacctgtcccggccagttcctaaaatttggcttttctgtagagtgtagaagaggtgaaggtagggtgcagtcgcttttctcttttgctttcctttcttctctggttgttgcatgaggggtctgggatgcagacccgacaaaagagccccagagcgctgatcactctgagctgaaacttggcactttcaagctggaattgctccatgttctagcaaatgctggcttttctttctctttgctgtggcccccaccccccaccccattctgagtccctcctgtgtctcttgggaattgggcactgagagggtagcactgagctctgccccattagttacagagacactgctctgctgtctttgcagcctggggctggctgggtgtggcccggggggtgaatgccagcattggccctatttgtttaggggaaggggtagtactccatagccttaaggcttcaactgtatttgaggatgctggtttctacatataatacttctgggactctcaaaagtgggttatacccttctgccaatatccctctctgactaacctttggctcttcagggagagccacacaggcctggcagagcatttgtctgcctgtgtctgagcaaagcttgactgatgtctgtctcagcgagagtcttggctttgtgttgcagtggaaaggccagacagcagactcctggataagcagccaaggccctcaaagggagaaagcacctgaggccatgagttggagatgtagtggcactgaaaccagtctcaggccttaattctccagagctttgctctaggactcctgctagcagtgccactaacagagaagcacccctgaccccaacttgtgtttgttctctccctgcatttcctagtgtgtaatgttagggtcccagttctgggagaaccttccattccatcttttctagcagctgactctgatgcccccttgggtgtggcccagttgagacaaggcctcttggcttctttccagtacaggagtgggagatgattgatggcctgcaagcttgcctgtgcttgtcactcattcatttgccctattagaggcccctcccctctttcagcctcagtcaccatctggggctttatcatgttggatgagttgcctgcccctcgatagcactgaacctggcctgccaggttcactgggtcagacagggcagaaggagggagagtagcttgggcctggggctgatttgcacttgctgtctctcctcaggcctgtccctcgttacagctgctggtcatgcccactgtctgccttctcccattgctattcttcaccataggagggtgcctgggtagcagcaggccatttcgtacctttgtggtaacagataccactctgactcacctggctgtgcaccgagtgactggggaggtgtttgtaggtgccgtgaatcgagttttcaagctggctccaaacctaactgagctacgggcccatgtcacagggcccattgaggacaatgctcgctgctacccacctcctagcatgcgtgtgtgctcccaccgcctggtgcctgtggacaatgtgaacaagctgctcctcatagactatgcagcccgtcgtttggtagcttgtggcagcatctggcagggcatctgccagttcctgcgtctggatgacctcttcaagttgggtgagccccaccatcgcaaggagcactatctgtcaggggcccaggagcctgattccatggctggcgtcattgttgaacaggtccaggggcctagcaagttgtttgtgggcaccgctgttgatggcaagtctgagtactttcccaccttgagttcccgtaagctcatcgacgatgaggacagtggagatatgttcagtctggtgggtgagcttgttgcttttgtcttctttcccctggttcttatgagcccaggtcttattcactcctttctctcagtcctggccctgcttcttaggaaaactttggtttgagagaggaatttatgacccttcactgtcacatagatgtagaccagctgttgaggacaggaagatgggcagagtttacctgtggaaagtctgtctatagagaggctaaggtcaccttgcactctgtggcatggaatccagtaattgtccaggtggggcagatgggagatcactggggaagcctttagaaaaccgcattgttggaacagggttgggaagtgaaggtgggccttcaccctgctctcatactttgttctaatctccaggtgtaccaggatgagtttgtctcttctcagatcaagatcccttcagacacattgtccttgtaccctgcctttgacatctactacatatatggctttgtcagtgcctccttcgtgtacttcttaacgttgcagctggacacccagcagacgctgttggatacagcaggcgagaaattcttcacatccaagatcgtgcgcatgtgtgcaggggactcagagttctactcttatgtagagttccctattggctgctcctggcgtggtgtggagtaccgcttggtgcagagtgcccatctggccaagccaggcctgctattggcccaggctctgggtgtgccagccgacgaggatgtcctcttcaccatcttctctcagggccagaagaacagagccaacccacctcggcagaccatcctttgccttttcaccctcagcagcattaatgcccacatccggcgccgaatccaatcgtgctaccgtggagagggcacgctggccctaccctggctactgaataaggagctgccctgcatcaacaccgtgagccctttgcttgccctgctgtccctgtgccggatatgacagctctgtggctttctgcctttctgctgagtggctgtctgtccagtcctaggcttggcatgatcatgggattggcaacttagttttgacacccacactaccttacttgagagccttactctcttttctcttcttttctcttggccagtgtcctgtttgtatactgccattttccttttctgcctctatattcattcccacctttctccttgctctatctcaagtctaacagggtcaggcttctcctccttgccccgactttccatccccagtcccattttcccatggggtcctaggggaaacaaactgtcaagcatgtctggagggcagtggcttccaggttctgctcctttacagaatgtgaaatctgatagcatctgtttagcttgaactctcactcacccctcctgtgtcaccagcctctgcagatcaatggaaacttctgtgggttagtgttgaatcaaccattgggtggcctacacgtgattgaggggctacccttgctggctgacagcactgatggcatggccagtgtggctgcctacacctaccaccagcattctgtggttttcatcggtacacgcagcggtaatttgaagaaggttggtcctagaacccttgtcttatgtgattggggatgtttttcacactatgggaagaagggctgagggacagaatgtgaacatgagcctggataaccctgaatagggtgtaataacttcccaggttaggctccaagaactgaatcctgttcctttggtggctcctctgccatctaccttcgccagcattgttcgaaggtagcatttgtcttagtctaaggctatggctgttggaactataagcctacaaactgaatacagactcaaggaggccatatctgaccagctcaactgtaatctagaaagtccctggccgaagagcgtgctctgggtgcagggagctatggtagcatgaagctggcttgtcattttctctgtcctggtcttgtggctcaggtgcgggtcgatggctctcaggatgcccagctatatgaaacggtctctgtggtgcagggcagccccatacttcgagacctgctcttcagccctgaccaccgacacatctacctcctgagtgagaagcaggtgggcccgtggtgggtggtggtgtgtggtggggcaagggtgggctgtgtgctgatgtggctgtccccaggtgagccaactcccggtggagacctgtgagcagtatctgagctgtgctgcatgcctgggctcaggggacccacactgtggttggtgtgtgctacagcacaggtgagggaagagggtgtgggatgtggggcagcagtgggctccctggggccattatcttgggagacagaggatttaggaggaccttgccagctggacaggagccagccacacttgctatactttccttcacccacctgcccagtttttcccagccttgagccttcccccctcccttctcctccactttctccagctaatgagcggaacttctaccctgagtgacgtcccttggatctcaggggatgaggccaaggtacactgttgcctggcagtatgagctgggtatgctgtcttctgtcccacctcagcctcttactgcacccccatctgggccctcctgggacagtgctcggactgctctggcctgtctccatgcaggtgctgccgtgaaggggcctgtccaggtgcctctgccccacatggctttgcagaagagctgagcaaatgtatacaggtgcgggtccgtcccaataatgtgtcagtgacatcctctggggtgcaggtaagtgacatagaggatacttggccctgtatatgcttcatgagggagggtgcaccctgctctgaaccctctgccttccccagctgaccgtagccatgcgcaacgtgccagacctcagtgtgggtgtgagctgttcctttgaggaggtgactgaaagtgaggctattctgctgccctctggagagttacgatgtccttcaccatcccttcaggagctccagacacttaccagagggcatggtcagtgggatggggcaatctggggtgttgtggggcagggcagaattccagactagttggcaatagccatctggcttgctgcaggggccactcatactgtgcggcttcagctgctctccatggagactggtgtgaggtttgctggggttgactttgtcttctacaactgcagtgccctccagtcgtgagtacctggtccagaatctgtccctagccctggggatagtagataagtgctctgaaatatataaaaattgcactgtaactttctctagggttcaggggtgagttgttgggacttcctgctgtcgccacttctgtctagtcctgatgtgccctatgtggcttgggcaggttctgcctaccctattcatttgttccccaatgtgtcttgtgggtgggtgatacaggtcggtatgacctctgttatttctaaagctactcccccctccaggtgtatgtcctgtgttggcagcccttacccctgccactggtgtaagtaccgtcatgtgtgtaccagccacccacacgagtgctctttccaggagggcagggtccacagccctgaggtgaggtggtgcagtgcaccgtggaagaggctgggctccttgggggctggcctctcacattttttgtttgacctcccatttccatgggcctggagaaggcgggtagaccagtgtgcctctaacaagtgttctcctcccagggctgccctgagatcctgcctcaaggggacctcttgattcctgtgggtgtcatgcagcctctaactctgcgggctaagaacctgccacagcctcagtccggacagaagaattatgaatgcgtggtccgtgtacagggacggcaacatcgggtacctgcagtgcgctttaacagcagcagtgtgcagtgccagaatgcctcggtaagacccagagtgcagggtgggccagccaggaataatttgttttgtttgtttgttttgttttatttttgtgttttgtggtgtgtgtgtgtgtgtgtgcgtgtaatattttactgtattttgtatttggttggttttggtctatgcctagcttacttatctggaaacctttttttttttttttttttttttttttttttataagggattcctaaagtgggcaaggattttgctcatcttatttgtgctcatgtggttccatttttcttagtacttctatgaaggtgatgagtttggtgacaccgaactggacttctctgtggtttgggatggagatttccccattgataagcctcctagcttccgaggtgaggggtgacatggggccaaggagcatggctcctggggcaggattggcactgctgggggcaagtctgtaggtcctagagccccctgcttttctgccattgcctgctccatcagtagtctcctgtgcctgcagcccttctttacaagtgctgggctcagcggcctagctgtggcctctgcctcaaggctgatccccgattcaactgtggctggtgcatctcagagcacaggtgccagctgagggctcactgcccagctcccaaaagtaactggatgcacccaagccagaagggtgcccgatgcagccatccccgaatcacccaggttagcttcacctacaaatcctaccttgcttgttaggcatgtgtgagtctggcctgatcttcttgcttcttctcctgctctgcagattcatccacttacaggacccaaggagggtggcacccgggtcaccattgtgggtgagaacctgggcctcacttcccgtgaggttggccttcgagtagctggtgtacgttgcaactccattcccaccgaatatgtcagtgctgaaaggtgagtgtggctatgtgagcaccctgtccttgtttaccacagctggtcctgaccttctgtgactcttaggatcgtatgtgagatggaggaatcgctggtgcccagcccaccacctgggcctgctgagctctgtgtaggggattgttctgctgacttccgcacacagtcccagcaactctacagctttgtggtgcgtggtctaactagccccttccccttccctatctgggaaaatgtggagtgtcccttggatcaggctggcttctacctcctctcaagggctgcttcttcctcagacccctacatttgaccgtgtgagtccctctcggggcccagcttctggaggcactcggcttaccatctctggaatttctctggatgccggcagcagggtcacagtgattataagagatggcgagtgccagtttgtgaggtgggcctgagcacaagccatctggagttgagcactgattgtgtgaaagactatgggggcagggtaggtgaaggtgccaggccatctgcttcatgcctacctgcttacctgtgtaggagagatgccgaggcaatcgtgtgtatctcacctgtctccaccctgggccccagtcagagccctatcacccttgccatcgatcatgccaacatctccaacactggagtcatctatacctacacccaggaccctacggtcacacaccttgagcccacctggagcatcatcaagtgagaccctgaggagaatggggttgaggactgagttggggctctgagagtcttggggccttacctattactggggccttgggtcatcaagtggttcctccttcctgagccctcatcagtaggggccacagagttgtcctgcccatatagagcctggcacctgctgaatgaaccaaggtcagaggctctgagctctcagaaaatccttggtaactttggacagggtggggaagggagtctgagctctttacccatctctgcagtggaagcacctccatcactgtgagtggaacccatctgctgacagttcaagaaccccgtgtacgagccaagtaccgtggtattgagaccactaacgtgagtagtgggtttctacccctgttctaccattgctactcatggcttcatgcgctgagatgattgctgttgtcttcacagacatgccaggtgatcaacgacactgcaatgctatgtaaggcccctggcatcttccttgggcaccctcagcctcgggcccaaggcgagcaccctgacgagtttggcttcttgctggaccacgtgcaggcagcccgctccctcaaccgttcttccttcacctactaccctgatcccagctttgaaccacttgggccctctggtgtgctagatgtcaaacctggttcacatgttgtattgaaggtgctggggataaggatagggagtagaaaggaggggaagaaccgagagctggagtgcttgactgtttctgtgtgggttatccactactagggcaagaacctgatccctgctgcagctggcagctcccgcctcaactacacagtgttgattggaggacagccatgtgcactaactgtctcagatactcaacttctgtgtgattccccaagccagacaggccggcagcctgttatggtgggtatgggctcaagaggccaccagggcagccctggctgtgcatgggagttggttcacctcaagcttgcccttacaggtgctggtgggtggcctggagttctggttgggcacgctgcacatcactgctgatcgggcactgaccttaccagctatggtggggctagcagcagggggcgggctcttgctgctggccatcactgttgtgctggtcgcctacaagcgtaagactcaggatgcagaccgcacacttaagcggcttcagctacaaatggacaacctggagtctcgtgtggccttggagtgcaaggaaggtgcctaaagcagggggtgtaccacattgtgtgagagctgagggactttcctgcttcttgttcaactcactctaccgtattgtttcccagcctttgctgagctgcagactgatatcaatgaactgacaaaccacatggatggtgtccagatccccttcttggactaccggacctatgctgtgcgcgtgcttttccctggcatcgaggctcacccagtgctcaaggagctggatgtgagcctcctacccccaaagcctgcccatattctgttttccccagagccaccactacctactctctgagattccctggtccccacagactccccccaatgtggagaaggccctgcgtctatttggacagttgctgcacagccgtgccttcctgctcacctttatccacactttggaggcccagagtagtttctccatgcgtgaccgtggtactgtggcctcactcaccatggtggccctgcagagccggcttgactatgccactgggctgctcaagcaactgctggctgacctcatagagaaaaaccttgagagcaagaaccacccaaagctgctattgcgcaggtatgtaactgtcttgcttggcctctcctccagtcctgtcttccatttcctgcttgggcccctacctctgttcaagtctcacccttgtcaggccagggccttaggacctatctcttaccataggacagagtcggtggctgagaagatgctcaccaactggttcacattcctgctgcataagttcctgaaggtgtgctggggtgggctgggtcgcaggagaggaatgtccgggggtgggagcaattgattgataagccagacaggcagccagctatgcccctaaccctgggtgtaggagtgcgccggggagccactcttcctgctgtactgcgccatcaagcagcagatggagaaaggtcctattgatgccataacaggcgaggcccgctactccttaagtgaggacaagctcatccggcagcagatcgactataagaccctggtgagcatgggactatgcgagcaggaagtaaggtggagccttgcttaggaatcatgctgaggttccttcactcttagactctgcattgtgtgtgcccggagagcgagggcagtgcccaggtccctgtgaaggttcttaactgtgatagcatcacccaggccaaagacaagctgttggatactgtgtacaagggtattccatactctcagcgccccaaagctgaggacatggatttgggtaaggtccctcccttttctcctagctcccacctatccaatccctcccagggagctctcatattctgtatctgagctctgttccttaaaaggaatgtgtctaagtccttgtgagggtgaatttccctaagagctgactatggcctgcagaatggcgccagggccgcatggcccgaatcatcctccaagatgaggacatcactacaaagattgagtgtgactggaagagggtcaactcattggcccactaccaggtgaggaactttgaacctattcagctccagggacacctagaagtagtggccaggtctcctctcgtcccttatccctatactcatgagggcttctcatagggccttgattgccactgtacatatatatactgaagagtatgaatgaatggtggtcccctggctccttctgtttctttggacctccaggtgactgatggttctttagtagcactggtgcccaaacaagtgtctgcctataacatggccaactcgttcaccttcacccggtcacttagtcgctacggtaggtatccatattgtggtggctttcctggtcccgtgccctttaattaaggctgtatcttaggaatccccaagtagctgtcttgatccatttggaaagactttcattattttgggcccctgggtggtcttcagttgtatagagcctaatagggaggggtggcaaggataggtgggtcccacaaagacttctagaagataatggagcaagagggtgggtaatggccagagcctgtagggcttaagagtcacatctgtcctctgccctagagagcttgctccgtgctgccagcagcccggatagcctccgttcccgagcacctatgctcacgcctgaccaggaggcaggtaccaagctgtggcacctggtgaggaaccacgaccacactgatcaccgagaaggagaccgcggcagcaagatggtctcagaaatatatctcacaaggctgctggccaccaaggtgtgggcctgccccatagacaccttctagcccagtcttaaacatgagatgagctgctttcttagggccttggcactaggacctctacgcctgaggtcaagcaaaggtctattttaggaatgttggcccttcagagaagtttttttttactgagctattctgccccctgtctgtcagattttgggaacttcctgacatggttcctttaccatcactcatagggcacgttgcagaagtttgtagatgacttgtttgaaactgtgttcagtacagcccaccggggctcagccttacccttggccatcaagtacatgtttgacttcctggatgaacaggctgaccagcgccagatcagtgaccctgatgtgcgtcacacctggaagagcaactggtacttactggttcctgactgctgctggctcttctgagggtgggtgggaggaagaggctagttacttagccaagcctccaggccaatggagacaggttgactagcaactgaatagccttccatgcaggagggatggaccagtggtatggcctggaagtgaatatgagtatatagaaggtgggtgctgctgggttgtgcagatgggaagtgctagtctagcactgggattgaccatttttctctagggtcctgtgcagggtagagacactgatggcttggcataggtggagacagtggaagtttcaggggtggaggttgaggacagaaagccatctattcttatttctcattgcctgagtgcagcagaaggttaaagaaaaacccatttatccaaaatagtctctcctgttacttcaggacaagatatgacctggccaaacaggacaaggtgtgaaggaaggcagtgggggaagggggcacatagggccattagggagtctcaagtgtatgtccctctgttcagcttacctctgcgtttctgggtgaatgtgatcaagaatccgcaatttgtgtttgacatccataagaatagcatcacagacgcctgtttgtcagtggtggcccagaccttcatggactcctgttctacatcagagcaccgcctgggcaaggactcaccttccaacaagctcctctatgccaaggatattcccaattacaagagctgggtggagaggtgggccctgggatactgctgtgtatgcctggtggcaggcaggaactgcctaaacagcctgtctgaggctggccagatacaagaaaaagcctcagaggctggccaaacactgatggcatgagttttggcatttatgacctgtgcatgattcactcacccaaggtctctataggtactatcgagatatcgcaaagatggcatccatcagtgaccaggacatggacgcctacttagtggagcagtcccgcctccatgctaatgacttcaatgtcctaagtgcactcagcgagctctacttctatgtcaccaagtaccgtcaggaggtacgttgatgtacctcatggacccccagttgcatggctctgatgatgatacagttaggggcaaaggcagggagatgtgttgagaagcacacaagcatgtaagcaagatgggacaaagtccatcttatatcttgtttacagtccatcccttgcctagggccagcatgggcaataatttctttagatgctaggatttaaggaatacaggagacaatgcactagctggaatatagaggtcccactggataaaggttacaagactggaaagtgagaacagatgtattctaagcactcatgttaaaatattggatgtggtggcatgtgtgggtatgggtgctggtgagtggtttagataggcagattcccataactcactagtcaatcactgagttctatgttcaatgagagatgtcaaataataaggtggaggggctggagagatgattcagcagttaagaacacttgctgttcttccagaggacctgagtttgattcccagcacccacaaggcagcacatatccctctagctccagttccagggaatctggtctccttctgtggcttctgaagacactagacacacatgatattacatacatacatgcaggcagaacacctatacacgtttttaaaaggtggggaatgataaagacaccaggtattgaacctctggcctccacacacatgcatatgtatccatatgtacagctgtacacagacaaatacagatgtgcaggagagatcaggtacactaaagataaagccctagataggcatggtggtacacacttttagtcccagcactcaggaagcaaagacaggcatatctctgtgattcaaggctagcttggtctacaaagcaagttctaggacaattagagatacatagtgagatactatatataaaaaggagctcaccaagggagatcaaggggctatagaggagatctggccaagcacagcattctgggcgactcacaggtcaaagaggaaagagagaactggtcgggaatggggaggggacccagaagtacctggtagtatcagcctcatatcctgagccaggatcaagaaggatgtcatggccaaatttgccaaagagatgttggagtttgggttaggagggaacaggaattgaaaacagcaagtattgcccactctccaaagaggctacaatacaagagccatggtagaagagttggtggtggtatttgcagacaaggggaagtgggtagttttggtgagaggtttggagcatgaggctggcacagggactgaagccaatgagggaagagcacttctgggaagcaggggctttatgcagaagtagggccctgccttggagtcttgctccaatggatcatcatcctctagatcctcacctcgctggaccgagatgcctcttgtcggaagcacaagcttcgacagaagctggagcagatcatcaccctggtgtccagcagcagctgagtggggagatggtgaggagggggcttcttgcttctgagccatcctcccagtcaggggagtgtctggctctagcctgggtctccagggctgagatccagagctggtggtgttggggaggttaccaagccaagatgccccatcacacctgggcccccttcattagtgccttgctttgggccctgcagggggaggggatgacaggaccaagcttcccccactagcagcagcaatatccccaccctcttgccctggtgttcccatgtcagaagagcccttgccctccttgctctgacatcctacccacctatttattaatgtaattccactttaatttccatatgtaaatatatatgccccatgggatgttactagcctcacagacctcttctttggttgatctgggtcctgtttcctgttctggttcctttgtgacactgcaagccttggctcagcctctggcgtctcacatttgctgtgtcaggccccacttgtcctaagaagagatcctcagtaccagcagcatttggggttggatgatgcatctgaagctgccctcagattggccaggccaggccaggccagggcaatatccctcttcagatatctcaggagtcagaccacattttcatggggcctgttgtctctgagagaactataaccaggctgtgattgggcctgatgagggcctgggcctctgggacattcctcacgtccctactgccaaatttcctcagtgttgtaggcacttgccctgaactctctcagcctcagctgccctatcacatgcccatccttaagggccaaggtggcagtgccttactgttttgtgtttcctgcttcccctgaggaatctggccctgtctaatggtcccagacccccagtccgctctccttctgttgcatgagtttttcttcgttgttgtaattttttcctaattaaatgttgggaaatggggtcagtgcatgtctttgtctttggagaaagtgggtagacctgttgggctatggatgaactagattcccactgaggggaaaaatgtaactcacgaagacttctgatgatttgaggaaggccatgtatagtccattagacaatccttgtggctctagtttcaagactgaataaatctgcttccttctccttgca

SEQ ID NO: 82 - DNA, 22662 bp, mus musculus
caggcggccgcaggccagcccagtgtgtgggcggcggcggttgcagattttgcagcgtgcgaggcgaggctgcggggccaagcgaggggggcggctgttgggcacggggcgggggggcacgtccacgtggccacgggtggccaccccgagtcagtcgcggtggagggacaggtaggtggtcgccatccttaaagcctgtgcgccaatagtctgctggatggcagaggtttcagacagcctgggggtccagatggtttctggggtcaggccctgtccctccctacctctccagaccaggcttgccaagcactccgtaccctgagcgggaagagacagccaactcgatcatagtcctattggttgatagaacccttttgtagaggaggagcagcatctctgagcattgctgtagcctctgtattgactaaggtatctgcgggtctgctcagggtgcccccattgggggcaggactggttgggttcatggcatagaggggagcattgtggaagagcgggctgtggacctgcatatttatatggagctttcctcatcatcgcgctctttgctggcaggactgtagcagaggggctgggtgcgactgtgatgcttgaggttgccacttagaggtgggggctggggtggggtcttgggctgccaattaccactttccaggtctcctttccaacctgtcccggccagttcctaaaatttggcttttctgtagagtgtagaagaggtgaaggtagggtgcagtcgcttttctcttttgctttcctttcttctctggttgttgcatgaggggtctgggatgcagacccgacaaaagagccccagagcgctgatcactctgagctgaaacttggcactttcaagctggaattgctccatgttctagcaaatgctggcttttctttctctttgctgtggcccccaccccccaccccattctgagtccctcctgtgtctcttgggaattgggcactgagagggtagcactgagctctgccccattagttacagagacactgctctgctgtctttgcagcctggggctggctgggtgtggcccggggggtgaatgccagcattggccctatttgtttaggggaaggggtagtactccatagccttaaggcttcaactgtatttgaggatgctggtttctacatataatacttctgggactctcaaaagtgggttatacccttctgccaatatccctctctgactaacctttggctcttcagggagagccacacaggcctggcagagcatttgtctgcctgtgtctgagcaaagcttgactgatgtctgtctcagcgagagtcttggctttgtgttgcagtggaaaggccagacagcagactcctggataagcagccaaggccctcaaagggagaaagcacctgaggccatgagttggagatgtagtggcactgaaaccagtctcaggccttaattctccagagctttgctctaggactcctgctagcagtgccactaacagagaagcacccctgaccccaacttgtgtttgttctctccctgcatttcctagtgtgtaatgttagggtcccagttctgggagaaccttccattccatcttttctagcagctgactctgatgcccccttgggtgtggcccagttgagacaaggcctcttggcttctttccagtacaggagtgggagatgattgatggcctgcaagcttgcctgtgcttgtcactcattcatttgccctattagaggcccctcccctctttcagcctcagtcaccatctggggctttatcatgttggatgagttgcctgcccctcgatagcactgaacctggcctgccaggttcactgggtcagacagggcagaaggagggagagtagcttgggcctggggctgatttgcacttgctgtctctcctcaggcctgtccctcgttacagctgctggtcatgcccactgtctgccttctcccattgctattcttcaccataggagggtgcctgggtagcagcaggccatttcgtacctttgtggtaacagataccactctgactcacctggctgtgcaccgagtgactggggaggtgtttgtaggtgccgtgaatcgagttttcaagctggctccaaacctaactgagctacgggcccatgtcacagggcccattgaggacaatgctcgctgctacccacctcctagcatgcgtgtgtgctcccaccgcctggtgcctgtggacaatgtgaacaagctgctcctcatagactatgcagcccgtcgtttggtagcttgtggcagcatctggcagggcatctgccagttcctgcgtctggatgacctcttcaagttgggtgagccccaccatcgcaaggagcactatctgtcaggggcccaggagcctgattccatggctggcgtcattgttgaacaggtccaggggcctagcaagttgtttgtgggcaccgctgttgatggcaagtctgagtactttcccaccttgagttcccgtaagctcatcgacgatgaggacagtggagatatgttcagtctggtgggtgagcttgttgcttttgtcttctttcccctggttcttatgagcccaggtcttattcactcctttctctcagtcctggccctgcttcttaggaaaactttggtttgagagaggaatttatgacccttcactgtcacatagatgtagaccagctgttgaggacaggaagatgggcagagtttacctgtggaaagtctgtctatagagaggctaaggtcaccttgcactctgtggcatggaatccagtaattgtccaggtggggcagatgggagatcactggggaagcctttagaaaaccgcattgttggaacagggttgggaagtgaaggtgggccttcaccctgctctcatactttgttctaatctccaggtgtaccaggatgagtttgtctcttctcagatcaagatcccttcagacacattgtccttgtaccctgcctttgacatctactacatatatggctttgtcagtgcctccttcgtgtacttcttaacgttgcagctggacacccagcagacgctgttggatacagcaggcgagaaattcttcacatccaagatcgtgcgcatgtgtgcaggggactcagagttctactcttatgtagagttccctattggctgctcctggcgtggtgtggagtaccgcttggtgcagagtgcccatctggccaagccaggcctgctattggcccaggctctgggtgtgccagccgacgaggatgtcctcttcaccatcttctctcagggccagaagaacagagccaacccacctcggcagaccatcctttgccttttcaccctcagcagcattaatgcccacatccggcgccgaatccaatcgtgctaccgtggagagggcacgctggccctaccctggctactgaataaggagctgccctgcatcaacaccgtgagccctttgcttgccctgctgtccctgtgccggatatgacagctctgtggctttctgcctttctgctgagtggctgtctgtccagtcctaggcttggcatgatcatgggattggcaacttagttttgacacccacactaccttacttgagagccttactctcttttctcttcttttctcttggccagtgtcctgtttgtatactgccattttccttttctgcctctatattcattcccacctttctccttgctctatctcaagtctaacagggtcaggcttctcctccttgccccgactttccatccccagtcccattttcccatggggtcctaggggaaacaaactgtcaagcatgtctggagggcagtggcttccaggttctgctcctttacagaatgtgaaatctgatagcatctgtttagcttgaactctcactcacccctcctgtgtcaccagcctctgcagatcaatggaaacttctgtgggttagtgttgaatcaaccattgggtggcctacacgtgattgaggggctacccttgctggctgacagcactgatggcatggccagtgtggctgcctacacctaccaccagcattctgtggttttcatcggtacacgcagcggtaatttgaagaaggttggtcctagaacccttgtcttatgtgattggggatgtttttcacactatgggaagaagggctgagggacagaatgtgaacatgagcctggataaccctgaatagggtgtaataacttcccaggttaggctccaagaactgaatcctgttcctttggtggctcctctgccatctaccttcgccagcattgttcgaaggtagcatttgtcttagtctaaggctatggctgttggaactataagcctacaaactgaatacagactcaaggaggccatatctgaccagctcaactgtaatctagaaagtccctggccgaagagcgtgctctgggtgcagggagctatggtagcatgaagctggcttgtcattttctctgtcctggtcttgtggctcaggtgcgggtcgatggctctcaggatgcccagctatatgaaacggtctctgtggtgcagggcagccccatacttcgagacctgctcttcagccctgaccaccgacacatctacctcctgagtgagaagcaggtgggcccgtggtgggtggtggtgtgtggtggggcaagggtgggctgtgtgctgatgtggctgtccccaggtgagccaactcccggtggagacctgtgagcagtatctgagctgtgctgcatgcctgggctcaggggacccacactgtggttggtgtgtgctacagcacaggtgagggaagagggtgtgggatgtggggcagcagtgggctccctggggccattatcttgggagacagaggatttaggaggaccttgccagctggacaggagccagccacacttgctatactttccttcacccacctgcccagtttttcccagccttgagccttcccccctcccttctcctccactttctccagctaatgagcggaacttctaccctgagtgacgtcccttggatctcaggggatgaggccaaggtacactgttgcctggcagtatgagctgggtatgctgtcttctgtcccacctcagcctcttactgcacccccatctgggccctcctgggacagtgctcggactgctctggcctgtctccatgcaggtgctgccgtgaaggggcctgtccaggtgcctctgccccacatggctttgcagaagagctgagcaaatgtatacaggtgcgggtccgtcccaataatgtgtcagtgacatcctctggggtgcaggtaagtgacatagaggatacttggccctgtatatgcttcatgagggagggtgcaccctgctctgaaccctctgccttccccagctgaccgtagccatgcgcaacgtgccagacctcagtgtgggtgtgagctgttcctttgaggaggtgactgaaagtgaggctattctgctgccctctggagagttacgatgtccttcaccatcccttcaggagctccagacacttaccagagggcatggtcagtgggatggggcaatctggggtgttgtggggcagggcagaattccagactagttggcaatagccatctggcttgctgcaggggccactcatactgtgcggcttcagctgctctccatggagactggtgtgaggtttgctggggttgactttgtcttctacaactgcagtgccctccagtcgtgagtacctggtccagaatctgtccctagccctggggatagtagataagtgctctgaaatatataaaaattgcactgtaactttctctagggttcaggggtgagttgttgggacttcctgctgtcgccacttctgtctagtcctgatgtgccctatgtggcttgggcaggttctgcctaccctattcatttgttccccaatgtgtcttgtgggtgggtgatacaggtcggtatgacctctgttatttctaaagctactcccccctccaggtgtatgtcctgtgttggcagcccttacccctgccactggtgtaagtaccgtcatgtgtgtaccagccacccacacgagtgctctttccaggagggcagggtccacagccctgaggtgaggtggtgcagtgcaccgtggaagaggctgggctccttgggggctggcctctcacattttttgtttgacctcccatttccatgggcctggagaaggcgggtagaccagtgtgcctctaacaagtgttctcctcccagggctgccctgagatcctgcctcaaggggacctcttgattcctgtgggtgtcatgcagcctctaactctgcgggctaagaacctgccacagcctcagtccggacagaagaattatgaatgcgtggtccgtgtacagggacggcaacatcgggtacctgcagtgcgctttaacagcagcagtgtgcagtgccagaatgcctcggtaagacccagagtgcagggtgggccagccaggaataatttgttttgtttgtttgttttgttttatttttgtgttttgtggtgtgtgtgtgtgtgtgtgcgtgtaatattttactgtattttgtatttggttggttttggtctatgcctagcttacttatctggaaacctttttttttttttttttttttttttttttttataagggattcctaaagtgggcaaggattttgctcatcttatttgtgctcatgtggttccatttttcttagtacttctatgaaggtgatgagtttggtgacaccgaactggacttctctgtggtttgggatggagatttccccattgataagcctcctagcttccgaggtgaggggtgacatggggccaaggagcatggctcctggggcaggattggcactgctgggggcaagtctgtaggtcctagagccccctgcttttctgccattgcctgctccatcagtagtctcctgtgcctgcagcccttctttacaagtgctgggctcagcggcctagctgtggcctctgcctcaaggctgatccccgattcaactgtggctggtgcatctcagagcacaggtgccagctgagggctcactgcccagctcccaaaagtaactggatgcacccaagccagaagggtgcccgatgcagccatccccgaatcacccaggttagcttcacctacaaatcctaccttgcttgttaggcatgtgtgagtctggcctgatcttcttgcttcttctcctgctctgcagattcatccacttacaggacccaaggagggtggcacccgggtcaccattgtgggtgagaacctgggcctcacttcccgtgaggttggccttcgagtagctggtgtacgttgcaactccattcccaccgaatatgtcagtgctgaaaggtgagtgtggctatgtgagcaccctgtccttgtttaccacagctggtcctgaccttctgtgactcttaggatcgtatgtgagatggaggaatcgctggtgcccagcccaccacctgggcctgctgagctctgtgtaggggattgttctgctgacttccgcacacagtcccagcaactctacagctttgtggtgcgtggtctaactagccccttccccttccctatctgggaaaatgtggagtgtcccttggatcaggctggcttctacctcctctcaagggctgcttcttcctcagacccctacatttgaccgtgtgagtccctctcggggcccagcttctggaggcactcggcttaccatctctggaatttctctggatgccggcagcagggtcacagtgattataagagatggcgagtgccagtttgtgaggtgggcctgagcacaagccatctggagttgagcactgattgtgtgaaagactatgggggcagggtaggtgaaggtgccaggccatctgcttcatgcctacctgcttacctgtgtaggagagatgccgaggcaatcgtgtgtatctcacctgtctccaccctgggccccagtcagagccctatcacccttgccatcgatcatgccaacatctccaacactggagtcatctatacctacacccaggaccctacggtcacacaccttgagcccacctggagcatcatcaagtgagaccctgaggagaatggggttgaggactgagttggggctctgagagtcttggggccttacctattactggggccttgggtcatcaagtggttcctccttcctgagccctcatcagtaggggccacagagttgtcctgcccatatagagcctggcacctgctgaatgaaccaaggtcagaggctctgagctctcagaaaatccttggtaactttggacagggtggggaagggagtctgagctctttacccatctctgcagtggaagcacctccatcactgtgagtggaacccatctgctgacagttcaagaaccccgtgtacgagccaagtaccgtggtattgagaccactaacgtgagtagtgggtttctacccctgttctaccattgctactcatggcttcatgcgctgagatgattgctgttgtcttcacagacatgccaggtgatcaacgacactgcaatgctatgtaaggcccctggcatcttccttgggcaccctcagcctcgggcccaaggcgagcaccctgacgagtttggcttcttgctggaccacgtgcaggcagcccgctccctcaaccgttcttccttcacctactaccctgatcccagctttgaaccacttgggccctctggtgtgctagatgtcaaacctggttcacatgttgtattgaaggtgctggggataaggatagggagtagaaaggaggggaagaaccgagagctggagtgcttgactgtttctgtgtgggttatccactactagggcaagaacctgatccctgctgcagctggcagctcccgcctcaactacacagtgttgattggaggacagccatgtgcactaactgtctcagatactcaacttctgtgtgattccccaagccagacaggccggcagcctgttatggtgggtatgggctcaagaggccaccagggcagccctggctgtgcatgggagttggttcacctcaagcttgcccttacaggtgctggtgggtggcctggagttctggttgggcacgctgcacatcactgctgatcgggcactgaccttaccagctatggtggggctagcagcagggggcgggctcttgctgctggccatcactgttgtgctggtcgcctacaagcgtaagactcaggatgcagaccgcacacttaagcggcttcagctacaaatggacaacctggagtctcgtgtggccttggagtgcaaggaaggtgcctaaagcagggggtgtaccacattgtgtgagagctgagggactttcctgcttcttgttcaactcactctaccgtattgtttcccagcctttgctgagctgcagactgatatcaatgaactgacaaaccacatggatggtgtccagatccccttcttggactaccggacctatgctgtgcgcgtgcttttccctggcatcgaggctcacccagtgctcaaggagctggatgtgagcctcctacccccaaagcctgcccatattctgttttccccagagccaccactacctactctctgagattccctggtccccacagactccccccaatgtggagaaggccctgcgtctatttggacagttgctgcacagccgtgccttcctgctcacctttatccacactttggaggcccagagtagtttctccatgcgtgaccgtggtactgtggcctcactcaccatggtggccctgcagagccggcttgactatgccactgggctgctcaagcaactgctggctgacctcatagagaaaaaccttgagagcaagaaccacccaaagctgctattgcgcaggtatgtaactgtcttgcttggcctctcctccagtcctgtcttccatttcctgcttgggcccctacctctgttcaagtctcacccttgtcaggccagggccttaggacctatctcttaccataggacagagtcggtggctgagaagatgctcaccaactggttcacattcctgctgcataagttcctgaaggtgtgctggggtgggctgggtcgcaggagaggaatgtccgggggtgggagcaattgattgataagccagacaggcagccagctatgcccctaaccctgggtgtaggagtgcgccggggagccactcttcctgctgtactgcgccatcaagcagcagatggagaaaggtcctattgatgccataacaggcgaggcccgctactccttaagtgaggacaagctcatccggcagcagatcgactataagaccctggtgagcatgggactatgcgagcaggaagtaaggtggagccttgcttaggaatcatgctgaggttccttcactcttagactctgcattgtgtgtgcccggagagcgagggcagtgcccaggtccctgtgaaggttcttaactgtgatagcatcacccaggccaaagacaagctgttggatactgtgtacaagggtattccatactctcagcgccccaaagctgaggacatggatttgggtaaggtccctcccttttctcctagctcccacctatccaatccctcccagggagctctcatattctgtatctgagctctgttccttaaaaggaatgtgtctaagtccttgtgagggtgaatttccctaagagctgactatggcctgcagaatggcgccagggccgcatggcccgaatcatcctccaagatgaggacatcactacaaagattgagtgtgactggaagagggtcaactcattggcccactaccaggtgaggaactttgaacctattcagctccagggacacctagaagtagtggccaggtctcctctcgtcccttatccctatactcatgagggcttctcatagggccttgattgccactgtacatatatatactgaagagtatgaatgaatggtggtcccctggctccttctgtttctttggacctccaggtgactgatggttctttagtagcactggtgcccaaacaagtgtctgcctataacatggccaactcgttcaccttcacccggtcacttagtcgctacggtaggtatccatattgtggtggctttcctggtcccgtgccctttaattaaggctgtatcttaggaatccccaagtagctgtcttgatccatttggaaagactttcattattttgggcccctgggtggtcttcagttgtatagagcctaatagggaggggtggcaaggataggtgggtcccacaaagacttctagaagataatggagcaagagggtgggtaatggccagagcctgtagggcttaagagtcacatctgtcctctgccctagagagcttgctccgtgctgccagcagcccggatagcctccgttcccgagcacctatgctcacgcctgaccaggaggcaggtaccaagctgtggcacctggtgaggaaccacgaccacactgatcaccgagaaggagaccgcggcagcaagatggtctcagaaatatatctcacaaggctgctggccaccaaggtgtgggcctgccccatagacaccttctagcccagtcttaaacatgagatgagctgctttcttagggccttggcactaggacctctacgcctgaggtcaagcaaaggtctattttaggaatgttggcccttcagagaagtttttttttactgagctattctgccccctgtctgtcagattttgggaacttcctgacatggttcctttaccatcactcatagggcacgttgcagaagtttgtagatgacttgtttgaaactgtgttcagtacagcccaccggggctcagccttacccttggccatcaagtacatgtttgacttcctggatgaacaggctgaccagcgccagatcagtgaccctgatgtgcgtcacacctggaagagcaactggtacttactggttcctgactgctgctggctcttctgagggtgggtgggaggaagaggctagttacttagccaagcctccaggccaatggagacaggttgactagcaactgaatagccttccatgcaggagggatggaccagtggtatggcctggaagtgaatatgagtatatagaaggtgggtgctgctgggttgtgcagatgggaagtgctagtctagcactgggattgaccatttttctctagggtcctgtgcagggtagagacactgatggcttggcataggtggagacagtggaagtttcaggggtggaggttgaggacagaaagccatctattcttatttctcattgcctgagtgcagcagaaggttaaagaaaaacccatttatccaaaatagtctctcctgttacttcaggacaagatatgacctggccaaacaggacaaggtgtgaaggaaggcagtgggggaagggggcacatagggccattagggagtctcaagtgtatgtccctctgttcagcttacctctgcgtttctgggtgaatgtgatcaagaatccgcaatttgtgtttgacatccataagaatagcatcacagacgcctgtttgtcagtggtggcccagaccttcatggactcctgttctacatcagagcaccgcctgggcaaggactcaccttccaacaagctcctctatgccaaggatattcccaattacaagagctgggtggagaggtgggccctgggatactgctgtgtatgcctggtggcaggcaggaactgcctaaacagcctgtctgaggctggccagatacaagaaaaagcctcagaggctggccaaacactgatggcatgagttttggcatttatgacctgtgcatgattcactcacccaaggtctctataggtactatcgagatatcgcaaagatggcatccatcagtgaccaggacatggacgcctacttagtggagcagtcccgcctccatgctaatgacttcaatgtcctaagtgcactcagcgagctctacttctatgtcaccaagtaccgtcaggaggtacgttgatgtacctcatggacccccagttgcatggctctgatgatgatacagttaggggcaaaggcagggagatgtgttgagaagcacacaagcatgtaagcaagatgggacaaagtccatcttatatcttgtttacagtccatcccttgcctagggccagcatgggcaataatttctttagatgctaggatttaaggaatacaggagacaatgcactagctggaatatagaggtcccactggataaaggttacaagactggaaagtgagaacagatgtattctaagcactcatgttaaaatattggatgtggtggcatgtgtgggtatgggtgctggtgagtggtttagataggcagattcccataactcactagtcaatcactgagttctatgttcaatgagagatgtcaaataataaggtggaggggctggagagatgattcagcagttaagaacacttgctgttcttccagaggacctgagtttgattcccagcacccacaaggcagcacatatccctctagctccagttccagggaatctggtctccttctgtggcttctgaagacactagacacacatgatattacatacatacatgcaggcagaacacctatacacgtttttaaaaggtggggaatgataaagacaccaggtattgaacctctggcctccacacacatgcatatgtatccatatgtacagctgtacacagacaaatacagatgtgcaggagagatcaggtacactaaagataaagccctagataggcatggtggtacacacttttagtcccagcactcaggaagcaaagacaggcatatctctgtgattcaaggctagcttggtctacaaagcaagttctaggacaattagagatacatagtgagatactatatataaaaaggagctcaccaagggagatcaaggggctatagaggagatctggccaagcacagcattctgggcgactcacaggtcaaagaggaaagagagaactggtcgggaatggggaggggacccagaagtacctggtagtatcagcctcatatcctgagccaggatcaagaaggatgtcatggccaaatttgccaaagagatgttggagtttgggttaggagggaacaggaattgaaaacagcaagtattgcccactctccaaagaggctacaatacaagagccatggtagaagagttggtggtggtatttgcagacaaggggaagtgggtagttttggtgagaggtttggagcatgaggctggcacagggactgaagccaatgagggaagagcacttctgggaagcaggggctttatgcagaagtagggccctgccttggagtcttgctccaatggatcatcatcctctagatcctcacctcgctggaccgagatgcctcttgtcggaagcacaagcttcgacagaagctggagcagatcatcaccctggtgtccagcagcagctgagtggggagatggtgaggagggggcttcttgcttctgagccatcctcccagtcaggggagtgtctggctctagcctgggtctccagggctgagatccagagctggtggtgttggggaggttaccaagccaagatgccccatcacacctgggcccccttcattagtgccttgctttgggccctgcagggggaggggatgacaggaccaagcttcccccactagcagcagcaatatccccaccctcttgccctggtgttcccatgtcagaagagcccttgccctccttgctctgacatcctacccacctatttattaatgtaattccactttaatttccatatgtaaatatatatgccccatgggatgttactagcctcacagacctcttctttggttgatctgggtcctgtttcctgttctggttcctttgtgacactgcaagccttggctcagcctctggcgtctcacatttgctgtgtcaggccccacttgtcctaagaagagatcctcagtaccagcagcatttggggttggatgatgcatctgaagctgccctcagattggccaggccaggccaggccagggcaatatccctcttcagatatctcaggagtcagaccacattttcatggggcctgttgtctctgagagaactataaccaggctgtgattgggcctgatgagggcctgggcctctgggacattcctcacgtccctactgccaaatttcctcagtgttgtaggcacttgccctgaactctctcagcctcagctgccctatcacatgcccatccttaagggccaaggtggcagtgccttactgttttgtgtttcctgcttcccctgaggaatctggccctgtctaatggtcccagacccccagtccgctctccttctgttgcatgagtttttcttcgttgttgtaattttttcctaattaaatgttgggaaatggggtcagtgcatgtctttgtctttggagaaagtgggtagacctgttgggctatggatgaactagattcccactgaggggaaaaatgtaactcacgaagacttctgatgatttgaggaaggccatgtatagtccattagacaatccttgtggctctagtttcaagactgaataaatctgcttccttctccttgcatgtactgtttccactcagatatgcccagctccctgcttttgccatgacccctttagcccattattagttggagacaaagagatactattaagaaataaggcacatgtctccattgtgttaaaaaaaatcttcagtgggggctggagagatggcttagtgtttaagagcaccagttgttcttccatgggactcaggtcaatttctagcacacacatagtagcttacaatttgtgtgacttcagttccaagaaatctgatgtcctcttcaggcttggtgcatagacatatatgcaggcaaagcacctatacacataaaataaaatgaaactaatttttaaaaccctcttcaatggctgcagttgtacccaaaattctgaagatgtggcaactcattggactataattaccattgtactgaacctacctatgaattaaccccatcacttgttagatggtgcatatgtggtcaaagggatagcttggaactaaggagacagactcattgataaaaagctttgccacacaatcttgaggactggagtttggacagtccatctgtaattatagcactcacaaggcagagacaagggtatactggaacaagctggctagccatgctaatcatatggacaagatctgggttcaactgaaaacccctaccttattgaataaagtggagagtgatagaaggagactcccaacatgagctccaggcctccacatatatatacaacaggtacacccataaacactggaacatggatatacacacacataagacaaatcaaataagaaatgatagtttgctcctagtacttggcaggtggcagcaggaattcaaggaaagcctcagatacatgcttaacttgaggccagcatgggccacatgagcctctgtctcaaaaaataagatgaaaaacacaagtggcctgtgagattttttggggggggagggagggtgcctagtggttaaaaaatttgttttatagctgtggctgtgtagtcaacaatcaagtgttgagggggagaggttcttgagctcccacctgtaactggggagctatcaagagtgtgcggcttctgggagaggcccttcataggtcaaccatgctccaagcacaaatgcgtcttgagttacttttaaaaagaagacaacatcagggagttaaggaagcagtagtgggtctgggaagagctaaggaagggtggggtgaatgattacagaatattatatgaaattctcaattgaaaatattttaactaccttgtttggtggtggtggggcactgaaaagatggctcagtcattaagggcgtatatttccagctgactagagttcagttcctagcacccatagcaaagaacacatacccacctatagcttcagctccaggggatcttatgctctcttctggcttccaggggcacttgaactcatatacacaaactcatatataggacacacacacacataaattaaaaaacaaaacaaaacaaaacaaaacaaaacaaaatcttagagaggctggagagatggctcagcactgacagctctttcagaggtcctaagttcaattcccagtaagcacatggtgactcacaaccattttaatgggatcttctgatgggtctgagaacagctatagtgtattcatatacataaaataaaatcttaaaaaaaaaaaaaacactagccgggtggtggtggcgcacgcctttaatcccagcacttgggagacagaggcaggcggatttctgagttcgaggacagcctggtctacaaagtgagttccaggacagccagggctacacagagaaactctgtctcaaacaacaacaacaaacaaacaaacaaaaaacgccgggcatggtggcacacgcctttaatcccagcacttgggaggcagaggcaggatttctgagttcgaggccagcctcgtctacagagtgagttccaggacagccagagctatctcgaaaaaccaaaaaccaaaccaaaccaaaaaaacccaaaacagaaaaaaaaaacccaaaaccaaaccaaaccaaaccaaaccaaaaaaaaaaaaaaaaaaaaaaaacccactaaatcttagatcaggcagtggtcgcacacagctttagtcctagcacttgggagataagttaaggcaaatatctgactttggggtcagcctgatccatagagtgaattccaggacatccagggctacacagagatactttgtctcaaaaaaatatattgtgtctaaagcatgtggtatcttcagcaatagcctatattgtttcaggagtcacttaaactcccctgacaacttgttctcatgcctggtattgggggattttgctaggtagtctataactcttatggggagcattcttaccctaagtggcataacttcaattaaaatatatcaaacagacactattccttgatgttttatccaacatccttagtgttatttgtccctcttctttcctcctgtattgatgtgccttcccctctccaattaaagccccccccacataccgtctttcccattttccccttcatgtcatctgcatcctgctatttctctctctagtacccctgcccatagtccctgtttcctttcctgatttctgtgcttatatgtatgtgtatctgaatatttggagctgagagagatgagtatgggttacctcactcgatccagtattttttccattgtattcatttaactccagatttcataatttcaagcttcatctacacggaatagtaatagcttttatactatcaaaaggtctatacaagctgccaagagagggaagcaagtaatagctctaatcagttgtgacacctatgaatcataaaaaccagcatggcaagatagccctaaaggtaaaatgtagtgaggattttggtttttttattttaaaaaatacagaaatagaaatgttcttttaatcccaggtgtggcatgtgggactggtttggactgtctacagcagctgcctataatttgcctcatgctttagcaggagtgtgattttaccagctgcagatagtttttatgattgtgtaacatttggcattctggggactttttggagggcatataaatgctaaggcctcaagaggcagaggttttttgtttgtttgtttgtttgattggtggtggccacagcttgttaaatagttgtgcacaaagaagaaagaagttagatatcctgactgtgattcaaacttgcctgaaggaactcaatgcccctaatcagcaggaattagtttaataatgttgtccctttcttttttttaaagattttatttatttttttacatatatgacgagtacactgtagctgtcttcagagacaccagaaggcatccgatcccattacagatggttgtgagctactgagtagttgctgggaattgaactcaggatctctggaagagcagtcaatgctcttaacctctgagccatctctccagctcctgttgtcccctttccaacccctgagtttattcagggatttctttcctttctccctctacccttttttccctctcctatctagtgttagggggttgaaaaacccacaaagtaacaaaagaatggctatagtgcaatagtggcactcataacttggtgttaaaacaagagctgtttaattggacttaaggcctgctcaacaagagaaatcatgtctggtactagaaatctagcctagagaactcagggctggagaggtcatgggtctcagaggagaaccaaccatcacagctttactagaccaacataattcctgtgttctaaaacttatacccacagataagtgtagctctcagtacacatctaagaagcttctctttgcagcagggttagggttatatagaaactggttataatgaagaaattaaccaattgtagagagattagcctcaacaaaactcctgcacctaaggctaagagaactttgtggaataggagacaaaaagattctaatagaggaccaagacatctgtgatattgtgtctcttagaaatggcaaggaagtcacaaccatgacacttcaacaatatggctacctaatacaagacttgaacatcgatgatatcaatagacatactaagaatggggaaatctaccaaggtcccaactctagcaaagaactataggcatcaaatgactgctggaaaagaattagtctctcagggatggacagatggttcagcagttaagagcactagctgctcttacagggtcttgagttcaattcccaacaaccatctgtaataggatccaatgccctcttctagtgtgtctgaagacagctacagtgtactcatataatatatatatatatatatatatatatatatatatatgtatgtatgtatgtatgtatatgtttttcaagacagggtttctctgtgtagccctggctgtcctggaactcattctgtagaccaggctggccttgaactcagaaatccgcctgcctctgcctcccaagtgctgggattaaaggactgcgccaccactgcccggcaaaataaataattttttaaaagtgcagttttgaagctagatgtgatggtgcatgcctttaatctcagtattcaggagatagaggcgggcagatttctatgaatttaagaccatcttggtctagagttccaggccatccaagctcaggtctcacacagtgagaccctttctcataataggagaacaaggagggcaagataagttgatagtgctgtaaagatagatttttctcggggctggagagatgctcagaggctaagagcacttgttactcttgcagatgacctaggtttggttcccccacatggtatctcacaattgcctgtaactctagttgcaatgtcctcttctggcctccatgaatacctgtactctttctttgttttgtttttgtttttatttatttttaaagatttatttattttcttttttttgggaaatgttttaaaaagatttatgtatttattttatgcatgagtacactgtagttgtcctcagacacaccagaagagggcacgaagtagcattacagatggttgtgagccatgtggttgctgggatttgaacttaggacctctggaagagcagtcattgctctttaccgctaagccatctctccagcccccacatacctgtactcttgtatacacacacacacagagagagagagagacagagagagagagagatttaaaaattaatgttgggaaaaaaggagggctgaaagtatggcttagtgcttaagagcaactgttcctcttgcagaggaccctagttcaattcctaacacccatgcattgactcacacccaaggaaagagactaaggcctgggaaaagaatctgctcctgtgacaactctccttagccctgaaagcaagactagtagctgccttctcttttggatggcagtaggaagggtcagaaaggtcatgcctcagtaatgagaaaagcctacttctatacacagctgctctgctccatgcagcattccctcaaagtaacatacaaaggttcatataccctccaagggatacaaagaagcaggaaaactcaactcagatgaaaggaaaaaaatattagtagaaaggaaaaggtacaatggcttttattctgagaaacataacctatacagaaaatctgatggcatgtacaaataaaccactgggctgagggtagccacgttgtagggcatgttttatggggagttgatgtcagacacttttccttacaaggtggagaagctaactaagctctatttctgggttatttgtttttacataaacaaagttttttgggaggggatgtactggcatttggtttagggggggaaatattagcagcgctaagaatttgaaaaaaacagtatctggtgggtagacttactttcaggagtacatttactagggtatgtcgagaacattcaaagaaatcttactaagagctcataaactaatcaagaataatcatttgttcaaacatgtatttacaagaatcatatccaaattatttctcaggaaacaaggcaggagaatcagtggttcaaggtcatcccagctatttaatgtgtctgagaacaagctggggtatatgagactcttataaaataaaagaaaaattggaagaatgaaatgattttttcgagacagggtttttctgtgtagccctggatgtcctggaactcactctgtagacctgcctggtcttaaactcaaaaatcctcctgcctctgactcccaagtactgggattaaagtcatgtgccaccacgcccggctgaatgaaatgatttttaagtattcaacaattacattaaattgcaccacatatatgcctatttcagtgtttaaaaattattttttatgcacaagccgggtttaatggtgaatgcctgaggtcccagcagcacctgaaagtagagatgaggataagaaactgaagagtttgaggccagcctaggctatgagaccctttctcaaaaaataaaaacaacttggctagaaagaaggaaaatgcactataggtgaaaaaaaaatcttaagaagaattataatgctaaacttaaaatttttatttatttggtgtttgtggtatgcatatgtgcaaacactctccaaggtcagaggacaacttgtaggagttggttttttcctatcactttgtaggattcaaaccaccatagcgcatggaattttaattttcctgtatttctgaaattatcctcattcactttcttctaatatatttttacagtactgggaattgaaccaaagacttcatacattttaaatgaatactcttaccttgtactaacaaacacctgagccgggcagtggtggtgcccacctttaatctcagcatttgggaggcagaggcaggtggatttctgagtttgagaccagcctggtctacagagtgagttccaggacagacaagactacacgagaaaccctgtcttaaaaaaaaagaaaaagggctggcg

SEQ ID NO: 83 - DNA, 14463 bp, mus musculus
cagtgtgtgggcggcggcggttgcagattttgcagcgtgcgaggcgaggctgcggggccaagcgaggggggcggctgttgggcacggggcgggggggcacgtccacgtggccacgggtggccaccccgagtcagtcgcggtggagggacaggtaggtggtcgccatccttaaagcctgtgcgccaatagtctgctggatggcagaggtttcagacagcctgggggtccagatggtttctggggtcaggccctgtccctccctacctctccagaccaggcttgccaagcactccgtaccctgagcgggaagagacagccaactcgatcatagtcctattggttgatagaacccttttgtagaggaggagcagcatctctgagcattgctgtagcctctgtattgactaaggtatctgcgggtctgctcagggtgcccccattgggggcaggactggttgggttcatggcatagaggggagcattgtggaagagcgggctgtggacctgcatatttatatggagctttcctcatcatcgcgctctttgctggcaggactgtagcagaggggctgggtgcgactgtgatgcttgaggttgccacttagaggtgggggctggggtggggtcttgggctgccaattaccactttccaggtctcctttccaacctgtcccggccagttcctaaaatttggcttttctgtagagtgtagaagaggtgaaggtagggtgcagtcgcttttctcttttgctttcctttcttctctggttgttgcatgaggggtctgggatgcagacccgacaaaagagccccagagcgctgatcactctgagctgaaacttggcactttcaagctggaattgctccatgttctagcaaatgctggcttttctttctctttgctgtggcccccaccccccaccccattctgagtccctcctgtgtctcttgggaattgggcactgagagggtagcactgagctctgccccattagttacagagacactgctctgctgtctttgcagcctggggctggctgggtgtggcccggggggtgaatgccagcattggccctatttgtttaggggaaggggtagtactccatagccttaaggcttcaactgtatttgaggatgctggtttctacatataatacttctgggactctcaaaagtgggttatacccttctgccaatatccctctctgactaacctttggctcttcagggagagccacacaggcctggcagagcatttgtctgcctgtgtctgagcaaagcttgactgatgtctgtctcagcgagagtcttggctttgtgttgcagtggaaaggccagacagcagactcctggataagcagccaaggccctcaaagggagaaagcacctgaggccatgagttggagatgtagtggcactgaaaccagtctcaggccttaattctccagagctttgctctaggactcctgctagcagtgccactaacagagaagcacccctgaccccaacttgtgtttgttctctccctgcatttcctagtgtgtaatgttagggtcccagttctgggagaaccttccattccatcttttctagcagctgactctgatgcccccttgggtgtggcccagttgagacaaggcctcttggcttctttccagtacaggagtgggagatgattgatggcctgcaagcttgcctgtgcttgtcactcattcatttgccctattagaggcccctcccctctttcagcctcagtcaccatctggggctttatcatgttggatgagttgcctgcccctcgatagcactgaacctggcctgccaggttcactgggtcagacagggcagaaggagggagagtagcttgggcctggggctgatttgcacttgctgtctctcctcaggcctgtccctcgttacagctgctggtcatgcccactgtctgccttctcccattgctattcttcaccataggagggtgcctgggtagcagcaggccatttcgtacctttgtggtaacagataccactctgactcacctggctgtgcaccgagtgactggggaggtgtttgtaggtgccgtgaatcgagttttcaagctggctccaaacctaactgagctacgggcccatgtcacagggcccattgaggacaatgctcgctgctacccacctcctagcatgcgtgtgtgctcccaccgcctggtgcctgtggacaatgtgaacaagctgctcctcatagactatgcagcccgtcgtttggtagcttgtggcagcatctggcagggcatctgccagttcctgcgtctggatgacctcttcaagttgggtgagccccaccatcgcaaggagcactatctgtcaggggcccaggagcctgattccatggctggcgtcattgttgaacaggtccaggggcctagcaagttgtttgtgggcaccgctgttgatggcaagtctgagtactttcccaccttgagttcccgtaagctcatcgacgatgaggacagtggagatatgttcagtctggtgggtgagcttgttgcttttgtcttctttcccctggttcttatgagcccaggtcttattcactcctttctctcagtcctggccctgcttcttaggaaaactttggtttgagagaggaatttatgacccttcactgtcacatagatgtagaccagctgttgaggacaggaagatgggcagagtttacctgtggaaagtctgtctatagagaggctaaggtcaccttgcactctgtggcatggaatccagtaattgtccaggtggggcagatgggagatcactggggaagcctttagaaaaccgcattgttggaacagggttgggaagtgaaggtgggccttcaccctgctctcatactttgttctaatctccaggtgtaccaggatgagtttgtctcttctcagatcaagatcccttcagacacattgtccttgtaccctgcctttgacatctactacatatatggctttgtcagtgcctccttcgtgtacttcttaacgttgcagctggacacccagcagacgctgttggatacagcaggcgagaaattcttcacatccaagatcgtgcgcatgtgtgcaggggactcagagttctactcttatgtagagttccctattggctgctcctggcgtggtgtggagtaccgcttggtgcagagtgcccatctggccaagccaggcctgctattggcccaggctctgggtgtgccagccgacgaggatgtcctcttcaccatcttctctcagggccagaagaacagagccaacccacctcggcagaccatcctttgccttttcaccctcagcagcattaatgcccacatccggcgccgaatccaatcgtgctaccgtggagagggcacgctggccctaccctggctactgaataaggagctgccctgcatcaacaccgtgagccctttgcttgccctgctgtccctgtgccggatatgacagctctgtggctttctgcctttctgctgagtggctgtctgtccagtcctaggcttggcatgatcatgggattggcaacttagttttgacacccacactaccttacttgagagccttactctcttttctcttcttttctcttggccagtgtcctgtttgtatactgccattttccttttctgcctctatattcattcccacctttctccttgctctatctcaagtctaacagggtcaggcttctcctccttgccccgactttccatccccagtcccattttcccatggggtcctaggggaaacaaactgtcaagcatgtctggagggcagtggcttccaggttctgctcctttacagaatgtgaaatctgatagcatctgtttagcttgaactctcactcacccctcctgtgtcaccagcctctgcagatcaatggaaacttctgtgggttagtgttgaatcaaccattgggtggcctacacgtgattgaggggctacccttgctggctgacagcactgatggcatggccagtgtggctgcctacacctaccaccagcattctgtggttttcatcggtacacgcagcggtaatttgaagaaggttggtcctagaacccttgtcttatgtgattggggatgtttttcacactatgggaagaagggctgagggacagaatgtgaacatgagcctggataaccctgaatagggtgtaataacttcccaggttaggctccaagaactgaatcctgttcctttggtggctcctctgccatctaccttcgccagcattgttcgaaggtagcatttgtcttagtctaaggctatggctgttggaactataagcctacaaactgaatacagactcaaggaggccatatctgaccagctcaactgtaatctagaaagtccctggccgaagagcgtgctctgggtgcagggagctatggtagcatgaagctggcttgtcattttctctgtcctggtcttgtggctcaggtgcgggtcgatggctctcaggatgcccagctatatgaaacggtctctgtggtgcagggcagccccatacttcgagacctgctcttcagccctgaccaccgacacatctacctcctgagtgagaagcaggtgggcccgtggtgggtggtggtgtgtggtggggcaagggtgggctgtgtgctgatgtggctgtccccaggtgagccaactcccggtggagacctgtgagcagtatctgagctgtgctgcatgcctgggctcaggggacccacactgtggttggtgtgtgctacagcacaggtgagggaagagggtgtgggatgtggggcagcagtgggctccctggggccattatcttgggagacagaggatttaggaggaccttgccagctggacaggagccagccacacttgctatactttccttcacccacctgcccagtttttcccagccttgagccttcccccctcccttctcctccactttctccagctaatgagcggaacttctaccctgagtgacgtcccttggatctcaggggatgaggccaaggtacactgttgcctggcagtatgagctgggtatgctgtcttctgtcccacctcagcctcttactgcacccccatctgggccctcctgggacagtgctcggactgctctggcctgtctccatgcaggtgctgccgtgaaggggcctgtccaggtgcctctgccccacatggctttgcagaagagctgagcaaatgtatacaggtgcgggtccgtcccaataatgtgtcagtgacatcctctggggtgcaggtaagtgacatagaggatacttggccctgtatatgcttcatgagggagggtgcaccctgctctgaaccctctgccttccccagctgaccgtagccatgcgcaacgtgccagacctcagtgtgggtgtgagctgttcctttgaggaggtgactgaaagtgaggctattctgctgccctctggagagttacgatgtccttcaccatcccttcaggagctccagacacttaccagagggcatggtcagtgggatggggcaatctggggtgttgtggggcagggcagaattccagactagttggcaatagccatctggcttgctgcaggggccactcatactgtgcggcttcagctgctctccatggagactggtgtgaggtttgctggggttgactttgtcttctacaactgcagtgccctccagtcgtgagtacctggtccagaatctgtccctagccctggggatagtagataagtgctctgaaatatataaaaattgcactgtaactttctctagggttcaggggtgagttgttgggacttcctgctgtcgccacttctgtctagtcctgatgtgccctatgtggcttgggcaggttctgcctaccctattcatttgttccccaatgtgtcttgtgggtgggtgatacaggtcggtatgacctctgttatttctaaagctactcccccctccaggtgtatgtcctgtgttggcagcccttacccctgccactggtgtaagtaccgtcatgtgtgtaccagccacccacacgagtgctctttccaggagggcagggtccacagccctgaggtgaggtggtgcagtgcaccgtggaagaggctgggctccttgggggctggcctctcacattttttgtttgacctcccatttccatgggcctggagaaggcgggtagaccagtgtgcctctaacaagtgttctcctcccagggctgccctgagatcctgcctcaaggggacctcttgattcctgtgggtgtcatgcagcctctaactctgcgggctaagaacctgccacagcctcagtccggacagaagaattatgaatgcgtggtccgtgtacagggacggcaacatcgggtacctgcagtgcgctttaacagcagcagtgtgcagtgccagaatgcctcggtaagacccagagtgcagggtgggccagccaggaataatttgttttgtttgtttgttttgttttatttttgtgttttgtggtgtgtgtgtgtgtgtgtgcgtgtaatattttactgtattttgtatttggttggttttggtctatgcctagcttacttatctggaaacctttttttttttttttttttttttttttttttataagggattcctaaagtgggcaaggattttgctcatcttatttgtgctcatgtggttccatttttcttagtacttctatgaaggtgatgagtttggtgacaccgaactggacttctctgtggtttgggatggagatttccccattgataagcctcctagcttccgaggtgaggggtgacatggggccaaggagcatggctcctggggcaggattggcactgctgggggcaagtctgtaggtcctagagccccctgcttttctgccattgcctgctccatcagtagtctcctgtgcctgcagcccttctttacaagtgctgggctcagcggcctagctgtggcctctgcctcaaggctgatccccgattcaactgtggctggtgcatctcagagcacaggtgccagctgagggctcactgcccagctcccaaaagtaactggatgcacccaagccagaagggtgcccgatgcagccatccccgaatcacccaggttagcttcacctacaaatcctaccttgcttgttaggcatgtgtgagtctggcctgatcttcttgcttcttctcctgctctgcagattcatccacttacaggacccaaggagggtggcacccgggtcaccattgtgggtgagaacctgggcctcacttcccgtgaggttggccttcgagtagctggtgtacgttgcaactccattcccaccgaatatgtcagtgctgaaaggtgagtgtggctatgtgagcaccctgtccttgtttaccacagctggtcctgaccttctgtgactcttaggatcgtatgtgagatggaggaatcgctggtgcccagcccaccacctgggcctgctgagctctgtgtaggggattgttctgctgacttccgcacacagtcccagcaactctacagctttgtggtgcgtggtctaactagccccttccccttccctatctgggaaaatgtggagtgtcccttggatcaggctggcttctacctcctctcaagggctgcttcttcctcagacccctacatttgaccgtgtgagtccctctcggggcccagcttctggaggcactcggcttaccatctctggaatttctctggatgccggcagcagggtcacagtgattataagagatggcgagtgccagtttgtgaggtgggcctgagcacaagccatctggagttgagcactgattgtgtgaaagactatgggggcagggtaggtgaaggtgccaggccatctgcttcatgcctacctgcttacctgtgtaggagagatgccgaggcaatcgtgtgtatctcacctgtctccaccctgggccccagtcagagccctatcacccttgccatcgatcatgccaacatctccaacactggagtcatctatacctacacccaggaccctacggtcacacaccttgagcccacctggagcatcatcaagtgagaccctgaggagaatggggttgaggactgagttggggctctgagagtcttggggccttacctattactggggccttgggtcatcaagtggttcctccttcctgagccctcatcagtaggggccacagagttgtcctgcccatatagagcctggcacctgctgaatgaaccaaggtcagaggctctgagctctcagaaaatccttggtaactttggacagggtggggaagggagtctgagctctttacccatctctgcagtggaagcacctccatcactgtgagtggaacccatctgctgacagttcaagaaccccgtgtacgagccaagtaccgtggtattgagaccactaacgtgagtagtgggtttctacccctgttctaccattgctactcatggcttcatgcgctgagatgattgctgttgtcttcacagacatgccaggtgatcaacgacactgcaatgctatgtaaggcccctggcatcttccttgggcaccctcagcctcgggcccaaggcgagcaccctgacgagtttggcttcttgctggaccacgtgcaggcagcccgctccctcaaccgttcttccttcacctactaccctgatcccagctttgaaccacttgggccctctggtgtgctagatgtcaaacctggttcacatgttgtattgaaggtgctggggataaggatagggagtagaaaggaggggaagaaccgagagctggagtgcttgactgtttctgtgtgggttatccactactagggcaagaacctgatccctgctgcagctggcagctcccgcctcaactacacagtgttgattggaggacagccatgtgcactaactgtctcagatactcaacttctgtgtgattccccaagccagacaggccggcagcctgttatggtgggtatgggctcaagaggccaccagggcagccctggctgtgcatgggagttggttcacctcaagcttgcccttacaggtgctggtgggtggcctggagttctggttgggcacgctgcacatcactgctgatcgggcactgaccttaccagctatggtggggctagcagcagggggcgggctcttgctgctggccatcactgttgtgctggtcgcctacaagcgtaagactcaggatgcagaccgcacacttaagcggcttcagctacaaatggacaacctggagtctcgtgtggccttggagtgcaaggaaggtgcctaaagcagggggtgtaccacattgtgtgagagctgagggactttcctgcttcttgttcaactcactctaccgtattgtttcccagcctttgctgagctgcagactgatatcaatgaactgacaaaccacatggatggtgtccagatccccttcttggactaccggacctatgctgtgcgcgtgcttttccctggcatcgaggctcacccagtgctcaaggagctggatgtgagcctcctacccccaaagcctgcccatattctgttttccccagagccaccactacctactctctgagattccctggtccccacagactccccccaatgtggagaaggccctgcgtctatttggacagttgctgcacagccgtgccttcctgctcacctttatccacactttggaggcccagagtagtttctccatgcgtgaccgtggtactgtggcctcactcaccatggtggccctgcagagccggcttgactatgccactgggctgctcaagcaactgctggctgacctcatagagaaaaaccttgagagcaagaaccacccaaagctgctattgcgcaggtatgtaactgtcttgcttggcctctcctccagtcctgtcttccatttcctgcttgggcccctacctctgttcaagtctcacccttgtcaggccagggccttaggacctatctcttaccataggacagagtcggtggctgagaagatgctcaccaactggttcacattcctgctgcataagttcctgaaggtgtgctggggtgggctgggtcgcaggagaggaatgtccgggggtgggagcaattgattgataagccagacaggcagccagctatgcccctaaccctgggtgtaggagtgcgccggggagccactcttcctgctgtactgcgccatcaagcagcagatggagaaaggtcctattgatgccataacaggcgaggcccgctactccttaagtgaggacaagctcatccggcagcagatcgactataagaccctggtgagcatgggactatgcgagcaggaagtaaggtggagccttgcttaggaatcatgctgaggttccttcactcttagactctgcattgtgtgtgcccggagagcgagggcagtgcccaggtccctgtgaaggttcttaactgtgatagcatcacccaggccaaagacaagctgttggatactgtgtacaagggtattccatactctcagcgccccaaagctgaggacatggatttgggtaaggtccctcccttttctcctagctcccacctatccaatccctcccagggagctctcatattctgtatctgagctctgttccttaaaaggaatgtgtctaagtccttgtgagggtgaatttccctaagagctgactatggcctgcagaatggcgccagggccgcatggcccgaatcatcctccaagatgaggacatcactacaaagattgagtgtgactggaagagggtcaactcattggcccactaccaggtgaggaactttgaacctattcagctccagggacacctagaagtagtggccaggtctcctctcgtcccttatccctatactcatgagggcttctcatagggccttgattgccactgtacatatatatactgaagagtatgaatgaatggtggtcccctggctccttctgtttctttggacctccaggtgactgatggttctttagtagcactggtgcccaaacaagtgtctgcctataacatggccaactcgttcaccttcacccggtcacttagtcgctacggtaggtatccatattgtggtggctttcctggtcccgtgccctttaattaaggctgtatcttaggaatccccaagtagctgtcttgatccatttggaaagactttcattattttgggcccctgggtggtcttcagttgtatagagcctaatagggaggggtggcaaggataggtgggtcccacaaagacttctagaagataatggagcaagagggtgggtaatggccagagcctgtagggcttaagagtcacatctgtcctctgccctagagagcttgctccgtgctgccagcagcccggatagcctccgttcccgagcacctatgctcacgcctgaccaggaggcaggtaccaagctgtggcacctggtgaggaaccacgaccacactgatcaccgagaaggagaccgcggcagcaagatggtctcagaaatatatctcacaaggctgctggccaccaaggtgtgggcctgccccatagacaccttctagcccagtcttaaacatgagatgagctgctttcttagggccttggcactaggacctctacgcctgaggtcaagcaaaggtctattttaggaatgttggcccttcagagaagtttttttttactgagctattctgccccctgtctgtcagattttgggaacttcctgacatggttcctttaccatcactcatagggcacgttgcagaagtttgtagatgacttgtttgaaactgtgttcagtacagcccaccggggctcagccttacccttggccatcaagtacatgtttgacttcctggatgaacaggctgaccagcgccagatcagtgaccctgatgtgcgtcacacctggaagagcaactggtacttactggttcctgactgctgctggctcttctgagggtgggtgggaggaagaggctagttacttagccaagcctccaggccaatggagacaggttgactagcaactgaatagccttccatgcaggagggatggaccagtggtatggcctggaagtgaatatgagtatatagaaggtgggtgctgctgggttgtgcagatgggaagtgctagtctagcactgggattgaccatttttctctagggtcctgtgcagggtagagacactgatggcttggcataggtggagacagtggaagtttcaggggtggaggttgaggacagaaagccatctattcttatttctcattgcctgagtgcagcagaaggttaaagaaaaacccatttatccaaaatagtctctcctgttacttcaggacaagatatgacctggccaaacaggacaaggtgtgaaggaaggcagtgggggaagggggcacatagggccattagggagtctcaagtgtatgtccctctgttcagcttacctctgcgtttctgggtgaatgtgatcaagaatccgcaatttgtgtttgacatccataagaatagcatcacagacgcctgtttgtcagtggtggcccagaccttcatggactcctgttctacatcagagcaccgcctgggcaaggactcaccttccaacaagctcctctatgccaaggatattcccaattacaagagctgggtggagaggtgggccctgggatactgctgtgtatgcctggtggcaggcaggaactgcctaaacagcctgtctgaggctggccagatacaagaaaaagcctcagaggctggccaaacactgatggcatgagttttggcatttatgacctgtgcatgattcactcacccaaggtctctataggtactatcgagatatcgcaaagatggcatccatcagtgaccaggacatggacgcctacttagtggagcagtcccgcctccatgctaatgacttcaatgtcctaagtgcactcagcgagctctacttctatgtcaccaagtaccgtcaggaggtacgttgatgtacctcatggacccccagttgcatggctctgatgatgatacagttaggggcaaaggcagggagatgtgttgagaagcacacaagcatgtaagcaagatgggacaaagtccatcttatatcttgtttacagtccatcccttgcctagggccagcatgggcaataatttctttagatgctaggatttaaggaatacaggagacaatgcactagctggaatatagaggtcccactggataaaggttacaagactggaaagtgagaacagatgtattctaagcactcatgttaaaatattggatgtggtggcatgtgtgggtatgggtgctggtgagtggtttagataggcagattcccataactcactagtcaatcactgagttctatgttcaatgagagatgtcaaataataaggtggaggggctggagagatgattcagcagttaagaacacttgctgttcttccagaggacctgagtttgattcccagcacccacaaggcagcacatatccctctagctccagttccagggaatctggtctccttctgtggcttctgaagacactagacacacatgatattacatacatacatgcaggcagaacacctatacacgtttttaaaaggtggggaatgataaagacaccaggtattgaacctctggcctccacacacatgcatatgtatccatatgtacagctgtacacagacaaatacagatgtgcaggagagatcaggtacactaaagataaagccctagataggcatggtggtacacacttttagtcccagcactcaggaagcaaagacaggcatatctctgtgattcaaggctagcttggtctacaaagcaagttctaggacaattagagatacatagtgagatactatatataaaaaggagctcaccaagggagatcaaggggctatagaggagatctggccaagcacagcattctgggcgactcacaggtcaaagaggaaagagagaactggtcgggaatggggaggggacccagaagtacctggtagtatcagcctcatatcctgagccaggatcaagaaggatgtcatggccaaatttgccaaagagatgttggagtttgggttaggagggaacaggaattgaaaacagcaagtattgcccactctccaaagaggctacaatacaagagccatggtagaagagttggtggtggtatttgcagacaaggggaagtgggtagttttggtgagaggtttggagcatgaggctggcacagggactgaagccaatgagggaagagcacttctgggaagcaggggctttatgcagaagtagggccctgccttggagtcttgctccaatggatcatcatcctctagatcctcacctcgctggaccgagatgcctcttgtcggaagcacaagcttcgacagaagctggagcagatcatcaccctggtg

SEQ ID NO: 84 - DNA, 292 bp, mus musculus
agcttccggaggataaggcgggttctgggccgcagcaatggcagaggcggcgggctggtaacgcgaaggtgggttgaaaggaggaacagcagcagacatgcagacagcacacacaggtttaagccacactgcagatggcgccgatggtcagactagccgctgttgtcctggtaatgcaggcacaaaggcagttattcccagtggagctcaccctgttgcaagagcactggaagcctcccgaaattccagcaaaagcatggtgcctttaacccaaaggcctggaacccgacat

SEQ ID NO: 85 - DNA, 292 bp, mus musculus; identical to SEQ ID NO: 84

SEQ ID NO: 86 - DNA, 24184 bp, mus musculus
ttacgacaccggaagccggaagtggagttttccactgcagagaagggaagggtgaccgcctgactaggactttctaggagctccggttctgtcggagcggtcggatccctctgctcctgccctcttcacttctggccgactctgctgacaggtgtggtcctcttctccaaagacagggctccatcggtggctgtttcgtagcttccgagactccagaggtccacacccttccccccaccttaggcccagtttgttctgccgcaagcttctaattattcgctacccagattatttaggctagtcggattgaatctgcccttcccttcactgcagctgtcgcctaagggcttggcccctagtgctagaactctttaggtagcagacattttctgttgatcaaactgtttctgaaacacgttttgcactgtaggccaggtagacctcgaactcaaagttctgcctcagcctttcgagtgctagagcaacaggtgttcgccatcaggctaggctgtttatcaaacttgagtgcatttgaagtctttaaaaagttttcacgtgtaccttcacaactaaaggtcttaccttctgcacctcagtttactttgcaaatgattcatagtaatctgtttgcctgtcctcataacatttatctgacctgagaaggaatgtgttgtcttggcatttcctaggaaaaaggaaggaccagagagggcaagggagaatagttggtggagaggaaggaagggagtataggtggtataggatcttgtaggctgttgtatggactttgctttttaacactaggagaaatggaaactctgaaagagttcatggtagagaagagaagtagtttgagttatttttgaggtaattggccccagtggggccaattaactgcaaagggccattgaaaaggcaaagcatggtgacccgtaaagagattattgcagtaatgcaggtgaaagatgatagcgctgtcagccttgaattactgaaaaaatttaaaatgtacaaaagtagaaataataatatagtaaattccatgtacacatttcttagctgtgactatcagctcatagttaactttaatccacaccccattacaatcctttaccatgattattttcttttctacagaagatgttattttatgtgtataggtgctttgctatgctttcctagtgcccaagggagtcagaagaaggtttcagatccccttggattggagttacagatgtttgtgagccacatctgcaacaacaagtgctcttaatccctgaaccattatctctcttgctccacccattgcgattttcaataacagctttcttgagacataattggcatgctacaaaaattactatttgtgtgtgtgccccccacatgcatgcatgatgtatgatttgtacagggagcacaggtgccatggctagaatgtgtagagctcagaggacaacattgagtcagctatcttctttccacctttatatgttctcatgtctccaggcttgcatagcaagggcctttatccactgagctgtctcccttgcccatacttcaatatttttttaaacagtctcttctagatcccttccctttgagtttctaatcccctggagctggagttacaaaaggttgtgagttgcccaacatgggtgctgggaactgaacttgggctctctggaagagcactgagtgctcctaatagctgagacatctctccaacttcttttaagacttctagacatccaagtagttttataaatatctggaatttaggaatgagaactgtttgggatattatcaacattaagatttgggttaaaagccatgagaccggatggaattactgcaggggtgaatgcagttaagaaagaagtcccaaagttcctcaacgtgaagaagtggggactcaggaaaagggcctgagcagcatcagcctttgagggagtgagtcaccagcagagaaggcttttctggaacctgaaggaagaaagtaggtgaaaaagtggggagggtcagttgtgtgggctcaggcagatggacctatgggtagcaacacctttagtataaatagccaatattccccagtgttacaggaggtctcccttattgaaagcccacttctggaaacttgcattgagatcattctcttcctggttgtcagtatgaggcaggatttacaaggtctccaggttagtattgtcctgcatattctctggtttaaaagccagcataagcagatcaggggtcatgtgtctcggacaccccagttcacactttcacacttcttagagcaaagaagtcacaagaggtctctatccccagtgaacacttttcaggtacaatgtggtctcctgaagtctcttttatcatgtgtttgtgttttcttgactcctgtaagaagtgaccacaggccaagtggcttaaaagaacagaaaattgatatctcacaggtctggaggccaggagaataaaaccagaaggtgaacaaggttatgcttcatctgcaagctgtacaagagtatccttcatgtgtcttatagttgtgggtagctcagttgtttcttggcctgtggttatatcaatctagttgagtaataaggtacttgttactgggctcatggcccacctatataacttgcagtgatctcaatttgagagccttgatttttgtgagacaggttcttactatgtagagcaagctggccttgaattcgcagagattgtgccttctaagtgctgggattaaagacatgcaccactatgcctggcttgaaatccttagtttaactacatctgtaaagaccattttttccaagtaaaaaaaaatcacatttataggttgagggattaggacatggatatatcaatcattccactatactgggtgagggaccaggaccctttgcttcaacttaaaggtgtgtggaggaggtaggattcccagtttacttcccctctcctccacaattctctctctttgcaatggtaatatttgctatgtcttagcccaaacttcacttttgtatcttgttccaccagacaaaatgtccatccttttgctgtgaatggaagtctagttgaacgaactctgttctttgtcatgcactcctactacccttttcttctagacactgtcctgttggatgaacaagcacccctggaagaaccagctgagtgagatggtgcagcccagtggtggcccagcagaggaccaggacatgctgggtgaagaatcttctctggggaagcctgcaatgctacatctgccttcagagcagggtactcctgagaccctccagcgctgcctggaagagaatcaagagctccgaggtaaagattgatgtgtgagggaggtatgaagttaaaagtcaggaggagcctgggatacttatataaggacaaagcttattgtcacctgcatcttgtaattggcaggatatgaggtcatgatgtgcccaagaaccatccagagtttcaaacttagctaccttgctttgttttaagtagggttctctgtgaagagtcacatgcagaagataatgtggttcaaagccagcaccagggaagggagaagggatggggaaggaggataagctaaaaagccatggtaggtaggggaagagtgggctataggaagcaatgagaataggtttattctttcttgggacatagcaagcttttaggtgggaggggatatggttttccttcagagagagagaggggttttttctaagatgaaatgtgtcctattcttggaagggtatggccagctctggtgagaggagatctttgagtatgtcttctgcactggcactgccttctttctcatgccaccctcatttgtaaggtggatgtttactgttcttcaatatgcagccgaagagaatgaaactcagaactactagcttgttctgtctgcaccttctgggcaaaaagaaagttgattttggtgtattcctttaagtgaagaatctctgtttagtaacgcattctagacacttgggggcatatcatcagtggaactggctaggaattggtttgacttcttagagaaaggccacttagtattataggagtgcctggctgttaggactcctatctcctttgctgtcttccctgtccctagacgctatccggcagagcaatcagatgctgagggaacgctgtgaggagctgctgcatttccaggtcagccagcgggaggagaaggagttccttatgtgcaaattccaggaagcccggaagctggtggagagactgagcttggagaagcttgatcttcggagtcagagggaacaggccttaaaggagttggagcaactgaagaaatgccaacaggtagctagctagtggacgggcaggcccttctgccccacctgtgtttgaagaccatagcagcactcatattcctgtaggaagtatgttgttggagtttcctcaggaccttttcaggcttgattgctgggagcactcttagaaccaagagaagccatcacactaactgttagtttattacagtaaaaggctctacatcagaatcttccaaggtacaaggcatatatggtaggagccaggagaggccagatgtgagcgtctcagggagcagtgcttttgctgtgaacggtggtgcactgtatatagagcattgtcaaccaggaagcagtcctgagctctgggagccaggctttgtcctgggctcaggctttgtcctgggctcacttttgaaggcatggagtgcttgggtacctgagctagcttgctcaggttctagccaccctgaggtctagcaggtgctataccatgtagtccaaggccctcacataccctggcatcagcccagacagcctggttgagtcctaggcccctgaaaaaacaaggcagtcacatcaggtaggatttcccagggggctcagagatgatccttaggagcctttggaggaattatgagaccctaggcctgtgaattggccctgtattacacaagcaccaaaggatggtatgcctagtgtggaatgaaagggtattacagggcctttttgggctggctggtttcaggaccctggtgacaatagttgagcagggattgtaccatctgagaggaccagtctgggggaaagggtagagaagacctgccataatcaagttttatattgtgggactaagttcataatgatgcagagagtgccttgtcaaagcatttcattcttatctggggagacagcagcaaggtaccacacagcaggggcttagataacagaggattgtctctagttgagatcagaggtctaagataaaggtatgggcaggcaggttcttcagagagctctttcaggtacttctccaagtatattgttagtgttggcaagccttggtgctccctaactctcttgtcacatggccttttctcttcagaaagttttgttatattttattttgggtagtgtgtgtgtctgtgcttgcactcacacatgtggatgtgtgtattgccatggggttcacatgtaggtgacaggacaacttgcaggagtcggttctctccttctaccatgtgagtcccaggcactgaacacaggatgttagcctttatggcaggcacctttcccacgtggacctgctaaattgtctcacagtcctttctttttatttttttattttatttttaggcatttttattagatattttcttcatttacatttcaaatgctatccccagagccccctataccctccccctgccttgctccccaacccacccactagtcctttctttttataaggataacgatgtgatgtgaaacataaaggtagacagttattagagctacgagaatagaatttgttcagtaactgatgacaatgagagagaaagagctaactgagctctggtgatttgcagaggtgattgtgtattttacctttttcttttttttttcaagacagggtttctctgtgtagctctggctgtcctggaactcactctgtagaccaggctggcctcaaactcagaaatctgcctgcctctgcctcccaagtgctgggattaaaggcgtgcaccaccactgcctggcttacctttttttaagatttatttttacctatgtgtttgggtgtctgtgtctgtgtataagtgtccttgaaggccagaagagagtctcagatcttctcaaactggaattcctggtaactatagacagttgtggtggaaggaactaaactctctggtcttctaaagagtagcaagtactcttaactactgagcaatgtctctacgcaatgactgggaatttcaaaatgagaataggggccagagtgtggctcagtaataaagtgtatgctttgcttgtgtgaggcctagagtttagtttccaggacttcaaaaaataagataaagacagaggtacagatagaaggaaatgaaagatttggataggggaaggagctcaagtgaatgccaaagggtattagtgtcaatatgataagaccagtgtgtttacaagcttatacaaatcaaatgtaggtttttgtacttgaagaccgggagtctgggttctttctgataattccatttaagagaagtagcactcaggtttttgagacagggttagggtcaaaggaaatacatgggctttgaggtgatagagaaaggaatcatggcaaaggttaggcctatgtcaagtgtcagtttctttaacagctctgagcatttgcaagtaggaactaggaaggggcttggtacattacacaaatgtgatcttaagctgttagaaggcatgctagagctagagagatgactcagaggttcagagcactgactgttcttctagaggtcctgagttcaattcccagcaacgacatggtggctcacaaccatctgtaatgggatccgatgccctcttctggtatgtttgaggagagctgcatatacataaaataaataaatctttaaaaagaaggcatgctaaagtttggttaaccttaaagtttgtctgagctgagcatggtttgtactcaggacagcttgtgatagttggtttcttttcttccatcatatgggttttgaaactcaaactctggtcatcagccttggtggtgagtaccttttatctgatgagccttcttgatggttcagctctcagtatttaaaaaattccagtctcctctcttattctgaaacttctcacctgttgtataatgtggactaggtgttaatttttgttgctgtctttgagtctagcctccttttacagagtctcaaaagagactgagaaaggttcactaccacttgagagtcaaggttggtgactggaggaaggcaaatagccattgggctaatgaggcttcaaagtaccaaggtttataggtcttgagaggcaggagaagccctccatatatcagctgcttgaaggctgccttaggtcttagaagtgccaaaagtgggaagcttgggagaaagcagtactgatagggaatgaccttttttcttgtagcagatggctgaggacaaggcctctgtgaaagctcaggtgacatcattgctcggagaactccaggagagccagagccgtttggaggctgccaccaaggatcggcaagctttagagggaaggtgagtggggaggggaagctaacccaggaggccccttccagggtttttaatgagacaaatgtaggagttctaggaattcctctctctgaaaggaaggaccgagtctttttagattccccagagccctcagggcttccttgtgagaagcctggtctggtattcagggatttagttctagctgttgctggaaagactctgagtctgtactgggtgcttagttagggcttccgttgctgtggaaagatagcacgacaatgacaacttttataaggaaaacattctatctggcttacattcagaggtttagtccattattgtcatggtagcaagcatgatggtaagcagacagacatgatgctggacaggtgtctgaaagttcttcatcgggattggcaggcagcaggaagagagagtaaaccagtgagcctagcttgagcatctgaaacctcaaagtccatccccagtgatccgcttcttttaacaaggccacacctactcttaacaaggccacttatcctaatccttttaaataattccactctctagaatcctacgggggccattttcactcaaaacatcatactgggatctagcttattctttaggaagcactgcagggcccctgagaccacactcaagagctcactatccagactgatatgcagtgggattctaccaaggcagaaagtcctaggtgaacaagactggatacattccacagcaaccctgtgaatagcacagagccctcatgaactacttctcattaaagactatggattccatgtttctgttgggagttgttcacgttggtatcctctgccaggcatgtaccagtatttctgaattctggcagaaaagtgagtttgactgactttgtcaactaatggtcttgggactgtcactcactctcttttgccaagggggttaggttgccacatgagatcatttagttacaggcatgggtactgttgtgcctctcatactgccttgctgctgtcctccatatagttagtgaagctaacaggccttctcagtgcaataggtagttattgtgtttgtggagtagtgggttggggctcctgtcctgtgggagggaggagagtttgacttgggctcagagagcactggtggtgggttggtggggggagggcagtgtgagaaaaagccaaaggggagcaggcccagtagtccagatctgccttgtcaaagttgggatgatctgctgtcagtggcttcctcaaagacacatggaaatgtccatcattgtctttgtaatgagcacacagggaggtaccagggtgttgaggctaacaccggaactagagtttaagggaaactgtggggtactgtaggccaggatcagaagatatgggtgatagaggtaagacaccatgagcttttacagtgagggtatagaggcagagatgaattctctgctgagactattgatgctatatcttgtcccatggggctgtacaacctaggtatggaacctgagcctctagtgagggtgcctgggactagagctaaactgtgagttgcacagtagttcctgcctatccttgagtccagtgctaatgagctcacagccttctcagggtgttctttttttgttgcatgtcaggattcgagcagttagtgagcaggtcagacagctggagagtgagcgggaggtgctacagcagcagcacagcgtccaggtggaccagctgcgtatgcagaaccagagcgtggaggctgccttgcgaatggagcggcaggctgcttcagaggagaagtaagtgcctgggagggttggtaccaagagatctcagagtgtggaggctgccttgcgaatggagcgacaggctgcttcagagaagtaagtgcctgggaggcttggtaccaagagatctcacagcacccgtggtgctttctgccttttagggagccctgatagggactgattgtgtataaaagggctgatttttctccttttgccttgctaatgacagagtcaactattatatgtaaacaggaatattttctacccatattcatgttcactacatgtcctacataggttcttttcatcacagttaaaatatactcttggtgtaaggaaagcaaagagccatggtgccttcaagctggtcctaaacactccttatctgggctcacaatgcctgtacaggctctcaacctgctattggtatctggttcagcatccttttgagttttctttaatttagaacagtctccctgcctctacatttattttctttttggtgctagagatggagggtagggcctcaaacacactaggcaacagttctattcctgagttgtaccctagcccttgttagaaacattccaagatgttggctttaaggaaaacatgaactatgtagcagccaaattatttgcagtgaatccttgcagtcaacaaagcttgccttagagctgatagcctcaggagcccagatgtaatccaggaagcccaaatttcaggtctcttatgggacaagaaggaagaaggtaaagttgtcttaggcaagttgtggctctactgggacaaagcagtttctccagtgacagctcctttttgcacaggcggaagctggctcagttgcaggcagcctatcaccagctcttccaagactacgacagccacattaagagcagcaaggtgagtgcaaaacataagctaggaagtatgtcttccctgggttgttcagggagaggtttttccttcttccccagtgtacctgagggggagcagtgtgacctttgagaaatagcatatctgacttttggaagggactctcaagttacctgacaccttcagtggggctgtaactatgacagtttttggatgaccacaaagaaatgggacatagccacaggacatctctagggtatctgggtctaggaacttcacatatggtctgtggcagagatgttgttctgcatggccattccttcatgctcagagttgggaagtctacaacatttcttttttttctaaaaacatttttatatttatttatatatatgtaaaaagtttttgcctacatatatgtatgtgtactatgtgtgtgcttgatacactggaagatagaaaagagtgatggatctgctggaactggagttatgaatggttgtgagctgcctgtgactgaatttgggtcctctccaagaacaagtgttcttaactgctgagccatccttccagcttctctttacctcccccagaaacagttctgaggtgactctgatctctctttgagtttatcctcattaggtctagtgattactttgtatgtgtgtctactcacaaacatatgtggaagtcagaggacatcattggtgttactccttaggagctatacatgaccagctctttttctttcatagattctgaggcttgaattcaggtcctcacaagtgctttactgactgaactacctccctagcctattctttttcagtagagcccaggccagccttgaacccttaggtggctgagactagccttgaactcctgatccttttgcctccatcttccatgtgctgagattacaggtgttgtgctaccatgaccagcattctagtggtcacatttttctcacaataaagtttattagctgttctctttctcataaatagaatcgattttcaataattttttacaacctattactcatataaagaaactctaacaaggttgccaaaagcccacatattggtggtgttgggcatggtagtgtatatctttaatcctagcactctggagtcagaggcaggccaatcttggtgagttcatcctagtctacagagtgagttctaggatagccagctttacatagtctcaaagacaaaacccaaaaccccccagaccaaaccaaaccaacaacaaaaaaccaaccccccaaaacaaaaatactccactatcgaataaacaactccagagagtaatgggaagccaactgatattaacagactagacgaaatgatttctaaaggcatttctgcctctcactaaaattttaaaaaattgtttacaataaagaactctagaacagtgcagttactcaagatgaagtatccaaagatggattcacaaaaatgggaatttatctgtttttcaattaataaaataaatagaactagaagaaatggcagagaagcaaaatcaaatcccatgatatgtgtgtttgtatatgtatgtgtataaaactgcaagaagtaattctcaaagttgcagagtttaaacaaaatatatttatttattttttggggtgggggttgggctttttgagacagaatttctctgtgtagtcctggctgtcctggaactcactctgtagaccaggttggccttgaactcagaaatctgcctgcctctgcctcccaagtgctaggattaaaggtgtgtgccaccactgcctggctaaaatttttttttaatttttttattaggtattttcttcatttacattttcaatgctatcccaaaagtccccctataccttcccccctggctaaaattttatattttatgtatttattttattatagcgaaataggcagttaatttggggtaagatagtcattaaaatttgatctctccctaaatgtacatttaaaattttaggctaagaactggatgtttccatgcaatagtgattactacatttccatataaacatcatctgcagttacgactatgaatttttttccttctgtgtaaagatgagctgctctagcacctaaatatggccttaatttagaaagtgtatgaacaacttttgaaagactatagtgtggtacaaatagattaaaaatacttgaacactattatttctagcaaatacattaagggagggctcaaacaatcaaaacatgaagacctctatgcacataaaaatccctcatgaaatgagttaactcatattaatttaaaaataaaacctatgttttcttatttgtctaaaatttaaataataatggaagtcaattaaaaaaaaaacacttgaaagctaacacagattatgcagttactcaaagttagtggttacattttaaggaggacattgtcaagcataatgcacccataggtgcatgatactagatcacatgacaaagaattggttataaaatgctgcttaaggaacaggaaagatttttcagtgactaagaccacttgctatttttttccccccagaggacctcattttttttttgttgttgttttttttgttttttgagacagggtttctctgtgtagccctggctgtcctggaactcactgtatagaccaggttggccttgaactcagagatccgcctgcctctgcctcccaagtgctgggattaaaggcacgcgccaccacccggctaggacctaagttttgttttcagtactcacattgggtggctaacagctacctgcaactccagctttggcagatatgacagtatctctgacttctgtgggtacccacacacatatggtgtacatgtgtatacacacacacacacacacacatacgtatgtaaattaagaaaatcttttaaaaaatggctgtttaatcttttggaaggaattcttggctgagagcatgtgtgcatgtgtataagatgtgtttgaccaagtggcagagtcgaaggacacatagaatgcagctttgcctccagtctatggagaggcagtgcatagtactggcttgcctcaggagggatggtggctcttgtccttgaagagtcaagtggatggctggctagctaggaattctctgaagggaatgatgcagagtacgaggcagtaccttatatatcctcagagttcctatcagtcctaagatctttgtgcatcctaagggccttagcatttcttctgtactgtagggctaccacaggatgcagtattctccctgcacacatggtcattggctccaaaatccaaaggactgactttgttccagcttttcctacttagtctcaaacaatggccagccagggaggtagcttggccccactgtgggccaaaagactctgacagcaccctttgtccttctctagggcatgcagctggaagatctgaggcaacagctccagcaagctgaggaggccctggtagccaaacaggaattgattgataagctgaaagaggaggctgagcagcacaagattgtgatggagactgtgccagtcttgaaggcccaggtgagggctctgttccagcctgcctaccacatgaatgacctgcccatccaggcagtggggttctgtgtacctttttacagcattttgtagtggcttctctattcttgagccctttgcattcttccttgacttcttggtgctcttgggatcataggctttcatatctgtttctgatgtactattatagggtcctaggccagggctctgttcctttgggcatggcatagaatgcttgatgggaagctgatggatggtgggtgttcacctctgttctatttgccaggcggatatctacaaggctgacttccaagctgagaggcatgcccgggagaagctggtggagaagaaggagtatttgcaggagcagctggagcagctgcagcgcgagttcaacaagctgaaagttggctgccatgagtcagccaggtgggcctgtaagagtgcagccaggagcacagccatagacagagaaggtgtatactaggcagcaaccagtagtaacttcaggagattgatggctcttagcattggtgttaagttctctgtgcctcctactgctcccttgtgtttggccttccaacaaagacctttcccattggtccagctagaaactgaacagaaatgcatgtattgagatgtatctaaggccggaggtttcatagctttcatagtgtttttttttttttccattttttattaggtatttcgctcatttacatttgcaatgctataccaaaagtcccccatagccacccaccccctctcccctacccacccactccccttttatggccctggcgttcccctgtactggggcatataaagtttgcgtgtccaatgggcctctctttcgagtgatggccgactaggccatcttttgatgcatatgcagctagagtcaagagctccggggtactggttagttcataatgttgttccacctatagggttgcagatccctttagcttctttggtactttctctagctccttcattgggggccatgtgatccatccaatagccgactgtgagcatccacttctatgtttgctaggcccaggcatactctgacaagagacagctatatcagggtcctttcagcataatcttgctagtgtatgcaatggtgtcagcatttggaagctgattatgggatggatccctggatatgctagtgtctacatggtccatccttttatctcagctccaaactttgtctctgtaactccttccaagggtgttttgttcccacttctaaggaggggcatagtgttcacacttcagtcttcatttttcttgagtttcatgtgtttaggaaattgtatcttatatcttgggtatcttaggttttgggctaatatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttccttccagcttctggctattataaataaggctgctatgaacatagtggagcatgtgtccttcttaccagttggggcatcttctggatatatgcccaggagaggtattgctggatcctccggtagtactatatccagttttctgaggaaccgccagactgatttccagagtggttgtacaagcctgcaatcccaccaacaatggaggagtgttcctctttctccacatccacgccagcatctgctgtcacctgaatttttgatcttagccattctgactggtgtgaggtggaatctcaggtttgttttgatttgcatttccctgatgattaaggatgttgagcattttttcaggtgcttctctgccatttggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagagcaagccattgctgttctgttcaggaatttttcccctgtacccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgccctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgctcatagtgttttagtttggtttctgttgctgtgatagagaccatgacttatagcaactggggaggaaagggattattttagcttataatttataatccatgacagaggcagagcaggcacctggaggcagaacgtgaagtatagtcaaaaggggaatgctgctttctggcttgtccagcttgcttgcttgcttatacaacctaggcccacctgcccaggggtggcaccacctaccataggttgggccatcccacagcaattattaattgaagatatgccttacaaacttgccacagcttctgctctccatggtggttgtcccatgttactggcatccaatatgctagggtttccactgcagctgagggtgcaccttctcctgacctctgaaatagtgccaagccctttctttagctgctttccatgatgccttcatattacttggtcccctctcctgtgtgctgatcctgaggagatactctctagattttaaaagatttcacctcagtgatactgttttcttcttaatcacagctaatttctcagcttcagttaaccagcattagttgtcctccctcgtaaagcaaaggttttacttgagttctgctgatctcttgttcatcgcacctgattcttcagcctcagctgacttcaactgcagattcttaattcaaaataccacacaaatgacgctgatagaatctttgcttccctctgaaacttcatttgctttggtgtcagcattcttatcttccttggctcccacagagcagcccgttaagctctaaccacttgatggataggaacttgagataggaactgaagtcaaaaccttggaagaacgactttttggcttgcttgcttttgcaacctaagtgattgcttgaggtgtggcactgtctctagggaactaggtcttctcttatcaatgaagaaaatgccccaaaggcttgcctataggccagtctaatatactcagttgagtaaatatcagatgactttgatcagatgaatccagcttttgtcaaaatgacaaacaacaacaacaaaaacctaaccagtgcaaatgtatctatctaaaaactcaaaatatgactttatttggtttagtatctttatatatgtaactagttaatataaggtcacattaggttaattagttgactgtggtacttacagaagcaccaaattaagataatagaaggctgccacaagaaggctaaggcagactctgagattcagctacaagccaagaaatgccaaacactttgtaaaccactggcagctagggggtgggcatggtaattctgcccagtcctctgacacgtttatttggggcacttagtcatctgtatcatgcacgtttttgttattctaagttactaagtatgtggtagtttgtaacaaggttctgaggaaactaatataggggaacccaaggaataattcctaataagtacaaagtttcctttgggggatgataaaatattctaaaattaggctgatgattggatatgctgaatagagtaaaaccctctaacaatacggtttaaattggggacttatatagtacatgaattatatctaaatgaatgtatttattcataaaaaaccctataagcattgattgaatgctttctgttttcaaaaggattgaggatatgaggaagcggcatgtagagactccccagcctcctttactccctgctccaggtaagtgaacaagtggtagatgatgggaggagatgcttagggaggggaaacatgtgttggtttctctgctgctctgctttggggagttcttgctgacctctcctgtcagtagcccacatcactctgaggtcaaaggaaaaatgtgctggtggaggtggctcccagcaatgtagtcaaatatggtggtatcagtaagtctcagcaccttgttagcccccctttccatttgaggcctacctaggctgtgcatgaagtacttacatagttcatcacactcctgtgttcttttttctcagctcaccactcctttcatttggccttgtccaaccagcggaggagccctcctgaagaacctcctgacttctgttgtccgaagtgccagtatcaggctcctgatatggacactctacagatacatgtcatggagtgcatagagtaggagcagcagatgcaaggccacttgcagtactatgtcctgatctgtgtgacttgtgctttcctgttttacctgcatagtccacacttaagggcttgctttagccctttggtcccccatttagggtagacagccccattcagggcttttttttttctgtgtgcctgatccagtttgcctctggtggcttcttccctcttctcccatagtcctagggagtctagaatggaggccaggggctcttagggagcatcccttctccaagcaggtctgggtacagcttttcttctctccaactggtacctttcttgccggtgaactgcaggctctcctcccagggcatgtggcacttgggtctataacatgtgttacctctggtagacatgtggaaagtattctgtccttttgttactgtaattaatggtgtagtgaaagtacttgtacactgatctgtgtgtacctttaggacagatgcttagatgtgacattggatccttgccctggaggaggtgggcagacctttggatttttgccatctctaagatataccattctttactaaagaatttgcttaagtgtctttttctggggcatgtgggccctttttaattcctctgatgtaacttggattttcataattcctacccatttttctgttgggacattgccatttgttcttgggctttgtagagctttttgattatcagtcaggttggttttgactattacagaagtgcaccccttgttccacattgattgttagtgttttggggcctagaagctgttttatactcctacttacccattctttactcctagttttttgactttggaattatgactgctttgtcaacagaaaggtatttcacatgtatgctttcctttttctagccccagtgtgctcttgtttttgccaagcacattgttaccttctgtgaatggtggtggccatagttcatcacactcctggagtttgtgatcacatgttcttcaccagccaaaatgtcctagggaaccatttagcagtgactgactgatcacagaaaagggaacacttcacttgttttgcaaggttctagacattttgtgggaccttaccgtcattggtattagacctgcagttctagtaaaggaaaggaagttgtagttgagaaagcaataaatatgccttgctcattccttaggtctaaatccttcctgccctcctgtaagctttcatggttctgagtggtatctgtgaatccatcccgggggcttttatttacatggtttctttcccattaagagtgagaaggctaagtagaattcagattataaaaaaggatttaaaaagtaatcctgagctgggggctttctcggaattttcaggggatgcagagtaagttttccatttcctaattcccaggtatctatcagaaagatctttaggaaaatgttaaaggaacaaacaagttctttgcttatgtgttttcatttaaatacctaatctataattttcctttaggaatactattggtttaggttgagtccagttttgtggtggtatatatcacttttctatagctgctttaaaatttttcctaaacttggaagagcaagaacaacaacaacaacaacaacaacaacaaatcactctttcctgtctggaagccacatattaagttttttctggaggctgtgagaatcaattccaggcattctcttaactttcagtggtttgtggtagtccttggtgttgcttggctcatagacccatcactccagtttctggttctagggccttgtggtttcttcctctcttctgtctcataaggaaaccatgttgtgcatgtggggtctatttgattagattaaggaggatctccagttcaagacccttaactcattccacctaccaagatcctttccccaaataaagtcttgttctcacattatgggggtttgggcttatataacccggagtatggatatcatcagaacctgagtaaatgcagcccaaaggcagggcctttaaagccttgtaattctgctagagagacctggtctctagggtgatgaccagtagtcttcagagtttgaaggcagacccttgtcagtgcttgatgctgttagtagggtcagtgggaatgattgggaaaggcaggttggctatagtaggagagagctgttgggctgcctgcagtggctgcatgagcttcacgcttcttggataaacagagatgcataggtgcatttctgaccagtactttatcctgaaagggtcccagaaagcaggtgtgacccaggttacacagtaggaagcttgaaaacatgggcttcatgcactggtcaagacaaatctgagggtggcacaaggtaatggttgggacctagtacccttctagaaggtgggagcccttgccaccgacttaccctgcagtatggtgtatgattaaccgtacatcaaagatttgagattctaccatctttttgacatgagacatgctcttttcttttgcagaattacttaagctagaactggaaaaagtggtcgttccattcccctcaggaattagtctacttgcttttgcacaaattttatgtggcctctggcagacaacttttagatccatacagctagaagcatgccctttccagaagacctgttctggaatagatagtgcttcttatgtatgctctcttcctgttggcccatgcccaagagaaaaccagagagccagtaagacagtacagagtgcttcacctactgaagtaataaacgataaggcagattgtaggtaggaatgatatctaaaaaggaacaattgcagccctgtgtgtgacaccctcaggcaaggtaaggcctaccttttagtgtttcccctttcaaggtgggagtttggagagatgaacaagcactttggaagcatccccagccctctttacctgacaacagtttggtcctcacagtgactgcttcattggagtgcctctccagtgttatggcaccatcatctgttaccacccaaggctgtgatgaaataagatacaacatatccgatgacacaggcctgcatggctagcatcttgaacattttattacatgaacattctctgtacgatggtataaaaaggcccgaggattaaattatgtataaaatatgaaataaagaagtaagactttcaagcatgcactctgtcctcccttgttggatgtaggggtaggattgccagtaacaaaggttttctttgctatttctatctctttaattcccctgtattacataggaagtagctgttacacacagctctgaggtttcttctgcctatggctgaggaaagctcattattgacacaacagagtggtgaaaggggccaagtcaactaatttggggcttgaatttcctgtggttgcagcaacaaagtaccacacgttagggagcttaggcaacagatttcctctccctgttaaggatggcaggcatctgagaagtgggttcctcataagggataacccattccagtgcccctctccagtgtgtggcaggtcccagaaattcttagttttctctagttgtacctgcatctctgcctctgccacttttgtcacatggccatcttgtgtttcctttttataagcacaccagtgttgtatacaggtgggtatttggaaacatggaagcattttgttcagtatctagtgacagtgatggaaagagatgatttgcagagaaggtcagagcagcatgagggtcttaggtatggagctgcagccaacattatggacatggaagagagggattgctggacttttggtttcctgcctgggtacctggacaatctatctaccattgggaggactaggtaacagtggaagttagttatgagagaagttgtttgatgttcaattctgatctagccaggctcagtgtgagatgtcctgggtcccttcatcttgccttgactgttaggtgcagtttcatattgaaactgcaggctcttttttatccattgctactggcaaccagtgtgatctggtaaatctgtttccactttgcttagtgctctccactgattttctgttacttgagacctaaactccatcttcagccttgtgttgatctaatgtcatgtcaacttctctaaaagctcagccaattctacactggccttctattcctttcctcaaaccacttagcactttttttttttaaatttttttagatttatttatttatttattatatgtaagtacactgtagttgtcttcagacactccagaaaaggagtcagatcttgttacggatggttgtgagccaccatgtggttgctgggatttgaactccagacctttggaagagcagtagggtgctcttacccactgagccatctcaccagcccagcacttctgtttcttaaggctgttgctcctgttgtctcctttgctgagaaagttctgttccctaatttgtactgttgactactttttgtcatccatataagtgtaaacaaaagttctttcatctgatctcttcatcctaaatcatactaccctgttttaactcacattactaccactgaccttttctagtgtttttttcttttctaccactagagggagacagaagccgtatcaatttagtcgtatactcaacacagggaaactgcatttactgatggctgagcttgtctgagacgatatcaggattcccctgccaatatcttcatggacgtcacttgtcaccataattggtgacttatagaagttattaatgtactagaaattatagtacagaaatcttattttaggactatagtaccaatagcctttttttgtggtgctggggatagaacccagggtctttcacatgtaagcattcataccatcactgagctacaatccctggttatcagcttctcactttatttaccttcccctgactttgacagccctgtctagtttggaacttattatgtaatccacgatggccttgaatttacagccatcctcagcctctccagtgctaggattataaatatatctgactagcttatttttttcattttgttcaggtttttaatgagtgtcttggtttcagatatgaaaaacagaatttggaagaaagccagttgggccagtctgtggtagagcatgcactcaaagttgaagcaagatgttaatgagttctaggctggcttaggcttcatagcaagatcctatctcataaaacaaaaagttaactggtgattccctggaggtgagaggggtgaggagagagtgatagttaatgaatacaaagttctttgagggaaaatgagaatattctgaaattggctatggcgatactcatacatttgtgaatgtgcaaggaacacttcagatgaatgacttttgttgtatatggattaggttgcaataaaactggcatttaaaatgttatctaagccctgcagttttccagaactttttgtgacaacgaagatgatataaaaagagttgaatatttgcttttgttaaa

SEQ ID NO: 87 - DNA, 207 bp, mus musculus
atggcgacggctctgtcgggtctggctgtccggctgtcgcgctcggccgctgcccgctcctatggggtcttctgcaaggggctgacccgcacgctgctcatcttctttgacttggcttggcggctgcgcatcaactttccttacctctacatcctggcttccacgatgctcaacgtgcgcctgcaggttcacattgagatccactga

SEQ ID NO: 88 - DNA, 207 bp, mus musculus; identical to SEQ ID NO: 87

SEQ ID NO: 89 - DNA, 783 bp, mus musculus
atgaaggctgggagagggaccctgggtgtctgcctggccaaacagtcacaaggaggtgacccggacaaactagcatgtggccttaagaaaagaagtcagaagaggaaccccagcccatcagttgtgccttcttggacagaccagcctgtagcagatagccatggaaagtcacgggccatggcggcggcagcctcagaaatgaagcatggtcagagcaaggccagcctcctgtgttatggtggcttcaaagtgcttcagtctctgaagggatcaatggggagaaattcaaccccagcagcctcccttggcaaggctgtggctctgtcccctgctccttcagaagaacaactagccgggatgtcccgtggcattggggatgcactaggaagtgactggccaggaagagagcccagaaccacagacaaccgtggacagtacctcaaaggagagtcctgggtgtcaggatggccaggccatccaaaactgagggaagtgggattcctaagaggtgaaccactaagtgctgtccccaaggggctaggcatctggtcagaactgtctcaccgatactctgagctgtgccagctgcattatgcttacccctattataaagttctcccagaaggcgagctgaggcgtgtgtcccttgactgtttcaatcccgtgctttcagaggaaacagtagaagatgagaaaactctcaagtacttcagatggtccgcagatagtcgtggggtcactggctctgcaatcttccagattagcaagtctctgatgccatag

SEQ ID NO: 90 - DNA, 783 bp, mus musculus; identical to SEQ ID NO: 89

SEQ ID NO: 91 - DNA, 12001 bp, mus musculus
ggcttttctcggttcagtctccgtgaagcgtttgcagccgtcgtttgattagtcgctgcccccctcgcggattaggagctagcgtctcccgcccgcccgcctgccgccccggtgcccctgggaggaagcgagagggaggctgccagagggtttgtcactgctgttgctcctccgcctcagcgagtccagcccgggcctagtcggtcgcctgcctttctcatagccgttaccctcaggccgccacagccgccgaccgggagaggcgcgcgccatggcctctggagccgattcaaaaggtgatgatttatcaacagccattctcaaacagaagaaccgacccaatcggttaattgttgatgaagccatcaatgaagataacagcgtggtgtccttgtcccagcccaagatggatgaactgcagttgttccgaggtgacacggtgttgctaaaaggaaagaaaagacgggaagctgtatgcattgttctttctgatgacacgtgttctgatgagaagattcgaatgaatagagttgttcggaataacctccgagttcgcctaggagatgtcatcagcatccagccatgccctgatgtaaagtatggcaaacgtatccacgttctacccatcgatgacacagtggaaggcatcactggcaatctctttgaggtataccttaagccgtacttcctggaagcttatcggcccatccgtaaaggagatatttttcttgtccggggtgggatgcgtgctgtggagttcaaagttgtagagacagatcccagcccttactgtattgttgctccagacacagtgatccactgtgagggggagccaatcaaacgagaggatgaggaggaatccttgaatgaagtaggctatgatgacatcggtggttgcaggaagcagctagctcagataaaggagatggtggagctgccactgagacatcctgcgctcttcaaggcgattggtgtaaagcctcctcggggaatcttgttgtatgggcctcctgggacagggaagaccctgattgctcgagctgtggcaaatgaaactggagccttcttctttctgatcaatggtcctgaaatcatgagcaaattggctggtgagtctgagagcaaccttcgtaaagcctttgaggaagctgaaaagaatgctcctgctatcatcttcatcgatgagcttgatgccattgcacccaaaagagagaaaactcatggggaagtggagcgtcgcatcgtgtctcagttgttgaccctcatggatggcctaaagcagagagcacatgtgatagttatggcagcaaccaatagacccaacagcattgacccagccctacggcgatttggtcgctttgacagagaggtagatattggaatacctgatgctacaggacgtttggagattcttcagatccataccaagaacatgaaactggcagatgatgtggacttggaacaggtagccaatgagactcatggtcatgttggtgctgatttggcagccctatgttcagaggctgctctgcaggccatccggaaaaaaatggacctcattgacctagaagatgagaccattgatgctgaggtcatgaattccctggcagttactatggatgacttccggtgggctttgagtcaaagcaacccatcagcacttcgggaaactgtggtagaggtgccacaagtaacctgggaagatattggaggcctggaggatgtcaaacgtgagcttcaggagttggttcagtaccccgtggaacatccagacaaattcctcaaatttggcatgactccctccaaaggtgttcttttctatggacctcctggctgtgggaaaaccttactggctaaagccattgctaatgaatgccaggccaacttcatctccatcaagggtcctgagctgcttaccatgtggtttggggaatctgaggccaatgtccgggaaatttttgacaaggcacgtgtactcttctttgatgagttagattcaattgccaaggctcgtggtggtaatattggagatggtggtggagctgctgaccgagtcatcaatcagatcttgacagaaatggatggcatgtctacaaaaaagaatgtgtttatcattggagctaccaacaggcctgacatcattgatcctgctatcctaagacctggccgtctagatcagctcatttatatcccacttcctgatgagaagtcccgtgttgccatcctaaaagccaatctgcgaaagtccccagttgccaaggatgtggatttggagttcctggctaagatgactaatggcttttctggagctgatttgacagaaatttgccaacgggcttgtaaactggccattcgtgaatctattgagagtgagattaggcgagaacgagagaggcagacaaatccatcggccatggaggtagaagaggacgatccagtgcctgagatccgcagagatcactttgaggaagccatgcgttttgcccgacgttctgtcagcgataatgacattcggaagtatgaaatgttcgcccagacactgcagcagagtcgaggttttggcagcttcagattcccttcagggaaccagggtggagctggtcccagccagggcagtggaggtggcacaggtggcagtgtgtacacagaagacaatgacgatgacctgtatggctaagtgatgtgccagcatgcagcgagctggcctggctggaccttgttccctgggggagggggcgcttgcccaagagggcccaggggtgtgcccatggcctgctccattcctcagtctgaacagttcagcccagtcagactctggacaggggtttcctgttgcaaaaaaaaaaattacaaaagcgataaaataaaagtgattttcatttgggaggtgaagagtgaattaccagcaaggaattgggtcttgggcccacacggtttctgtcgtagtttggggtggtgcaggtaacctgtgtggtgtgaaccaaggcattgccaccaccatcaccacagtaaagcatctatactcaatgctgtccaagtcctctcttaccctagccaacctgggtaggtggatgaggggcctcagtttgctgggtgtttatatagaaagtaggttgatttttattttacatgcttttgagttactgttggaagactaatcataagcagtttctaaaccaaaaaaagaaaaaaaaaaaagacatgttgtaaaaggacaataaatgttgggtcaaaatggaaaaaaaaaaataataagaacaaataaaaaagccaagtaaaggagataggatatgtaaataaatctacttggatattttaataggtaatataatataagccttatccacatttttgtctttttaggcatatgttaaagatgtaaccatcccagttaacattgacaatgattttaattttaggtttgcttttgaacaaaagagtaatcttagaatattaagtctccactatgaaatgctatcttaactttttaatctcttcattagactacagaatcattaagaaatactacacagcagagatggggaaaagacaactccagacagttactagatgctacaaaggtaagatttagtcaacatttctaaagctagtaagaaaagtttgcaagcgcatggggcatttaccaatttatgctgcatatttactacatggtttacatttcagaaatactttcctttttctaattttttatataaatactggcaggaaggtatgtttctattaagaatgcagaaagaaatcttggtattatctgccactgcagaaatctgtctgaatcccttgagattagtgccaactagagtaacatttttagaaagcttttgtaaatgtaatggcagcttgttgacatccaaatttatcctaatttgtgactgatacatagaatattgacattttttcaaatgcggaacattcctttaccttagaagatgttcggatagtagaatgccatgggattttaagtttgctagagccccgaggataagtgatgttgagtttaaatattgatgaggcttattttcattgttattttacgtgaatgatagctttcatgattatcactgcttcaaaatgagacatgaaaatctctatgattaaaaaaaagaacaaaaaacttataaggctatttgcatcctgggtactttatttttccctttgtttagtaattgtttgccattaaggcacaaagcattgttctaatttatgcagagactgtataaatgaatttgttttccactattaaattaaatctttaagtcgaaaatatgttcagtcttctcattatccaagatatcactgaatttgtatttcagtcttctacttcattgaagaccatatcatcttatgtgatagtcaccagaacccttactaaaactgttatgtagccttttagaggaaaaaggtcagaaaaagatgctgccagaataaaaaccccttgatgttttcctcttatcaagtgctttatgagtgttaatctaaaaattgataacatttatgacagttattttctgtctcattagtaagaataaaaagatacttttgcctgttacaattatatttccataccttggctgtaagctgatatagttataccgtatatagtatcagtatatatatgtgttcataaagaactatgcactcagcattaattattgttatgaatactgcaaaaacatcattaaatattcacttcatttaatacttttaatcataaaaactttcaatattagaaaatctaaatattaagcctaattgtcactatcttattcttacatctttttttttttaaagatttatttatttattatatctaagtacactgtagctgtcttcagtcactccaaaagagggcgctagatctcgttacggatggttgtgagccaccatgtggttgctgggatttgaactctggaccttcggaagagcagtcgggtgctcttacccactgagccatctcaccagcccccttcttacatctttctaaatgattttattttatatatctctgattttagcaataatattaaagcctttgaaattttatagtaggcaagatgttatataagactatttcgccgggcgtggtggcgcacgcctttgatcccagcacttgggaggcagaggcaggtggatttctgagttcgaggccagcctggtctacaaagtgagttccaggacagccaaagctatacagagaaaccctgcctcgaaaaaccaaaaaaaaaaaaaaaatttgggaaagtgtatgtagctcttattttctaagtgaatccaagaaacatttgaagtctatttgcctatatataatatgtacatatagtattaccataggagataaaaatgactcaaaaagtattgatcttaattttaagaaatttactgtgcaatagaaaaaacaaaaacatgtatgcaaaatgttagatcataagttagattattaaatattaaattaaatattaagtactttgtaaatatatatgtaagatacaataataacataaataatcagttgtataaacttgattttattaattttaaaaatatcaaagaaaagcaagtgaaatatgaatcattaactatattagccttgcttgcttacttacagcattatagtgagtgatagaaggggagtcaggataaattgagtaatactaatgttagctaaatcacttaaactaatttcaaaagctatttagagaaagcaatttgagtatttattatatttgaatattctttgtataaatgtatctgtatgctcattttaaaagtgtttttgctttactatgccaagctagatgcaatcccttgagtttattttagggacagttgttgtattagattaagacaatatctgaaattctgtaatacctaataaataaatggtttgttatcatttttaataaggctctccagacatggccattgatagaaaagagaacatgttggcatgggcacgcaggaggaggactccacacagacccaaaagaaggggtaagagtgactctcaagccttcctatgctaactttacaaataaattctaaaaggagtgaatgacaggtaactggaaattcatgctgataactgtatttgagtagaagataggtctttaacattgtcatagtctaatactgtttgattggctcatctaatgatgctttctcatgcagaaaaatcctatcgaaattggcgaatattatacagaggagatctatgacataacaaaaatgcatggctgtgtaaaatttttaaaaagtattcatggggccagacagtagtggtgcatacctttaatcccagcactaaggaggcagaggcaagtagatctctgagtttgaggccagcctggactacagagtgattttcaggatagccaagtctacacagagaaatcctgtcttgcaccttctcacatcccagatagacctttattattcactgagaaggggaaaaatgtattcgtcaactttagtgttctattgtgcttgctattattgttgctttgggttttggtttttttttttttttttttttgagacagagtcttactatatgcatctcatcctcactttaaactcaggatcttgatgtttaaatctctcaggcactggtttatgttatcataaccagttctaaatgttttagatctctaagataacagtaactgactttgttatataacctagccttataaataagtaggcaaattaggtttagtaattataaagaatttatgtgtgttaaggtcagtattttccctttacatgcttagatcttagaatatcagttagcttcatagtaaatctcatctatatgatccagctattactgatattctttaacattattattgttattatcatataggcatgttaaacagtagcgcctctgaaataaaaagatttatttggacctcactttaactgagtgagttaaaatgtcaccagaatactgttacatatttctccatctgttctttgggggggggggcttgcctctacctaattgctttcctcttttttctccttttttcttatctctccttctttgtctctccttcccccttccctctctcattttctcatatagacagacatatggtattttgaagtagcaatgagttaaggaaacaaaattttatgaagaatgtctataaaatatagatgctaagtgaatatgagttgtcttattgatagtggaaattgataagagaactttctaattcttgatgtctagtgttgctctttactttcaagcaagtgaaagcatattgcatccatgtccctttttttatacgtcactaaccctcatggctatctttgaaacaaacacagtgtaatatgacagaatttttaaaagttagctaagtaatgatatttgtttatctatctgttactctttggcatgatatttgtcagttttcaggatcatctgtcagtaaggactcttaaggatagttgctaataatgaatgctctatgaccaaaaatatgttgactaataaaggagaagcaggcacttctcttaagctgcactaaacaagaattttatatattttgtattgtttaaatgttgataatattttctcatccaacaataaaatttttatattggtacattaaaaaaggacacagaataaactctaagataattttacagaaaaatcagaacaaagcaattataattgtaatattttatattgttctttacagttctttttctcttattatctttatataactttaacttcataaatcataaaatagggttttctggtcaaatggaaaagaaaaagagacatagtatgtaattgttgttgatagtctcagctctagattgatactgggtttgagtgtgggctacatcacttcctaatggaatggccttaaacaaatcctgaaattctggatgcttcaggaccttctataaaataggttaataattacactagaagggctttaaatgaagtaattcttctcaccatgttaaaactcttaaatgctgtccaacatataggaggtgcttagtaaatgttaggtactgttatagtgtgagattgtaagaccttcctcagccacagtgtattcatttaaaaagtatatgtctgagccaatacgatggctcagcatgtagaattgcttactgtcagcctgacatcccttgtgttgttctggcttctgtgcatgtgtgcatgtgtacaaacacacactcaatataataagaaacttaatttttcaaagtacttgctttgtgccaaactttatgataggaatggaggatactgtacttaacaagacaaagcccttcctatctaaaatttaactgttgagatgttagaacatataagctactagatagaatgtttactagcataacaaatgatagaaaccaaaacatatacatcttgatttttaaattaacttccacttgtatattctttataaatattgctattaacaattacaatcaattttagagtatatttaggtgatctgtttatctcatgtggttgttataaagggtttatgaaaaaggaatggtagttcaatacttgaaaatattgcttcttaaaatagatgaatgaattgtttgttttataatagaatattgagattctttaaaaagacttgagattttaaaaatgatttatttctgtgtgaatatgtatgaatacatgcaagcatgcacattgcatgttgcacatgtagaaagaagttagaggacatccttgtagagtgtattcttttcattttgatctgggtgtggaggatttaatgcagattgccaggcctgtatggctaacacatttacctcctaagacattttgctagccaggattggggtttttactcctacatttaaatatttagtgatatctttctataggatcatttgttctgtatggtctgcagaatgatctacaatagccatattattattttttttttaattttgattgagcaggttcattaagtgtatagcaagccacaataaataatagatggtaagtgggaagtaagtaggtaggtatataggtagataaatggtcaatagatagatacatatacatatacacatacattaccagatcaagtgtttaaaacattcagcagaaatcaaaagggaaaattctgttaagacaggcagctggcattctcaataaagattatgggtagaataccccctcaggtaaggcttcagagtaaatgaacaaataataacatagaaataacagcatcaaacacactatcgaacaaaaaccaattagtggggttgagggcgtaagctagatttcctgattaagctttctcttcacaaccgagcctgctatggctcagcttctggcttctttcttactgtaggcatttttgtatcatggaataaacaatagtaacctctgttgaaaatagcttaccttctagatgttttcaaggacacaatgttttttttattcttgggctgctttgctgttgtcatccctccctgtcacagagttagcagggtcattccccttggatgccatggaggacacttgacatgaacatgcatgggtctgaagggtgcgggtagggagcagagtccttctcagtgagataaaatatgacaatttaccaatataatatacatcatactgttagtgaatgtagtttgaactcagtgaaaggactacttactgaagaagtactctgcttcatagtctttttttatgttagaaataattcctcattgattggatatagtctaaagtctgtgatagtaagaggcacttgctagagcaatcagagaactttagcataaatcttgatataaccagaagatgtgaaaagacatcctggggtattgaaaattggaagattgggaaaataatatctaagcttgctaaaatgagtgagactacaaaccagtgcacaagaatgcctggaggatatggggagccagttttctggttctgatttcatacatcatcaggcagcctaggatcttcatttgctttatgaacttgactgacttttgggataaagaactcaccgactggccagtgtgaacatcagtctacttgttagttactttttattataagttgttaaatggagtgtcaggtacaaatccatctcatgtgcagcataatccatcacctcaggtcctaatcactactgcataaactctttattgagatctcaaactaaccgagcttagaaaacaaaccctgaggtaaagagaaaataacaatacttgccaagctttttctgacaatttatattttcctctcctattccaaacacattacagttataataatgtaggaggacttctctgcttgctctctggggctttctgttagacatcaactgaacttgcttttcttttgacctagcttttatcaagtcactgttatgtctaacagtactgtagtatcctttttaattattcctttaattgaagtttcctttagcttgagacagttttcttccctgaatggtttttttttgtccctaaaataatactaaattagttctttagggagatgatattcagcctatatgccagattttacagaacagagactattccaaaagtttgggtttggggaactttttcccccctgggtgggggagtccttcctaaccaaacgttttatctgcagatagtttattttaaattagtttgattttgtaagttacatttcctactactaacatttaggaatgtctggggctggagaggtggctcagtgtttaaagagggttctattcccagcacccacattcttagcacccaattcccagctcacaactgtctgtgacttcagtttcaagggatctcacactttcatacagacatacatatagtgaaacaccaatacacattaaatacaaataaattttaaaaatagaaatgtctgtaaaaccaggattcttacattcttcatcagctaaggaaaggacaattctgctaaccttgtcaaaatactattttcttatttcttagtttcattttgtcaaagctcagtggactggattctcttgaaataagtgaacttcttatggaaacatttgctatttatgcttaacaacttttttggcaaccaatacaaagcttcctgaacagcaaaatatatatataggacttattaatatagttatacttaatatctgaaaattcttccaagtgaaccaatttagatgttttggtttttaagttcttgtgccctttttatagttattaactataggtcttctcttgtagtgcatttagtcatgagatttctctcctacagttaagttgagtactatgccatgttgaagatccattgttatgataaatactattctatgtaataagtatgatttgtgactataaactataaagttataccctactaactcatatacttccacatttatttatgcatgatcacatgccccataacgaggttctggtcagcaaaggatagtggtggtctcataagattttaatagaactgaaaaattcctacttcttagtaaacttatctttcagaagagggggcaagagaaaagaaaaacacaggaataaaaagggggaaagcctccttcactgggatttgataattaaagaagagatctttaatttgagatggaaagggcacaaaaggagatggagagagaaaggagatgtaatacagtactcatgtatccaattctgaaaacaaaatatattttgaaaatatgggatatatgggagttgtggatgtggctcattggataaagtacttgctggtcaagtatgaggacgtgagttcagattctttgtacccatattaaaaataaaaacaaagcttatagtaatgatgtagtaatgactattgccccggtgctgtggagtggaaacagaaagatctgtgctcactggccggccattctagccaactaataagctccaggctcagtgagagacacctcctcataaaaggtggggaaacaaattgaggaaggtatctggt

SEQ ID NO: 92 - DNA, 12001 bp, mus musculus; identical to SEQ ID NO: 91

SEQ ID NO: 93 - DNA, 2406 bp, mus musculus
atggcctctggagccgattcaaaaggtgatgatttatcaacagccattctcaaacagaagaaccgacccaatcggttaattgttgatgaagccatcaatgaagataacagcgtggtgtccttgtcccagcccaagatggatgaactgcagttgttccgaggtgacacggtgttgctaaaaggaaagaaaagacgggaagctgtatgcattgttctttctgatgacacgtgttctgatgagaagattcgaatgaatagagttgttcggaataacctccgagttcgcctaggagatgtcatcagcatccagccatgccctgatgtaaagtatggcaaacgtatccacgttctacccatcgatgacacagtggaaggcatcactggcaatctctttgaggtataccttaagccgtacttcctggaagcttatcggcccatccgtaaaggagatatttttcttgtccggggtgggatgcgtgctgtggagttcaaagttgtagagacagatcccagcccttactgtattgttgctccagacacagtgatccactgtgagggggagccaatcaaacgagaggatgaggaggaatccttgaatgaagtaggctatgatgacatcggtggttgcaggaagcagctagctcagataaaggagatggtggagctgccactgagacatcctgcgctcttcaaggcgattggtgtaaagcctcctcggggaatcttgttgtatgggcctcctgggacagggaagaccctgattgctcgagctgtggcaaatgaaactggagccttcttctttctgatcaatggtcctgaaatcatgagcaaattggctggtgagtctgagagcaaccttcgtaaagcctttgaggaagctgaaaagaatgctcctgctatcatcttcatcgatgagcttgatgccattgcacccaaaagagagaaaactcatggggaagtggagcgtcgcatcgtgtctcagttgttgaccctcatggatggcctaaagcagagagcacatgtgatagttatggcagcaaccaatagacccaacagcattgacccagccctacggcgatttggtcgctttgacagagaggtagatattggaatacctgatgctacaggacgtttggagattcttcagatccataccaagaacatgaaactggcagatgatgtggacttggaacaggtagccaatgagactcatggtcatgttggtgctgatttggcagccctatgttcagaggctgctctgcaggccatccggaaaaaaatggacctcattgacctagaagatgagaccattgatgctgaggtcatgaattccctggcagttactatggatgacttccggtgggctttgagtcaaagcaacccatcagcacttcgggaaactgtggtagaggtgccacaagtaacctgggaagatattggaggcctggaggatgtcaaacgtgagcttcaggagttggttcagtaccccgtggaacatccagacaaattcctcaaatttggcatgactccctccaaaggtgttcttttctatggacctcctggctgtgggaaaaccttactggctaaagccattgctaatgaatgccaggccaacttcatctccatcaagggtcctgagctgcttaccatgtggtttggggaatctgaggccaatgtccgggaaatttttgacaaggcacgtgtactcttctttgatgagttagattcaattgccaaggctcgtggtggtaatattggagatggtggtggagctgctgaccgagtcatcaatcagatcttgacagaaatggatggcatgtctacaaaaaagaatgtgtttatcattggagctaccaacaggcctgacatcattgatcctgctatcctaagacctggccgtctagatcagctcatttatatcccacttcctgatgagaagtcccgtgttgccatcctaaaagccaatctgcgaaagtccccagttgccaaggatgtggatttggagttcctggctaagatgactaatggcttttctggagctgatttgacagaaatttgccaacgggcttgtaaactggccattcgtgaatctattgagagtgagattaggcgagaacgagagaggcagacaaatccatcggccatggaggtagaagaggacgatccagtgcctgagatccgcagagatcactttgaggaagccatgcgttttgcccgacgttctgtcagcgataatgacattcggaagtatgaaatgttcgcccagacactgcagcagagtcgaggttttggcagcttcagattcccttcagggaaccagggtggagctggtcccagccagggcagtggaggtggcacaggtggcagtgtgtacacagaagacaatgacgatgacctgtatggctaa

SEQ ID NO: 94 - DNA, 17844 bp, mus musculus
gcccaacaaaatggcgtcggcataggccttgctttgtttccgtggctcttgcagcagcagcagcagcagcagcagcagcggtagcggactctgagctgggaggacgatccagcactatctgcggtgactactaagatcccagtacttttcgttcagccactggcgccgaggagcgcagaacggtacccaaggggttgccaagccaagcggccgtccgagccaaaaacatgaccgctgagcccatgaggtaaaacgcaagcccttgtcacgggccccggcgttctgctcccgggcgccttccactcgagtggggtgtttgcaaagacgtgcgctaggtgccctaggcccgcgcgcggcttcgcggtcagcggcatcgttttccctctaggtgagcggggctgggggagcgcggtgggaagccccagctggggcttggggtgtgtgtgtgtgtgtgtctatgtgtgtatgtgtgtgtctgtctgtctgtctgtgtgtgtgtcggtcgggggcggcatgcggcgcgcgcgttgcctttcccgcctcccgccgctgcggagccgggagcccctgctcggctcacgcctccgtgcccgcggcgtcgaggcctgggggcggggggtgtcgcgggccaccgaacgcttgcggtcagtctttcgaatctcggggcctagcgactgcgtggggaaggaggggggagggggggggagaaggtggatgggggagggggaggggcggaggatggggagggggaggggcggcgggaggaagtgagatcctggaactagcgaaccccaatggtcgcctccactggaagtcctccagctctccgcggctccgagaggagagccgagcattggaggtaggagggccgggcccggaaggtacctctagaaggtgccttttcgccccccgactccagatcctggagggttatcttggggacccctgggcggctgagacggagagcgggcagcccaatgcgggcttttgctttctgagaacagcggccgacgactttgcaggagaagtccggtttttgacgggacatcggttgttgttaccccctgcggtttgggacacgttccgtgaagtagttagatcgtgcttttatttatttgttccacgaggcatgtggagcgggttaacggggattcaccagaagatttattgcaaaggtagaagagagcccaggcccgatgttagcgatcaaatacgtttacgattcaggctgtttttccacgcgtttctgatttgctttttgattgtttggagtagttaatctgaaatggattccgcttttatgcagataccttgcttttttaggcagtttgatatttgaccttttatcccaagattgaattcggtgatttttcttctcgaatgagatgcaagcttggtgaatagtggcaaaacgaaattataggtagcgtggatcataattgcatctgtaattggcaaaatgtgccgttgggtgactaggacatcatggctttgagcactttagattgtagaatttgagaacgagcctatccgattattttctaccttagcaaacagtgcatcgatgctctctttacttagggaaaatatacttcagttctgtttgtttgtttgtttgtttgtttttcgagacagggtttctctgtgtagccctggctgtcctggaactcactctgtagaccaggctggcctcgaattaagaaatccgcctgcctctgcctcccaagtgctgggattaaaggcgtgcgccaccacgcccggcttatacttcagttcttaaaatacaggcacttagttgtgtaaagatcattgtcttcctttatgaatttgtgttaactgacccaagtaaaacaaatctttttttttttaaatggaatattgagcagtattggctggttaataccaggcattcatgctcatttacttacagttcagtatgacttctaggttttacttcatgtcttagttgtctgtatttaaaaccatagttgcttctttgtggatggtgaagctggatactgaaggatttgaaaccagcctgactcaaagctaaaaatctccaaacagaaaacaggtgttgcctgtatcctctacctatcaggaggctgaggaagttcaagaccagcctgctcaacatcggatggctgttgcaaaaggaaaaatacataggttggatttggattttcatccttcctttcttgccttcattttgagatatgtaaaccaaactggctttgaactgaagggtaatcacaaacgtcccagggctggcattacaggtggcaccatgctgagttttgcgaggttggagattgagcccagaactcttatatgtgttaaggaggcatgcttccaactgagctaccctccctccccttctcttttccataatggtgatcttgtgcctctgtgctaactcactactctctaaggctgcagtctgccctccttttgcattttattttgaaacagtttcactaaattgaccaggtgagagagagagagagagaaagagaaagagaaaacagacagtcctacctacagaggtcagcgtgtgctcttcctttcagcacatgggtgcaggtgttagaactcaggttcccagtcttagcagcaaacaggttctccctacctactgagccatcttgccagtccacgtgtatctttttaaaggtgtatcttccttctaattatgtttttgtctgtgtatttacacgtgtgtgggctggaggagatgtgtctttcttacttgttctgttactgtgaagagtcaccatgaccacagctactctgattgaaacatatgattggcagctcgcttgccgtttcagaggtttagttcattatcatcatggcagggaacacttccgtttcctggctcctttcagctttgctgactgcctcacacttttctctcttgggctggttccatgcctggtcttcagcttccctttgaaggtatctcacaactctggcatctccaacatattgaggtctctctaggtctccacatacgggcacccctcccaccaggcggccttcggtgacttctgagtcacagaggagattccataatcccattcgtgtctccagaacctcgtggccaatgctgccaaattctgctgcttgctggggctggaacccggtctcccgccttcagttacatttgcctcagcttcctgttgttcctggtttccttctctgctgcagcagaggaaatgcagttgggtggaatgtctcgccccgaggactccctttagcctggggcttgtctttaaactttgtatttagtatctctctgagcactgaacggcattccattatactccctggctcatcttttcctttgaagctgtacacttgatgtttctcattttccagtttgctccttttcattacagatctgcataagaatgataactaataaccacactaggtcagtcagtatggccaatattcatctgtcttaaaatctcctctgctaatggcattaatctaaaactcttcagtttatctttggactggtttttaggacaaggacaaaatgtcccaatagtttctaggctacttactagtattctcctgcactgaaacttgacttgtcacacagttcaaatctcctttagcactgtttcccaagctcctaatagggatggccaccaactgattttctagtccaaagccccaaactcttccacagtcctccagcaaccagcatggtcaagtctgtcacagcaatacccaactccttgggactaacttcctttttttttttttttaaaaaaaataatgttatttatttttattttctgtgcattggtgttttgtattaagtcttcgtgcgggcatcttatcccctggactggagttacacagttgtgagctgtcttttgagtgctgggaattgaacctgggccctttggaagagaggccaatgctctttttctttctttcttttttttttttaagatttatttatttattaattatatgtaagtacactgtagctgtcttcagacactccagaagagggagtcagatctccttatggatggttgtgagccaccatgtggttgctgggatttgaactcaggaccttcggaagagcagttgggtgctcttacccactgagccatctcaccagccctgaggccaatgctcttaattggtgagctatctctccagatccccgcttccaacttctgttttagttgctgttctgttgttgtgaagaggccctatgaccacagaaactcttagaaaagaaaatctttagttgggagcttgtttacggtttcagaggtttagcgtggtctgagtatggctgaactccatagcaatagcttagagctacattgtgatctgtaggcagggagggagagacagacacacagagattggctgggcctggcatgggctttagaaacctcaaagcccacaatccagagatgctacacctactcctcaaatagtcacttcctaattaaacattccaatatgtgagcctttgtgagccattcttattcagatcacaaggccagaagaggctgttggggtcccttgaagctagatttacaggcagctgtgaactgaactctggttttctacaggagctcttaagtgctgagccatctctccagacccaatttgtatattgattttcagaatactacttcatcttccccattttgcagaggaggaaacagaatgtgatagaaattttagagcttgtaattgtgttttgttctttctttttggttgagaaaaggtctcagtatgtggcccacgatggccttgaactctgttggtagtcccaattcagcttcccaagtgctaggattgtaggtatggactaccactcctgactccaggaattgaattcctttaattaaagttgtgtgtgtgtctgcctgtggcagccagaatctggatcccgtggaattggagttataggtaattgtaagctgtgacaaaggtactgggaaactagagccctctgaaagcgaccttaattgctgagccatttccaacaccaagagttttatcctgaaggaattagtgcttgctcttttctgctctcctctgccctgttctcctccactctgctcccctccactttgctctcctcccctcccctccactctcctcccttcctctcccttcccctccccctctcttccccctccccttccttcccctccctaccctctccctcccctttcctcctctctcttcccctcccccttctcccctcgtctatcctccccctctccctccccctcccttcccctcttcccttccttcccctcccctcccctccttccctccccctctcctctcctgcactctgctcccttccccttcccctcctcccttccccctctcccttccttttttcttccacaggatttctctgtgtggtcctggctgtcctgtcccagaatttgctgtgtagacctggctggcctcgagagatctgcctgcctctgcccccagttaccctttcttagtgcccttataaaaggtttttttttttattattatgtgcattgatgttctgcctgcatgtatgtatgtgtgagggtatcagatcccctggaattggagttacagacactcgtgagctgctatgtgggtgctgggaatcgaacccaggtcctttggaagagcagtcagtgctcttaactgctcagccttttctccagccctcttagtgtctccttgagctgccaagttgagctggattttggccgttttattttaggctcaaattttttgataaaagtagttttttctcccagctgtttttgatatactgcaattcactttttacatttaaatttacaatatagtgaagtaagtgatcaaacattttgaaagacccacaacgtgaggactcccccatgttctgactcaggagaggtgataccccaaaatcacccacaagaaacggtcttgctgcaaactgcaagaggatttttattcaagggcactcgggcccacggtcacacaccacgtggcgccccgagtagctagataagggggtattcaaaggaagaaaccacagctcaaggaggtgggaagggcgttgttggaaaataccaaaaataccagttaagagtcacaaggaagtgcaaagttacaagaggaatacctggtaattgtgagggttatttctcaagacagtttctaagagcccctaacaatagcacatttgcatagtgggttccagcaatggccagggtgactttctttgaatgaatactctttgaacccaggaagtgggtgggtggagggatgtcgctatctgttttatgattagcataccttggaccattgagccacaaagatcacattcccaagcctgggcccaaaggcctagaattttgtttttactactcttttaatttaattccaggaatgtcttaaaatatgcagtataacccttgtaaataaccatttatgtaggcccgatggtgggcttccagaggcagaggcagagtcaggtggatctctgagttagagattggcctggtctacaaagtgagttccagacagccaagactacactgagaaaccttgtcttggggggggggggctggaaagtcccaaaagacaaaaaaaatcacatatatagatgtagtatgttactaaactactgccctgattattgttgtggatgaatttcatggggggggggtgtcttagttagggttttatggctgtgaacagacatcatgaccaagacaaggcaagtcttataaaacaacatttaattggggctggcttacaggttcagaggttcagtccattatcattaaggcatggcaatatccaggcaggcatggtgcaggtagagctgagagttctatgtcttcatccaaaggctgctagtggaagactgactcctagggaactagggtgaggatcttaagcccatacccacagtgacacagctactccaaccaggtcacacctccaaatggtgccactccttggcccaagaatatacaaaccatcacagggggtattaagggtgaagtgttactagtctctctggtcataatggtcaaatttatagaaaagtaaccaataggcagtgcttgagccaagcccacagtacccaaactatcaatctcaggcccattttcttcattgcttcaccctttctggcttgattatcttttaatgtgaaacagatataatgtgcacagctctactttatcattaatttgtattttttggggtagcaattccagatatttttcttaattcaaattttctaagtaggagaaaagcttacttctaatttttttacttgtgtttaaaacaaacaaacaaacaaaaaacaaaacaagaaatattctagggctctgtggtagaaaaatgcccaatattggcaagagccaggaatatttaaaaggtgacttggctaaattatatgctgaataatcagtgtcttacctacctttaagagctttcctttcctttcctttcctttcctttcctttcctttcctttcctttcctttcctttcctttcctttcctttcctttcctttcctttcctttcctttcctttcctttcctttcctttcctaattattgggctggagagatggctcagtggtacactgactggctcttccaaaggtcctgagttcaaatcccagcaaccacatggtgattcacaaggatctgtagtgggatctggtgccctcttctggtgggtttgaaaacagcagcagtgtatttgatgtatgtgagtacactgtggctgtcttcagacacatcagaagagggtgtcagatcccattagagatgtttgtgagccaccatgtggttactaagccaccgatgaggttactccccatcctgacccagctttcaatgtaatcggaataatagactcctcacttttggcttaatgatttctttaacatttgttgttgttcatttgttttgtttagttttgttttctcaagacagggtttctccctgtggtcttgattgtcctggaatttgctctgtagaccatgctgacctcaaattcagatccacctgaatccagagttctgggattgaagaaatgcacctttgtttccagagttctaggattgaagaaatgcaccactgccccctgcctaaacttttttttttttaattttgatattgttttggttggctgttttattttatggcattggattgtttcaagtgtttgacactatgaaaaaatcaacatctgatcaactaaaacttgtatataaagatcttggtatagagagagttgatggtacagagatttgatgggacttctcagtctaatccttatggcaactgattatttgaaatgctgacagttcaatattcttttattcccttccacccagtcttggggttggggatccagccaagggctttgtgtatgctaggcaagcactctaccactgaattccatcccagctgttactgtctgtctgtctgtctttctttttgtctttctttctttctttcagtaggaagcttatttaattaaacaaggtgctttatgtgaaagaactgtctaggattcattttctttctttttggtttttcaagacagggtttctctgtatagtcctggctgtcccagaactcactttgtagaccaggctggcctcgaactcaaaaatctgcctgcctgtctctgcctcctgagtgctgggattaaaggtgtgtgccaccaccgcctggcctttgtgtgtgtgtgttattttcttaagttccttctggagctgaggactaaacccccagggtcttgaacttgcctagcaagagctctaccactgagctaaatccctgaccccagttcatttttttcttttttttttttttttaattttttttttaagatttatttatttattatatgtaaatacactgtagctgtcttcagacactcctgacagatggttgtgagccaccatgtggttgctgggatttgaactctggaccttcggaagagcagtcgggtgctcttacccactgagccatctcaccagcccagatttatgtatttattttatgtatatgagtgcactgtagctgtctttagacacaccataagagggtatcggatcccattacagatggttgtgagccaccatgtggttgctgggaattgaactcagaacctctggaagaacagtcagtgctcttaaccactgaaccatctcttcagccctcatttttttctaagagtgatttaccactactaaaagatacattgccatacatgtagctgctatataaaaaaagttaggaaattgtccttggttttacaatgacaaaggaaaataagtagccaggtggtggtgtcacatgcctgttagtcccagcacctaggaggcagaggcaggtggatttctgtgagtttgagggcagtctggtcaacagagttagtttcaggatagctaggaatacacaaagaaaatctgtcttgaaaaaagaccatttttttttttttacagctgaacaaagtatgtaaggagttttatgctgttgggtttatttgttcctggactataaaagagtggactaagcaggtcactaagggagaaatggggggatcttttctcaggaccagtaccttcctccagacaatctccatttgaagttggccaaaacagaagattggcgattcagtttgaaggaaagaagcccaatatgcttgtccatgggcaccaattgctttctgtacatacaggaaaggagcagggaaggggaggggaagaacggagaaagaaaacttccggtcagagtgtgctgggactaaatcatggctttctattgaagaatatgtttttggtctataacacaatcctggggtaaaatagcagcttcccttttagtagacagctcctgtctgctgctggaatgaatgaatcctctggtcatcttccatttctaacagttgtgtctgcttcattgattgattgtctattgccaggagctcatctgcctcactggcaaactctcttgttgctaataggctttccttaattcaccaagggccataggcctccggtttgcactgcaccacagaagcagcctgccctagaccaccttcaggttaacatagttcttgttcttaggcttgactccttccttggctttctcctctgacatggtgagagccaagaaacccaagtccactctgaaggaacacacaagcagtaccagggttggcagaaggaggtggcactgatggaccacaaaacctatttatttatttttatattctgttttgtattgttacttttaatagtgtgcatgtgtgtgtgtatgtatcacctgatgtgctaggatttgaactcaggtcttctggaagagcaacaaatgatccttataacgaatgatccatcttgccaccccagtccccattttagacatggtctccactgtgtaactctgggtggcttaaatcttgctatgtagatcaggttgttgtcaaactcaaagagatctccctacctctgtttttcaagtgctgggattaaatacatgtgctaccacactgtctagtcttaaagtagaagttgtctgaattgagagatgttagttaacatcttagaaagtgtctggtagggtgatattaccaagcaactgtatgataagccaataatttaactacactatctgggcaatatttgtgtgtgtgtgtgtgtgtgtgtgtgtgtatttcaactgagtgagacactgcctcaaaatgaaaaagtaaaacaagggctgtaagtatagggtaagtggtatagtcattgtgtagcatgaatgaggaggctctgaggattcaatctctagtactgcaaaacatttgtgatcctaatttttcagacactggtttcatgtggtctaatcagactcctatactctctctctctctcttttttttttttttttggtttttcgagacagggtttctctgtatagcgctggctgtcctggaaatcactttgtagaccaggctggcctcgaactcagagatccacctgcctctgcctcccgagtgctgggattaaaggcgtgcgccaccacgcccggcttctctctctctctcttttttttgttgttgttgtttttgtttttcaagacagggtttctctgtatagccctggctgccctggaactcactctgtagaccaggctggcctcgaactcagaaattcgcctgcctctgtctcctaaatgctgggattaaaggtgtgcgccaccatgcctggctatgactccttgaactcttaattttcctgtcttctcctaagagctgtggttgttcgtattcaactttaaccctgatttcctgattttgatcagattaaccttttatatagttggtcatgagactgtcagttatatatattgtagttttctgtaggtgagtacatgcagtgtgtgtgtgtgtgtgtgtgtgtgtatgaatgaatgaatgaatggtttccgctgcatgtggtggtgcatgtctgtctaatcccagttacttcaagactgaggcaagaggattatgagttctagacaaacctgtgcaacacggcaagaatctgtctcaaaaagcaaaacaacaaaacagtatttttggccgggcagtggtggcctacctccttaatcccagcacttgggaggcagaggcaggcggatctcttgagtttggggccagcctggtctacagagtaagctttaagagagccagggctccacaaaccctgccttgaaaaaacgaaaagggggctctgcttatagaattgcattttatttgctttttgggttgtagggagaagggcagtgctaggggaagtttgcttattcaatgtacacacatcatttttgctctgaaacgtcgaggattgtatgcagatgtttggttgctgatgtgctaggcattctgtatacacacacacacacacacacacacacacgtgcagacatttgttgtggagagtaaccattttgcttgaaagttgctcattttgtttggctctagactttgttctactttagatctattgtatttttgtctttttgtggttgaaatgataactctgaaaagacctattattactatagccagttcttcttacctggggaaagattttcttgccctggaaaaagttctttgagatttgccccgtagctgctattttcacatcctgattcctgagaagtctgttttggcttaaaatagtcatccctgttcctggtatcttcaacccgctatctcttgttcctcataatttttgttgagagtattactgttatgatcaataacctacaccgtattttgggagaaggccttgccagttcatctaataatacttgagtgtcagtgaagagcaaagctgggcgctgttatcccttcattccaccactccccaaccactcactctccactccatcctccttcagcaagatggctcactaagtaaaggtgtatgccaccaagcctgaattttgcccctgaaatgcacacggtggaaggagagaactgacttacaagcttcctatagctcactatagctcatgtcacctccccaggactacagggtttcctctgcagagtcagaggtcagcactctgtgtgtgatctagctaccaatttggggcccttatttatttgtttttttaatgtaaagttctattggaacttaccaaagcctgtttgcttatgccacctagctgctttttttttttgtagcaactacaaaaatcactttggagttgcagagttgaatagttgcctcttatggtctgcaaagcctaaaggaagtgttctctggcctttatagaaagttcactggtttgttcactaagtaaatgtaggaaaaccacccccagcctagtagagttcataaaaaatacatgcataaacatgtactcaggccaaacaattattagctacctcagctcaccatgttaggagccacacctaagtgcatcttaacagttttccattcagtttctacagctttccttctgtcgttttgcagtaattcacaagctgcaaatgtttgttttgagacagtcttactttgtagggaaaggaggtctgaacctcaccttacaaagtccattctggacttaagcgtgtcctgatcctcaagtgagtgtaaactatggtatgtgctaccatacccggcttagaaactgctgctcttctgaggcccacttccacaggcaaatttcaggtctgtttccaaggcacagtggcatacttacgtgtttgtacatttctggatcgtgtgtaaaattgctatcattttggagttggaaagatggctttgtggttaagagcactggctgctcttccagaggacccaggttcaaaccctagcacccacatgcagttcacaactgtctgtatgctcatcatgccttctggcttctgcaacattgctcaagtaaggtgcatagacatacatccacgaaacattgcatatgtaggataaagggaaaaagcctgctattgttccttccttccttatttatttatttaggggtcttgctttgtagttcagccttccttcaccaccttccactcttcagtttgcttgcttgtttagacagggcctcactctgtagtccagtctactttgtcaccatcccttcctggtgctaggattatataggcatgagccaccacacacaggattttcatctcagcgccagtactttcaggaactcatttgttatattattggacttattgttgtaaaaagcactgattcattaggtattttaggagtattgtgaaaatcaaggaaattagttggctataaagcagattagtgtcagacatactaatttctcatattattactgattattgttgccatgtaccagaaaatgttctaaatacactgacccagatggataggaacactgtcccacagagtttatattgttcttttacaaatctcttaggatatgcccatcaaattgccatttgaacagttatgtttaatacctgcagacttgtgctcctgccagaacctttctttcttttttttctacagtgagtgatggaaactgtgggctcaaattgttaagcctgctggaaataagtgactgttgaatgctcagcctatgtggtacttgtatatcactttctgtaagtcttagagaatattacagaacaggggtgcacagaatgtaagaaatagaagtagtagctacagagatgctgttcttccagagagtgagcttacacgtgcacacttacgtacataggcaaacactcacacgaataaaaaaggctggaagaagtggactgaggtagaacttcttttttttttttttttaagaaaaagatttatttatttattttatgtatgtgagcacactgtagccgaacagatggttgtgagtcttcatgtggttgttgggaattgaattttaggacctctgctctctccagttgtccccactctcttcactcactcagtccctgctcacttcagcttaaagatttattattatacataaatacactgtagctgtcttctgacacaccagaagagagtgtcagatctcattacgggtggttgtgagccaccatgtggttgctgggatttgaactcaggacctttggaaaagcagtttgtgctcttacccactgaaccatctcaccagccccgaagtagaacttcttaagactgtttcactgtagctttaatcttttcaatgcctgcttcttcttttttttttccaggcaggatttctcggtgtagccctggctatcctggaactcacctggtagaccaggctagccttgaatcaatgcctgcttttaaatgatggttcttaaaccgctttcacctccctgctagaccaccacctaccagaggtagtggaaaagaaggaatgtggggaagtggggctgtttagatattctttggagcatctgtgttgtctggacattgtcagttcagttcataggttagcagtggcagctctacccacttgaaaacacttcacaggtatactagcagttcattttgatagtgtcgggataccaaatgtagatcagcagtagtggcacgacctagcagagacaatcaggcctcagctgaattggcatgagtgaacaggaggattaagaccagcagggatgtcaggagaagtcctctgctgtgcatctctcaacaaagcgaagatgagcataaaaatgagaccaggaagcattgtaaagctagctctataagcaagcccctttcacaatctgctgagtcctagtcataccctctgcgaacatcatgtgtgtcctccagggatcttgtctcagcacctaagtcggtatcagctgacatcactctgctaatcccaagtctgaagaagtggcaagaagccacagaaacttttccagaaggttttttctttttcttctttttttctttttttctttttctttttttgctgcgtttctctctatggagtcatgacaaattgagctcaactaatacatgggtgtcattagtgatgaatccttcaccatgtgcccttttacatgtctgcataatcctttcacctgtgtctgcttcagtggcacattccttcatgagtgtgccacattgaaacatcttttcacttgtgtctgcttcagaacacgccttcaagtgtttgccccagtaaaacaccatctgacacaactgactttccaaagagcccttaagtttccacttcgcatcactgttgtactttagaaaaaggtttctttttacttatgcatacgtatgttctttctgtgtgtgtgcacttgtgctgggtgcctgtggagaccagaagagggcattggatcccctggagttggaattacaggaagaggatatgagatgcccaatgtaggtagatgctgggaatggctcctgtcctctgcaagggtagcaagtactattaacttctgggccatttctccagtcctgctgttgcatatttgatcccacagttgtgatcattgccatggaatcaagtatgggcctgacagcattaagttttttttgggggggggttgtttagacctccatgaaaatgactgctaggagaggtaagctcaagaggtactacttctctttgtcagtagccaattaactgtcaatgggggatggagagagacttctttattggcgtgtacataatccctcactaggccttctaaatagccctagtaaaacttcctggaaactaggagaggagctaggttgggcgatgaaggtaatcaatgggaactgaaagagaataggatcgatcggcaatagagatgaatgatacaaatatatacatatgaaatatagactattatatagaatcaacatgcagtaatataaaacttgtactaatatatgttttggttactaatctagccctctgcctggaaaatggttttggtcttatcgaaaagatattttaatattcatttatagaaaaacatgtaaattaaaataagtgttttagccgagactggtgggacatgcctgtaggccaagttcttcaatgatagaggttggaagaccaagagtttaaggttagtgacttgtgtgtgtgccctaaggattgagtcttgggtagggcttcctgtgtgcttaccatgggctaacctgccaatatagagaatgatagtcttccaccttttctctttctccctctttctgttttgattatttttatgaatgtgggtgtgggtgtgtatggataggtgatcaatgcctgcagtggccagaagagaatggagctgtagttatagacatctgggagctgcttggtgtgtgtgcaacattctaacctctgactcagtgaagttctaatcagcctttgcaaagatagcagaggtcgcagcggtcacggtggtccatcccccatccccccaagccagtgtttctgtcttgccctggctgttcttctgtagatcaggctggctttgaattcagagatttgcctgcttcttctgggattaaaggtgtgtgccacgactgccaggccagaaattcttgttcatgttgtatatatttggcaactgtttttcaattcactatttgtgttagccatagttattttacatcctcaatctgttaattttaaattctccatcgtatctgagtttggtcttgatgcttactttgaatttttagactatgtttttttgtttttattttacttttttttttttttttttgccctgtagcatggcagcctgccttgtctttgtggttggaagctaggcatgctgtatctactaacagaccaaggtcagctctctgggttttagtatccgtttttgttttttggctaccactgtttatcaaactcagcctcatctgccacacaagtgttgtgagtttccctgtacattctgggaactaatgaaggtcctcttgaagagaagccagtgttcttaactcgagtggccctctccagccaagtttctcgttttgaccttgggaaatatttcccaagtttcatatccacttgggtaaaacaggaaggcaagaaaagtctggggatattttattgcctttcctccaagaaggtagataatgctttgggcatattttaatatgttgatatagaccaggtagttcctagtgggaaaaaaaaacagcaaaatatgggtattcctgtgagactgaggccacagtggcggtttcatttttttctatgacttacagttgtgagcggccattgagttctaggaatcgaacccgggtcctctggaagagcaaccagtgctcttaaccgctgaaccatctctccagctggcgacagctgctgcagcaggggttttaactcttcactcaatccgtccttggcttccagcagc

SEQ ID NO: 95 - DNA, 543 bp, mus musculus
tgaggaagtgcacccaggcaccgcctataaacttccgttgcggctctagcctctctctttccgagctgctagcgctcctgcgaacatggtacggtcgtctgtggggctttgatagcatccagtttaatccttgtacccagcgtgtacagcaccatcccagcgtgcatctgggctctggcatgacctcgatgtacccgagaaacctaacatagcagagagcgacacagagggaaccgagttctgggtggaggaattgacttgatggcgtgacttagcggcgggtggatgcgcagtttggtggcgcgtgggactgcaacgccttttagagctacatggtcgttgtgtgttagtgaggagtcgtagaataaatcagctttatttgcatccagcgaggactctgcgccattgtggtccggtaaccgagtgctgtacactattcttactaggtgaacgtgcctaaaacccgccggacattctgcaagaaatgtgggaagcaccaaccccacaaggtgacacagtacaagaagggcaaggattctttgt

SEQ ID NO: 96 - DNA, 2373 bp, mus musculus
ttccgagctgctagcgctcctgcgaacatggtacggtcgtctgtggggctttgatagcatccagtttaatccttgtacccagcgtgtacagcaccatcccagcgtgcatctgggctctggcatgacctcgatgtacccgagaaacctaacatagcagagagcgacacagagggaaccgagttctgggtggaggaattgacttgatggcgtgacttagcggcgggtggatgcgcagtttggtggcgcgtgggactgcaacgccttttagagctacatggtcgttgtgtgttagtgaggagtcgtagaataaatcagctttatttgcatccagcgaggactctgcgccattgtggtccggtaaccgagtgctgtacactattcttactaggtgaacgtgcctaaaacccgccggacattctgcaagaaatgtgggaagcaccaaccccacaaggtgacacagtacaagaagggcaaggattctttgtatgcccagggtaagctgcttagatggaatttggtggtggttgtgtggtggggagttgttgagaaagaccagagcctccccctctgtaaggcaggctggcccggaataagcaaacttcctacctcggcctctcaagggttagggctgtacctgttccctggcatgccagactcaataatttggttttgatgtgacagatgcaggcatccctcccccccaccccccttagtactatttcttaatgcagggcagcctcaaatttaaacctgagacttttccttgtgactattttgacttaggaccctaacttagtaccctaacgagtaactttttccaggaaagcggcgttacgacaggaaacagagtggctatggtgggcagactaagcctattttccgcaaaaaggttagtgattgccgacacatggtaaggacttgaattttgtcaccccttgttagcaagcgttgctttagtgttgaccacagtaaagttctcccacttggtggcagggacatttcccaggtagcagagctgggcttcaacccagatctgtcttagaacttaccatgttaagctgttaggggaatgaaaacttttgggggtgttttttgttgtttttttgagacagggtttctctatagccctggctgccctggaactcgctctgaagaccaggctggcctcgaactcagaaatctgcctgcctctgcctctcaagagctgggattaaaggcgttcgccactaccagctgggctgaatgaaaacatttaaatgtccagctaacttgtgtggaaaattgataacatttcaactttcaaactgccaaatagcaagtctttggccaaaatggtggactcagttgattattagtgggcagtgagtgtagaagtccagaaaagtgtacattagtctaatggaagttttaaggaaagtgatccatcttattatgaattccaaaagttttaattcctagttagcatgagtttggctggcaaaaataaagtaacctagaaggctaccaatttaatgtagcttttttgtgtgttgggggggggggaactatgtagcacaggctaacctcacattcctgtggctgtaccttgcctctgggaaccacaagtgtgtggcagcaagcactgtttccatttcattttgttactgttagacttttctcttaaaatcaacaggcttctggatttttttttaactccatagctaaatgcagactgtggcagaatggaatttcatgagaggtttgacttggtatcttttctaggctaaaactacaaagaagattgtgctgagactggagtgcgttgagcccaactgcagatctaagaggatgctggctattaagagatgcaagcattttgaattgggaggcgacaagaagagaaaggtactctccttttgaatgtaaagccttatttgtagagctaactgtctcaggcctcggtgtatatagggtaccctccaagatattatattgtccacagctgagttacataacccatatctgaatgcatgggaccagaagtatttttttttatgttctgtgaatctggcatatgctttattagtaggcacaaaagtttgcacaagtgcaaaagtttgaacaccaatatataaaagaaatggcctctacgatttcagtatttggattttggctgtggctgggattgaacacaggaccatagattatgtaaaaaggttccttaaaaattacaaaacacaacattttgtttttctgttctgtttacagggccaagtgatccagttctaagcagattttgttatgaagacaataaaatcttgacctttcaacccctttgattgcagttgttcgtttgggagggaatacattaaaagctttcagaaattacctgaa

SEQ ID NO: 97 - DNA, 358 bp, mus musculus
atggtccagtgtttgacataccatcgtaggctttcctacaacacagcctctaacaaaactaggctgtctcgaacccctggcaacaggattgtttacctctacaccaagaaggttgggaaagcacctaaatccgcatgtggcgtgtgcccaggcagactgcgaggggttcatgctgggagacccaaagtccttctgagactgtctaagaccaagaagcgcgtcatgatgcagggcctatggtgtgtccatgtgtgccaagtgtgtccatgacaggatcaagcgggctttccttattgaggagcagaaaatcgttgtgaaagtgctgaaggcacaagcacagagtcagaaagcaaaatag

SEQ ID NO: 98 - DNA, 358 bp, mus musculus; identical to SEQ ID NO: 97

SEQ ID NO: 99 - DNA, 7951 bp, mus musculus
tgcatttctctaggtctaaaggcctcatgactctatatacttcaagagcgcttcaccaagcaaaagaaggacagaagcgggaacttcgttcattccaggttcgtatgagtggggacctgtactaatgataaccgtaggagaccccttacaaatctagttcttagagtttctgttccttgtccatttgttctcagccctcctgccatccttgacacaatccatctggcatatgaaaatagctgggcattggggaggataggaagaaatgaaataaggggtgaaaatttgccaatcatcctcttctagcaagctcattgttcctaccctttccggttcctgtttgtatctatttgaataatgccggagagttagaagagacggttaaattaatttccttcttccacttctaggtctacttccaggggcagctctgctggcctttaagtggttaaacaccattgcccagacacaccatcctctttcctagcccaagtgagccctcctatatactgtccgtgccttcagcaggggtgattacatgggccgtgtacaggatgtgggctgggcgactgcaggactggtgatctgggctggtacctgctactgcatttacagattaaccaagggaagaactcagagtgtgagcggacatgccagaaatgggtccagaatcgagacggagactgtggttggggaacagaaccagaccttggccacaagtgaagccatggctggaagagaggctgagactagagtcaagactgaaccagaaactggagaaggaggtgagcctgtggctgaagtagactccaaggtccctgttctagtaagatccagtggcaactgtcaggccaagacaatgcttgaggaagagatagagacccagtctgagaccagttcattggtggaaacaatggtcatgacagaggcagtgactttgactgaatccacatcccaagccaaggaagtaaccatgaaagaggcagttacacaaactgatgctgaggctgaggctgtaggcaagaaagaggcagtgactcagaccaaagctaaagcttgggcaatggctggcagggcagaggtcaagaaagaagcaatgacccagaccaaagcagaagctcgtacattggctgaaaaagagacagagattaacagagtaacagtgacacagagtgaggtcttggcagtgaccaaggaagtagtcaagattggaacgatgaatgagactggagttgtggctgaagccatgataagaccactggaagagactgtgagtgtgactaggactcaatctgaggctaggcttgatgctgcagttgacactaaggagaatcttaatgatatgtctgtcgtagtgactggagtggacacgaagtcctgtgcacagtctcaggctgtggccataatccaaaatgatgatatggctggtgctgaggctgacaaggaggatctcaaaaacatgtctaaggcagggtctgggatagatatgaaggttcctggtcagcctcatattgctgccaacaatctggctgaagctgtgccaggggcaaagaatgatgcttgggacaatgcaaaggacatttgtgaagcagaggcagatataagaacttgtttaatacaatctgagactgtggccaagatagagactgaggcaacatccagtgccacgatggatggtgggaaagatgccaatgctaaggcaatgactgatgttaatgtaacggatacccagcctcaagctgtaaccagtgatcagactgaagccatgcctgatgccaaggttaagggtaaaggtaatgccagtgccatggctaaagcaggggccaaggcaaacaccaaaaccagttcgcagactgatgccttgcctgatgctggggataaaaacagaagtgataacaatgtcacggctaaggcagagactgggatagatatggtttcctgtacccagactgagcctgtggccaaggacaatgccaataccacgtctaaggaaggagctcaggctacgggccagagccagggtgaagccttacctaatacaaaaggtaaggctagagggaaagccaaagccaagtgtaaggcagcggctgggacagacacaaaaacttgtgcacagcctcaggctgggacaaaaactcaagctgaggccttgtctgattccaaggttgatagcaaaagtgactctaatggcgtttctaaagcaggagcaaaggcagaccagaaagcctctggtcagccacagcctgtggccaattgccagaatgaggccttgcctggtactaagaataaggtcaagggcaatcctaatcctacgcctaagacagaggcggggacagctacaacaagctctgcccagactaatgtgaccagttcccagggtgagaccacacctggagccaagaataaggccaagggtaatcggaattctgtgcccaaagcaggggctgggccagatacgacgggttctgcccagtcccagactgtagccaattcccacagtgaggctttacctggtgccaagaataaagttaagagcaattccaatgttgtgcctaaggcagaggctggggtgggcgcctgtccccagtctgtgcccgcttcccagggtactgccttgactggtaccaagactaaggtcaagggcaattctagtgctgtgtctaaaccagatgctggggcaggtacaatgggctctgcccatgccaagactgcggcaaattcccagggtgagaccttacctggttccaagaataaggtcaagggtaattccaatgctgtgcctaaggcagaagctggggcaggtacaacggagcctaatcagccccaggctgaggccttgcttggtgccagaaataaggtcaagggtaattccaattctgtgcctaaggcagagtctggggcaagtacaatactggctttggcttcttcccaggctgaggccttgcttggtgccagaaataaggtcaggggcagttccaatgctgcgcctaaggcagaggctggggtaggtgcaaggggctctgcccagtcccaggctgtggtcagttcccagaatgaagccttgcttggtgccaggaacaagattaggtccaatgctggtactaaatcaggagcaagaacaggtacaaggggctctgctcagccccaggctgtggtcagttctcagaatgaagctttgcttggggcaagggataaaggtctatccagttcacaggtagaagccactggagacaatagggtctatgcaaagcctatggtaggggctgtgcccgcttctgaaatggtgactgtggcaggtgctcagcctaatgttcatgattattactggaatgggattggtgttgaggactggattgctgctgagaggtggatcaaattcaggtttcagactatagatggagactgggagaatagtgtttcctggactgaggatgagagtggagccactattgggccctggactggggcggctaatgacaaggctggccttgttagctcctgggctgtggcttgtgatgaaagtagcattaagtcctggactggggctaggcctgagaatgaggttgctcttgggtcctgggtaagtgctggtgaccaggccactggagcaatctgggcaggagctcagactactgatgggacctgggttgcagacaaagccagtgcaggttcctggactggggccgagaaccagatcagtgcaggttcttgggttgtctctggaaaccaggccattgctgggccctgggctgtgagtcaggtcactgatgggtcatggcctgcagtccaggctagtggagtgtcctgggttgtggaccaggctactgggacctggactgtagctgagaaccaaactggtgcagtgtcttgggctggagctggcaatatagttagtattggatactggactggggctgtagaccagaccaatgcagtgtcctggacaggaactactgatcaggttggtgttgaggttaagccaaggtttgaagatcaggccagtgaaaaggggtcttgggttgtagctggtgtccagactagtggagagaccaggttgggatctgaggatcaatccagtggaaggtcttggactgagactgtagaccaggccaatgcggcatccaggcttggaactgtagatcaagctggtggtacatcctgggctggaaccggagaccaggttggtggagtatctacatcagggtctgcagaccagtccagtagtggatcatgggctggcacgaggaatctggctggggaaagatcttggactgggactggcgatcagtcggatggtgcagccaaacctggttttgagaatcagaccagtgatgaagggtcttgggctggcactattggccagcctagtggaggttccaagtcagtgtctgaggctcagtctgctggaagatcttgggcagattctgcagaccaactcagtggagggttcttggttgggcctttggaccaggccaatggagagtctcagcctgtctctggggaactggctgctagtggagtagatcagactagtggaggaggatgctggactggttctggggaccagtctggtggagaatctaggctgggtcccagggaccaatcgaatggagagtcttggcctggcactggagatcagactggtggatggtactgtacttacactgggactcagactattggaggaggcccttgggttggggtcagtggccaggatgttggagggccaaagccagtgcacatgaaccaggctactggtggggcctggcttggcactgggactcaggtcagtgcagtgtcctggactggtgatcaagttggtggttgttccaaacctggatttgaggatcaggccattggaggaggattctgggctggtgctggggaccagaccactggagggtccaggccagctgtgtctgaggatcagtctagtggaggagtttcctggggtggtgctggtggtcatgttattggaggatctagaactgatcagtccagtggcacgtcctggcctggcatggggagtcaggtcagtggaggctcttggattgggagtgtggaccagactagtggctgtactaaatctggatttgaagatcagacatgtgcaggaggctcctgggttggtactggggagcagactagtggagactcctggcctgggtctagggctagtaatgaagccagtggaggatctaggctagatcctcaagaccaggctagtggagggtcctggattaggtctgaggatcaggccagtggacgattccttgtcagtgctgaggtggaggctaatgaaggattttggtttgggcctggcagtgaggcctttatagggtcttggtgctggacagaagaggctactattttgcctgtagctgggatgaaagatgaggccagtactgaatccacatcagggactagggaagaaaccagcattagttctggcttaggggatgaaaaaaagaccagtcctgagtcctggaccagatctgaagaggcagctcttacaggcacctgtgatggcggtgaggctaagactgtggctggagctgaggctgaagttgatcctgagtctaagactagagctgaagctaaggctgaggctgaagctgagaccaaggttgaggctgaggtgcgagtggagactagggctgaggctggggcagcagctacaactgcttctgaagccggagctgaggcaggggctagagttgaggcaggggctggggctgaagccggaatggggttttggccctggaatggagatgacactactaaagggtctaggcttggagctgaggcagaggctggggctgggggaggggcagaggctggagctgagaccgagaatagcatggggttttggttctggaatggagatgcagctactaaagggtctaagcttggaacggaggctgaagctgagactgggattggaacagggacaggggcagggacaggaacagggacagggacagggacaggggtgggagcaggggtagaggttcaagctgtggctgataccagcatgggattttggttctgggatggagctggagccactaaagggtctaggcttgggactgaggctgaggctggagttggggcaggagctcaggctggggctgaagccgtgggtgggaccagcatggaattttggtcctgggatggagatgaagctactaaaggttctaggcttggggctgaggctgagcctgggactggagttgtggctgagcctggggctgagaccagtatggggttttggttttggaatgaagactcaaccactaaagggtctgggcttgggactgaggttggggctggcttagggtcttggactttttctacaaatgtaaatgatggtgaagaggaggaggaggaggatgaactaagtagagaatccagccctggtattgaagagattagtctaagaaccctatttggggctgagagcgaggacagtaatgacctcagatctacaaatgaaaaagatgtcagttctgaacctgggactggggataaggctgacgacactaaagaccagtttgatgctgctaatggagttgacataaggtcttggttctatactggtaatgaaaacaaatgtgaggatgaatcttcatctcaggtgaaagtcaaaaagtcaacggagtcaaggggcatatatccatcgatggtccctggggcaggaatgggtgtatgggatggaaccattgtttgttcggaaagcaaattattacacaaaacaagctttccaggtgaagatggcttcagaaggcaagtcagtactggagtcaaggtgcattcctgcaactgccgctgtaagcgtactgttaatctggatccacacgatcttgaaaaactcatttgcatgattgaaatgaccgaagatccttctgttcatgaaatagccactaatgctctatataacagtgctgattatccttatccccaggaaattgatcggaatataggtggaatttcagttatccaaagcttattgagcaatccctacccaaatgtccggcagaaggctttaaatgcgctgaataacatctcagttgctgctgaaaaccatagaacggttaagacatatttaagtcaagtatgtgaagatactgtcacttatcccttgaattcaaatgtgcaagtggctggactaagattgataaagcacctgactattactagtgaatatcagcatatggttaccaattatatttcagaatttctccgtttgttggctctgggaagtggagaaacgaaggaccatgttttaggaatgctggtgaatttctctaaaaatccatccatgacaagagacttgctaattgccaatgcaccaacagcactgatcaacatctttagcaagaaagagacaaaagaaaacatccttaatgcccttttactttttgaaaatataaatcgtcattttaaaaaaagagggaaaacatatccccaagaccggttcagtaaaacttccctttatttcctgtttcaacgacctaaagcctgtgccaagaaacttagagccttagcagcagattgtagtgacccagaggtgaaagaaagagttgaggtattaataaataaactctgattaactatctgtttttcccaaagtttgagtaacattttggtttttcatcctggacatgatgcgcattgtaaattgcattagaattttgaaactggtgttgcctatgaggatctatagctggacaattttaggaacaacaaatgagttcaagcttgtaccgaaaatacatgtgtcaatttttatcttgtctggattgagatatttttagtatgcttcatgagcaaaacccaaccgattcttcataagtaaggtaatctttggtcctttgtgtggacttatgtttatacatttgagactttatttttatgtcaccaataaagttgtgtgttttaagaagcaaaa

SEQ ID NO: 100 - DNA, 8830 bp, mus musculus
gggcgggaatgtaagatggcggagtagcaacgcggtactgttggtgttcagactgcctgctgacttccgttcccgtgttggcagcggcggcggcggcgaccactgagcacgttgaggtagttacccaagatgccgaatatcaaaatcttcagcgggagctcccaccaggacttatcccagaaaatcgctgaccgcctgggccttgagctaggcaaggtggtgactaagaaattcagcaaccaggagacctggtaaggacgcaattggtaccttgagtgtacctgacctgcccaggccatggcaactcgggggatggagcggccgtgggatttcctggcagcagaggatgggcagaaaggggcagcagaggttagcttgcctcgcgggttgttccgttattttacctcccgagagggtcgcgttcatcctcgctgcgcgcggttaggtggagccaagatggagatgggagctgaggccgctacgtttgggggttggggatggaggatctaatgtcggggggtaatggcctcctggaatgtctggaggtgtacgggcgcttagctttgggcatggggacacgtggcttgtcgcttcactgtggagccagtagattggattcggttcactttccgcgcgtcgactggtgtacatcagagaacctatggcgttctgagccccatcgtggtctttttcctagatttgaaaagctttttggttggaaatggtagcgttctggtttggtcttgggaaacattgtgttctgagggcgcgaaaacgttaccacgttcccttagactggcacggtgtcggcttttcctatcctgtctgtcgaggaatcaaaccacccttaagttaaattcagtagatggggtaaagtggttgctttgagctcaacatccttgatcttcgacatctcagcttaagtcatcccaaaaaaatagggaaaccttagttgtagaattcgaatttttgacggtttccaattccgctactggcagacataataatacaagcactccgcccctcctccattgtagccacttcttagtgttaaatgcgtgaggatttagggaacgacttacacgtgagtgttcagtgacaaaataataacgcagtggaagagctagctcaaacagcaaagggaaatttgaatgtcgtctttttggtgctctgctataaaactcgtggcccagcactggtgtgctgtcgcatgccactaggcaagagcaggagaagcaagtttgaagcaagcctagtctgcatagttaactctagactagtcaggactatgtagtgagacggtctccgaaaaattgctaacagaactgtcttagccccagtcatcatccacatgcactattggaccgtgcttcttttagtgcccccttccagctatatacaggatcctctagagcactgtattgttttcctgtagtagatgaaatcaagaacactaacaataatgcttttttgttcacttattttaattttggttttagggttgtttgtttgttttggggggtagtctacaggactcaaacatttatcctcttgcttttctcactgcctgcttagtactgggcttgcagacttgcgccatcactacctccacagtctacaatctttcagtcagctgttaggggtcagttttttttaaaccaatgatcaattaaattacataagatttattctttctgattatttctaaacgtcttgtagtctttcctttaaattgtttctgtgtgtgttagttaaagttcatctgtaataatggctgcttccaggactagcatgctgttaattgtgatgcaaatggcagtgcaaacactgaaagcatctgtaaccaggcaataccttagtcaaaagaggtgtgcaagctgctgtttttatctctgaccgttattactcctgggcctcaaagaaagcagagcagccccagactttgagaacagcctagctaggggataagaatatttttttaatttaatgtggggttttgtggccactttggttaaatcttctatgttttttttttgggggggggtgatgtgaggactgttttgtccgtttgttaatccttctgccctttgcagaatgcaacacaccagaaactgagattatatttgtggtggtggtcatgggagaagagaacaacatagttttctactgattaatcttgattaagcccaacttggataaggctttttatgatttaagttattttgtatatggatattttgcctgcatatacatatattgtgcatggctggtacctgttgaggtcagaagaggatgttagatcccctgggactggagtcacagatggttgtgagctaccatgtgggacctgggaatcagagctccagtcctctactagagcagcctgtgatcttataactgctaaacaggctctctaaagtttcagctctaagcttggttttgaaaaacagctgaagccgggcgtggtggcgcacacctttaatcccagcacttgggaggcagaggcaggcggatttctgagtttgaggccagcctggtctacaaagtgagttccaggacagccagggctacacagagaaaccctgtcccgaagaaaaaaaaaaaagaaagaaagagaaaaaaaaagaaaaacagctgaaatgttggttattaagcaaaatttttacaaatcatggtaaaagttgggtgagttgctaagtgttttggggaggtggggagtagacctgggtggtttagagcttgctgtgtagaccagtctgtccttggaacttagaaacctgactgtttctgttccctaaagtataattaagcctgcatcaccatgcctgactgcagaatagtttgggtggttctttttgccttttggtgacaagctttcttttttcttctttttttttttgtttttttgtttgtttgtttgtttttcgggacagggtttctctgtgtatccctggctgtcctggaactcactttgtagaccaggctggcctggaactcagaaatccacctgcctctgcctcccaagtgctgggattaaaggtgtgcaccaccactgcccagcggcaacaaggttttcctgtagcactggctgtcctgcaactcactctatagataaggctgacctcccagctgtgtagataaggcagatcgcctaagggtcagaaacaggtgtgatggcacacacctttaatctctgtactgggggaggcagagacaggcaggatctctgagtcagaagccagtccaatctacagaagtagttccaggctacatatagtgagactatatattctgtagttacaaaagcaagaactttgttaaaatcaatattataagtcttatagacctgaagactaataattttgccaagagctttgaagaaaatgctaaagtttagagttaccttatcttttgttttcaagcagcttaagggatagaggcataagtaatggataacagctctttagagacttgcatttacaaactcctcggagttcttatatggatgggtaatttacaagtaataaagagtagaatgcaaaatatatgttgtagggttttattgactcatttgaggctttctaaagtgagaagccactttgatctaatttaaatgctttgaggaatttaagtctgtcagactttctagggggtcagttgtgaaattgtgttatttgttctctaactcctaatcaaacaatttgacactaggaagtgaatctgtgtgaaacacgtgatactctccccttttctgaaactatatccgtagataaacctcggataccaggcataaggcaaacctgaccttattggaaattggtgcacccaacttctactctcccccaggagaacagagatctgggtcaaagaggtgagatgtgtgagatttagccatttgtttgaagttactcaattgttggaaatacttagtctagactgcatgagccacaaaacagaagcacttttttttttatttaaatcagggagtctttcaaggaaagtgagtcaaaaaacacacctttagtctcagccagataaagcaggctgatcccagggttcaaggtcaacctgatttttatagagagttccaagccagccaggaattctcagtgagacactatctctaaaaaggaaaacaagacctgaagaattcctttttaaaagccacttctcgcttagcctccaagagacttgaagtgctggggtggggagatacctaggggcctgtccagaggagaatgggggaggattgtgggagagtgtgatgggggacagtgagcaggatgtaaagtgaataagtaaaaaagaataataaattttaaaaagtcactgttgctttggtggtaacttagagaataattccttgaggtattctttaagcctggcctggcctggccatttaaggatgatgagtcccactatatagcccaatctggtctcacacctatcatacctcaaagtgcctggttaatgcttttttttttttttttttttttttttttttttatgtatctgagtacactgtaggttttgagtcttcatgtggtttttgggaattgattttttttttttttttttttggacctctgctccctcaggtcaacccctcgctcagtccctgcttgttctggcccaaagatttatttattattatacttaagacccaccagaggtgggcgtcagatctcattacaggtggttgtgagccaccatgtggttgctgggatttgaactcaggaccttcagaagagcactcaggtgctcttacaggctgagccatctctccagcccaggttaatgcttttttattttgagacaaatttgcatgcttagctcagatttactccggatttgtgaacctcatgtgtcaggaactcatgaatgcatacaaaaggttttgttgtgagacaattcaggctgtcttcaaattccttataacctgattttcctgtctcaacctggaattaaagactgcacccacacctagataggatctaacccaagacttcctaaataccaaggaaacactcccaattgagctatattcaatatatgtaccttagctacattcttttttattattactggttctctggatacaattttataaaactatcagagaaggaattgtaatcggagacctaaaaatgggtaagtagttatagaaaaaaatcaagatactggcaagaagcatagagaggccagaaagtggaaggatatattcaatatatccaaggaatttttgttttgttttgtttgtcaagacagggtttctctgtgtagccctggctgtcctggaactcactttgtagaccaggctggcctcaaactcagaaatccgcctgcttctgcctcccgagtgctgggattaaaggcgtgcgccaccacatccagcttccaaggaatattaaaaaaaaaaaaaaacctgaatggtacatgacaagctaaggagaaaatattttaaactattttcccttttttttgagacaaggtatgtagacttggctttcatcagtttcctaagggacagatgtgtaagtgcataccaccaaacctggttcagagatggacaattttttatgctaactacagaaattggaagttacccgggttccctcattatacagcttctcggaaaatacagaattaaagtaggtttttttgactgacctcagaagtgtcttttttttttttcttaatacttccgttacctcagctttcattgaaagatgcagtaatggtttacttgagtatacacaggtataatggtacataattatattcttttctttactatttatttgtttagttggttgttttgagacagggtcataaactggcccagactgccctggagctcactgtctatcctaaactgccctcagcctactctgtcttaattataagtgcacaccatcaaaattgaatttagaagcatgcatggtggtgcttttggaggaagtggcaggagaatcagaagtctgagttcattctcgcttctatagtaaattgcaggccatcgtgaattactacatgagtcctttattgtccccacaaaaagaaaataagaataaatttgagttttgagaatagagtatctctggcagatcacttgcctagcatgtacaaaataatgaatgttattcccagtgacaggaaaatgaattttgagttgtagacttatgggcagttggaaaaaacgagaaaaaatatgtcttgctcagtgttttataactttctaattatattttttctcgaaattgtggtttccctgtaaagctatggtataatgtaacaataagtatatttacactgataaaagcctagagaggctgggtagcagtggcacactcctttgagcacagtgccagggaggcagaggcaggcagatcttggagtttgacaccagcctggtctacaaaacaagtctaggacagccagggcctctgttacaaagagaaaccctgtctgaagtaggaaaagaaaagagaaattgaagaaaacaaacaaaagtcaagatatataaagctccactattgacttattaattagcaaaagggtcttttctatttgctttgagatgatttgttttgttttgttttgttgtttttttttttttttttttttttttttttggtttttccagacagggtttctctgtagccctggctgtcctggaactcactttgtagaccaggctggcctcgaacgaactcagagatccgccgcctacctctgcctcccgagtgctgggatttgaggtgattacctctactttcttcctgctcttttcaatggttttaatactgccttcatcaggttttagtatctgagtaatacttcctggccgcaataaaacttgagttggaatctgtttccttctcacccatttctggaaaagactgtaaaatgagcattactactgtttaaatgttggtagaattctcagattaacctgggggttatgggggctagttttgttgcctaactttttcatataatacattttgggggttttttttgggggggttggtttgtttgtttgtttcgagacagggtttctctgtgtagccctggctgtcctggaactcactttgtagaccaggctggccttgaactcagaaatccgcctgcgtctgcctcccaagtgctgggattaaaggcgtgtgccaccaccgcccggcttcatacaatacattttgatcatattttctcctcacccaagtcctcccagatcctcttaactccctacttacaaagctgtattcattagttatcttagagggttatcaatagtattttttttctcagtcataaactagccttttattttgttggtttttcttctttttttttttttttcccagacagggtctctttttatgtaactaccttgtcttttttttttttttaagatttatttattatatgtaagtacactgtagcagtcttcagacactccaggagagggagtcaggtctcgttatggatggttgtgagccaccatgtggttgctgggattggaactcctgacttactttcggaatcggaagagcacttacccactgagccatctctcgagccctaccttgtctttaaaatcaccttcaccctttctcagtttctttagttctggaattgcagatgtatgccaccaacactggcctaattttgtagtttttgtttgttttttttttttgagactctgtatccctggctgtcttagaactctgtggaccaggccagcatcaaactcataaagagatctctctgcctctgcctcccaagtactgggattaaaggcgtgtaccaccacacccagctacttcatgttcttaaaagactaatctcatccctccagaccatagtagttagcaagactttctgcttaattcagagtagttagcacagaaagagggcagggcccacatctctttcatttacctttacatattcctagtagaatactaaggttggcgcgagtatttaatactttagcaaacttatctctatatagcacctttatagaacagtcgtgattcatttctgaggattttcgtcctttccttatgtgtagactataatagttaccattaatagcagatttggtactgtatttggtactgcaattacatctttataagtactttaaaatcaaccaatctttttcatccagtatcacatttataaactcagaatatttgtacagtgaactgtaatgaaactggatgataagttgcttctagtatacaggttcctttaggtgctctttctctattttttcttatttatttgtttttctttttaaaattatgtgtgtgggtacactgttgctgtcttcagacacaccagaagagggcatcagatccctttatagatggttgtgagtcaccatgtggttgctgggaattaaactcaggacctctggaagagcagtcggtgctcttccactgagccacctctctctaacccttaggtgcactctcaaagtctgaagtgattaatatccacgtgtagctgcaacccatccattgcatgtattaatgctgatcctatgactgtagtggtggcttagaaaaatctattgtttatattcattctctttttttctattttagtgtggaaattggcgaaagcgttcgtggagaagatgtctacattgttcaaagtgggtgtggtgagataaatgacaatctaatggagcttttgatcatgattaatgcttgtaagatcgcttcagccagccgggttactgcagtcatcccatgcttcccttacgcccgccaagataagaaggataaggtaggaatggtgtgtgtgtgtgtgtgtg

SEQ ID NO: 101 - DNA, 8830 bp, mus musculus; identical to SEQ ID NO: 100

SEQ ID NO: 102 - DNA, 3141 bp, mus musculus
gggatccgccggcggagcgtccctgcggctgctgcgtggtgaaaaacagcagctgcagccgggaaggcagagggccggcgagctaggcaaggctggggcaaggagaaggccgaatacttctaaattgagaaggaattcctagctaggtccggagttcggtaggtttgcctgggaccttaggggcctgcaatagggacttcccttgggcatgtgctccattgtttgcaaatcgcccaaaagcaggccgctcaggccagggagccccataaaccgcgaggctccaatcctttggaactcagggcagggcggagccctcacaaggcttgtgggggttggggaaagtgcagcttcctgcaggggctggagagggacctaaagactaaagtgtctgtctggacttcaggccagggaggtaggagagaggaagaccctaggcagatggaggacttcggccacagctgtcttgtacacttagagtgactaataggtggctatgctttttgtctttgcagtgcctccggagccagtgtggtggccctagacaacaagattgagcaggccatggtgagtagcatcactgcgtccttgctgtcctctgccttagctgcagcttatgtaactcggaacaggtctaagggcataggtgcaagggttttgccaggacccatcctcattggagaccttagagtacaattagcaggatactccgtcttcactcctccatcccagggctttacagcagcctctggcttcctcctgaatggtgcaaggggagagctatgactcttgaatttgtctgcctcctgcagttggcagagaccagagctcattggatgcagttgcactgcagtgcctctgcagaacctggactagggtcaggagttgggaggaaacagaaagtaaagcaccccacccttttgctggcccagttctgactaggtaaaggttatattccaccaagcagctaaaatgctggagaagcttgagacttctttcagtgagaggctcttagagtgtgctataaagcttaatgtcacaattccctatccctcagtagattcaaagagtatattgcaagctctgtcgtccctccccagaccaaggttcctgtgtcctgtctgagtgtgtaagacaactgtgactcggtgtactgtgttacgtgcagaggaggaaatgccaaaatagatgaaataacaatttcatattcttggagaatatttgtaaaggtgcactatcggcttaccgcagatttgtgccagcaccaggacaaacttaagagagttcttactctagtcagacttgaaagtcattaataattttgagggaacctgcctggaacaaagctggactcccaaccctggtatggcacaaatcctgtaagtctcccggacaagagtcttaagcgctttggagaagagagcgtaaaggatagagcttcaggcacaatatagtgtaggaaggctacatgatggtggcatgaagaccagttcagtggagtggtggcagggtggcagcgccgcggacgggctgtgatgactaacatagctctgtcccacggcaggacctcgtgaagaaccacctgatgtacgctgtgagagaggaggtggaggtcctaaaggagcagattcgtgagctgcttgagaagaactcccagctggagcgcgagaacaccctcctgaagacgctggcaagccccgagcaactggaaaagttccagtcccggctgagccctgaagagccagcacctgaagccccagaaaccccggaaaccccggaagcccctggtggttctgcggtgtaagtggctctgtccttagggtgggcagagccacatcttgttctacctagttctttccagtttgtttttggctccccaagcgtcatctcatgtggagaactttacacctaacatagctggtgccaagagatgtcccaaggacatgcccatctgggtccactccagtgacagacccctgacaaagagcaggtctctggagactaagttgcatggggcctagtaacaccaagccagtgagcctgtcgtgtcaccgggccctgggggctcccagggcctgggcaacttagttacagctgaccaaggagaaagtagttttgagatgtgatgccagtgtgctccagaaagtgtaaggggtctgtttttcatttccatggacatcttccacagcttcacctgacaatgactgttcctatgaagaagccacttgtgttctaagcagaagcaacctctctcttcttctctgtcttttccaggcaggggcagagatgggagagattgagccaaatgagccttctgttggttaatactgtataatgcatggctttgtgcacagcccagtgtggggttacagctttgggatgactgcttataaagttctgtttggttagtattggcatcgtttttctatatagccataatgcgtatatatacccatagggctagatctatatcttagggtagtgatgtatacatatacacatacacctacatgttgaagggcctaaccagctttgggagtactgactggtctcttatctcttaaagctaagtttttgactgtgctaatttaccaaattgatccagtttgtcctttagattaaataagactcgatatgagggagggaggggagaccagcctcacaatgcggccacagatgccttgctgctgcagtcctccctgatctgtccactgaagacatgaagtcctcttttgaatgccaaacccaccattcattggtgctgactacatagaatggggttgagagaagatcagtttggacttcacatttttgttttaagttttaggttgtttttttttggttttgtttgtttgtttgtttgtttgtttttgttttttgtttttcttttttttaagttcttgtgggaaactttggggttaatcaaaggatgtagtcctgtggtagaccagaggagtaactagttttgatccctttggggtgtggaaaatgtacccaggaagcttgtgtaaggaggttctgtgacagtgaacactttccactttctgacacctcatcctgctgtacgactccaggatttggatttggatttttcaaatgtagcttgaaatttcaataaactttgctcctttttctaaaaataaa

SEQ ID NO: 103 - DNA, 5427 bp, mus musculus
ccattgccttcagcatttgcatctacatccttcccactttcctgcccaacaaagttagggctctaagccctggccatgcaaggcaattcacatgatctacagagaacaaggcactcgctctgtcaacgtcttgtcttcttgcttccctccttctggactttggggattttccatggagtcaaaataactatgtaagtggcagttgccttcctgtctatagtctcccacattggagtggaaccagaggggaagagagaagataagaaacaaggacagattacaccatgacatttcagcctccttattcccccagcctcttcagaaaaggggacaagtaagtagtaagaactagatagagcctcagataggagggttgtggttgaggagtaaatggggagaggtggttttgacccatcccattaacactgtactaatgctcagacgctcaatatcctttttgtatttccctttctagctcctaacccagtgtttgttttgtggctggtcccacacctctcgcatcatgtccttttccgcttctcctgacataggaccctgtgttttgctggcaatattgctgaatccttgggtggaacattccctgtagaaaatacggaagactttcctataaatagtttccttctggctatgtggtacacaatgcttcaagtgtgacaaaaagggaagtaagatagatgttccccctcactgcctcctccaacctaccacacccacccaaagcctgctctccaccctttttcagcatgcttcgatccagtgtgagacttctgatgctgggatttttcccagttacccatctactatctagttggaaccccaagtagcaggagctcttgtcctgatgactttggcttttaaagtagaacagaccaatgggaacgtgattgcattctcccaactcaaacaacacattacctttcagggctcctgaaatgaggagagttgattccatcgtcattacatactctcctttaggaggtcacccctgagggaggcagggccagttatgtctgcttccttgcaaaatactgtgattagagctaaaaggaaaagccagtgaagggcctagctcatcaagtgctgctggtgtgctcactccaggtctaggctgtattcataagttgtgggatataaaaggcttagaaatatttctcaatattgatgctgctgggctgttgaagccttacgttactagtttctttatggagtccacttgcacaggacacaagaatatatatgatcagcactttactaggaagtattagaccagataatggatattaatgtactgtgcaatcttctaccccactccaaggtttcgtgcaactattttgagcagaagcattttctagtgtgttcagagttaacccgaaagttaaccctttaggttcttcccccctccttcaaccttccctgtgcttgttatcagaaagtctttgtgtggagacatttgagtcagttgtttcccttcatcctacactgaggttctgtctttctttggaacctgagctacagcctgcttttcatatgacaaaactatgggcatatacaagaagagagacttgtctaagtatgggttgaatctacaggatagtagatcattcagaagaaaaaaaaaacttcctggtataagcttgctccttccttccttccctccctccctcccttccttccttctcctttgacaaaggtttactgtgtagctctgactttgtacatcaggctggccttgcactcacagaaacattcctgcctctgctcctgcctcttgagattaaaagcatgtgccacaatgcccagcaaagcttctttttttaccacattttaaaggctgggtacagaaagaataagaaaaaatgggtagatttaattgaggatgccagtaagtgggggcccaaacttagaggtttgattaaattgtaattgttattacaagactacacactttatttagaatagcctgtgctctggaactatatatattcgttcttttctaaagttctttgggacagtttgaatattttttaatattttcaccatccctaaatgtcaaaaaaggtgactatgcctaaaacttaaagttggccttagaacctcttgtataccaccaatgtttgctagcatcctagaggcattttctcttcaccctgtcttcctccttacctgtatttgacacctccaattcatccctctaactttgtgacttctcctttttcagtaaaccctctttttgattcacaattatccaatagctggtatagtagaaaataaacttagtttctaggtcagtatatttgggctgaaatgtaattcactatcttggacaggggagccaaaccctcaatttcttcatttgtaaatggtagtgacagtgcctgtaatgcagggtttgtggtacatccatcacaatgtcaacccatagttagtatgtcattgatggaaactattacagtcagtgagttgcaaactcagcttggttttttttaattgaagtataattaattagtgagcaattaattaattattattcaatgcaacctcgtgggcaacccctatttcctcctttctctttttttcctcaaagtacctgaatttctctgtcactgtttccaaatgagggaatctgcaccaaaatgattgttttacttttgtcctgtacaccatttttctggtgttattttgcctctgcctacctgtcttatccctctcccgctgccttcccaccatctcccttggaattttgaggtgagtagcagtagtttaagaataatttaacaaaacaataaaaaaattaactcagagattctctcagaccaagaaagctctaggtggcagagggcagataatagagcagggaactctaagaacagctaatcagctaatttaaaagtggttggtttggttggtttggtaggatttttttttccagacctgtttttctgcctagccctggctggctgtcctgaaactgtgtagaccaggctggcctcaaactccaagatcactttttttcctctttcagataacactcccgacgacctataaatactatctctactttgttctgcttgctggatacctcttagttgcaaataccaggttcaaagagcctgaagtttaaaatgtccagaggttggcattatttccagactaaaatggtctgaaatgggcttatgcaaaaggtttgcttggagagtttattgttcagctctctgcaactgtagtgagaattgaatatgttaccattaaaatctgctagttgagccttatttcatagttgaaaacagtgactgttaagttataatgcactaaaagccaggaagaggtcaaggcctgaagattgggcttggctggggccttggccaggatgtcagtaccaggtacctgtttaagagaaataacctgaagcaaataattacctcctttgctgataagaggtcccagtacttttccaataacgtgattgcactagaatatttcattggaccataacttgtggagcactgatttatgggtacttaccttaacatcatgcaaactattgtatatgttggtggaacctaatgttcctctagttctggtttggttggtgtaaacagtattggttattgcatcacttattcctttttctgcccatgctgtttcttacatttgccgttcagattttgtccaccaggtggcctttcttaggaaggagcaggaggaaagaaccttttaagtcttagatgccgccttctttttcattccttccttcctttcttttttatgccaaaagaatgaaactatattttaatgcaaatgtgtaatttttattagacaacagtaaccttgtttctttacagcatcgctactcttaaatggtatatggatttattttggcaaaaatattttgccataatatattttggcaaaatttccccttgggatggaggttctctttggattccctgatcattcattatttcatattttataggaataatgaaacaagttgaaaggaaactagaaagtctgaacatgtagatggagctgttatcagcacgttgagattcctgggaggcacgtccccttggtgttaatacttcagggttctcagtttgggaactcctggggaaatcctaaatcttgctttcttctggctcctgtttacacggttacattatcgcaggaaaggattttcctgaggcagttgatatgtcactttgcattgtagttttcttttcagcttgttgtttattttaaaaagtaacaaaattttgcttttaaaaaatagtgaaatcatgttgctatagcctataatcccagtatttagaaggcttgtgattagaggccagcctgagctatgtagacagaccctgtctagaaagacattaagggaggaaagagggaaaagagagaaggaagggctggagaggtagctcagcggcaagagcactggctgttctccagaggactgggtcgattgttgcgaggttggctcacaaccttctgtaactccagagaatccaacaaggcactcatgtggtacagtcattcataccagcaaaagacccatacacaagagataaaaataaatagggacaagagctctcaggtaatggtgttgaatgtattttcttggcagagtaggatagagagaacaaagagaaaatgactggtatctgttgtcactccattgtcaactgtcagctttcaatatcctctgtcatccacccactgctcctattatgtgtccatcctatatctcatgcagaccacccattattcccataactatacttttcaaggaagaaataaactgagtgggttctaaaatttggaccaggctcggtaagcatccggctaggtgaggtgacagctgcgtttctcagtgcgtgaatatgcagatggaaagcctgtttccaaggaaagagattgactgaggggttagttggctggagaaagtgaagaatggtgggagtaggcattcagagtgactggagagcactgcagagccagttagagcatgccgactggcacccgaagaacttttaaatgcagtaccgccctctgctgaatgctttctacctcctgttagagcatttcttctttctctagaaatcggctccggtttgggttttgccagcctccaaagtcctctttggaaatgccaattggcacaagaaagtgctgaactgtttacagtccctgactaaggttcagggaggggatgtggtttaactgggccacaaagcccagtacaggactcatttgcatggcccctgacgccatgtgacgcagctggctcctcctatataaagaagcaggagccgaaattatctctgagtctgggttggactggctgctgtggagtttgtgacatactaggtgacacccttggagtcacttctcttcaactccagctta

SEQ ID NO: 104 - DNA, 510 bp, mus musculus
atgtctagaaggctgtggtgcaaggccatttttgttggttccaagcaaggtctctggaactaaagagagcacacggctcttaagattgcaggcgtttatgcccaagatgaaacagagttctacttaggcaagacatgtgcttgtgtgtatgactcaaaaaacaaaacaaaacaaacaacaacaacaaaaaccaatacagcgactcctggaggcaaaccaaacaaacccagagtgatctggaaaaaagtacctgggctcacagaaacagtagaatggttcttgccaaattccaaagcaaccttcctgcagaggccattgtctacattgtggacattgtctacaaagtaaggagaaggcatcaaaaaagcccaagccaccctcattggtccacttaaatcttcagcaacaggcgctggagagtatcggaatccatctctatatgtgtttggttgatcttttttcattaagaaatctacacagaatcagtttgatgctgtatccatcccggat

SEQ ID NO: 105 - DNA, 12133 bp, mus musculus
aggaccacttccggccaggggggcgggttacaagctcagacctgaggagaggcttggagagagcagacgtcctctcggctcacgagggcgaggtgagctgaggtggccagctttaggaaagaccccgtgggggcttcagagccgcggcttcggggtgactggcttcacacagcattaaggtttgacaggaacctggctggattcgggatctagcggtttcgatgtggtgggtttagaggtgcctggacccaattctcactgcgtaaaggcgggggcggaatctccgggctacgggaaagtctagactcagtttggggatggaaagaagggatgcagacctggttgggattttggaaaggaaacatctagaacacgttctggctgtagcaaaaagggaggagggtcgagttcaggagggaggtaagggacccggatcaagctgaagaaagggggctggaccccgttatgggctacgaaaaggatgaatcgaatctggactaagaaaggagcgacagaatcctctttaaacggccagaggaccaggcttggaagggagaaaggacgggctaggatccgggtagcactgctttgaaagaggggatgacctggtagggttagggagctgggaatcatgaaggggttatccctgttggatttgagggtggggtatcaatgttgcagaaagggcggggcggggcccttgcagacgtggaccggggggggggggggcgaggggggatagtgttggcgaaggcgactgcggcgcgggtggggggggagggggcttgaggagggtgggaggtgcggaggactgcggaaccacagcctgagtgagtggctgatggttggcgcgggctggcgcggccgcacaggaatgggggcgggggtggggtgggatggtggtaggagggggtggcgcgaagaggccctgtggagcctggggtggggggacgggctgagaaatgatgtaggaggaggaggcggtgggatcgagatgttctgtagctctgagagcgggggacatatgtggacatgagatggttagaatggtcctgtccaccatagcgcatgcgtattgagggccttgaggaccagctgcatttggaaaacctgttatcatgcgcgcgtgcgtgtgtgtgtgcacgcgcatatgtgtgtgtgtgtgtgtgggtgggtgggtgggtgtgggtgcgcgcgtgtgtgcgtgtctctcgctctcgttctgtgcgcatgcgcactgtcaggttgcggtgtggtagagggtattaaggtgtaggtcgtagaattaatttgccatcttggaagcaaaagatgctgcagctcagagaccacatgttctgggcttctagataggcaaacccagaaagatttggggcctaaaattaggcaaattctttcacccttcagatttagcaagacttctgataaatcttccccctttccaccctcctattatcctctaactcaggcctatttccttcaggctcggctattagcctttcagaaagatggatagaagaaatgaccatggtcatcgggtgcccacattccaggtgagacctctctgcattctgtttgtcgtgccctgaattcatttaccactctggagcctattatcactgtgtagttccataattccttaccttacctatctcagtcttcctttgcatggtacagggaagaggaaacttatctatctcttgctccatccccctttcccaaacccctttcaatgaaattgttcaggaggggaggcaactgtagagaggggtgattgtagggaggtggggtggcccataggattataatcctaagtatgtagggccctctgcctcccgctgggagcctagggcttcctttctctccagatgtacagtcggagaccacagaaaaggacccaccaattgccagccgatctaagaaaaacaagaacaagaagaattctattaagcctatggataagaccacaccggctccccctccagtcccatctgccaatgataatgctagcaacaagcctaaagtaactttgcaggctttaaacctaccaatgttcacccagatcagtcaggcttcagctactactgaggcacccaatatccaggcttcagttacttctcagacccagaaagccaagacaatgagagttactcccaaggtatccctaactggcagtgaggatgccactacacagctgaagccaccattacaggccctaaacctaccagttaccacaccgactatccagactccagttgccaatgagtcagctaattccctggcctcaacagctgtcaacaaatccaagaaagcttctacggcaaacaatgctgccaataagactgtacctagtgctgctgagatctcattggcttcggctgctacccacacagttactacccaaggccaagctgccaaggagacaggtagtatccagactatagcagccactgcccgaagcaagaaaaattccaaaggaaaaagaacacctgctaagaccacaaatactgacaatgaatatgtagaggcctcaaatgccattgaggcatctagcagacagattggggcatctggcagacagactgaggcatctaacagacagattgaggcatctagcagacagactgaggcatctaacagacagactgaggcatctagcagacagactgaagcatctagcagacagactgaaacatctaacagacagattggggcatctaacagacagatcatggcatctaacagacagattggggcatctaacagacagattgaggcatctaacagacagattggggcatctaacagacagacagaggtatctagcagacagattgaggcatctaacagacagattggggcatctaacagacaaactgaggcatctaacagacagattggggcatctaacagacagactgaggcatctaacagacagattggggcatctaacagacagactgatgcatctaacagacagactgatgcatctaacagacagactgaggcatctagcagacagacagaggcatctagcagacagacagaggcatctagcagacagactgaggcatctagcagacaaattgaggcatcagctgcagctgtgaggcccaaaaagcccagggggaagaagggtaacaataaaggctcaaattctgcttctgagccctctgaggctccacctgccattcaaacggttacaaaccatgccctatctgtcactgtacggatcaggagagggtctagggctcgaaaggctgccaataagaatcgggcaactgaaagccaagctcagatcgctgaacaaggagctcaggcctctgaggccagcataagtgccctggagactcaggttgctgctgctgtccaggccttggcagatgactatctggctcagttgagtttagaacccacgaccagaacccggggcaagaggaaccgaaaggtgagatctatgagtttatccttaactttgtgctactttcccattcctatcctaggttcatatcctgtgttcatagaagctataggatatgttgaaaagaatgtgatccatttttgtgtcctccagtagtttgtagattggtggggaaatatatttgtgtatttaatcaagacctatttgggactcacttgtatttacatagtatttaaccatgtgccagactttcggtcatatacatttacctacttcttgaaaagagctcttactaactggggactataagtcccaaacacaaagtctcagaattaagtgctctatccaacacctaagtgatctatctaatgcacaacatgccaaagaaaagggaaaaaaaatccaggctatgtccttgtttagtttgtatgctgggagacgacaaattgttagttagaagccagtaaaagaaaagcctgggtatcagagtagccattgttaggcctaagcccctctataggggagggtctaggccctctagattctagggggactttccagaagaaatggcactctttcacttggtaactctaggcattttttctttccattgacaaagtctaagcatcccaatggagaagaaagaactggaaataattacaggcggatcccatggggcaggcggcttccaccaccccgagatgtggccattttgcaggaaagggtaagaatccaatctgccaaagtcctgtttttccttctcttcattctctgacattcgtccaagtgttctgccactggattgatagcttcctaactcttccttctctaggcaaataagttggtgaaatatctgttggttaaagaccagacaaagatcccaatcaagcgctcaggtagcctttttgagctctcttcatccctactctctgtactgatggcctgtgggtaaccgtttacatccatcacctcctctcataccacctcagctgccacagtcatatttcaccatagcttccttgaccacacagggctgggaagaagactgcagtcatctgacctctgtacgctttagcatcttctgtctccttgtagatatgctgaaggatgtcatccaagaatatgaggactatttcccagagatcattgaacgagcaagctacgctctggagaaggtgaaggggcatccctgggggatgggtgtaccagggaagctttaaacagaagaaaggtatatgagcaccctcctggaggaaagcagagacctactacatcctcatcactgtggagatgagcacatggtggtctagggaggggcagcaactgaccacacagcaagtcagcggtggaaacacagttagtgctaaatctgtgcagcttagtcctggcttctgcctgctgctggatacaccatctcatgtgttgcagatgctcactgattataaagatgttgtagatgtctatcttatgtttgttacaactttaatgtgtgcttggtactgaactatatgttttacatgcattttctctctcacacaaaacccttacttaggtatacaacattctgcagaatgtccaacatgctaactgatacgtaagatatattttgagaactcacagactattcttttacttggcagatgtttcgagtcaatctgaaggaaattgataagcaaaataacttgtatattcttatcagcactcaggagtcatctgcaggcataatgggaacgtaagctgggaaagtgctagggtgggaaggggcttctgcttccacccatccatccctctctccgtggcctattagaagctcaggaaagaaggactaaacacccctgtccccactcccacacacgttggatccctgtgggtagtagtggtgctagactgagagaacctggagtaagtgggcattgctgctgtcaaggtggctttctctccaacaagtccccaggaaaccagcctgttgttatttgtctcttctaccaagtgcctggcctggctatggaagggatctcaaaggagagagggatttctggggtggaccatgatgcttgagagcaggaatgtcactagagttccatggagaactcaggggagtttggaactttgggagagaaagaaaagataaccattgactgagtgttcatgtgcttgggttgacaggcatccttccatgtcctaaccctatgtaggagtagcattttggtgtgtagagagcttggctcaagagggaatgcatcctgctttaggtcaggctgggaccatagagtaggctgaattctctatatctgaggaatctaggagagggcagcctagcaagctgctttacagatgatggctcatgaacgtaaacttgctttatgtcctgttattcttttaggaccaaggacacacctaagctgggtctcctcatggtgattctgagtgtcattttcatgaatggcaacaaggccagtgagggtgagtggatgagcgtgcagttgaataggtggctgttgcctgaattccagatgctcaatttctgcctttgtctccttcttgcctcctcttgcagctgtcatctgggaggtgctgcgcaagttgggactgcaccctgggtatgattgggctctctcagcgcttgctgtccgtgttgtcttttggcaagagaggacgctcccaggattgcatcagcctggtggtctggtggagaatgtatagggcggggatgggggtttcttatctggctgtatgacaaaatgattctgaactctgcttcttttctcctttatgtcttctgtctgttttgagatggggtataaggtgaaccttcagtcatccctgacaaagtgccatcaggcctccactgttttcttctagtggccatatgctcactactctcttcacctggttgagactgctatggactagacgttgggaaatacatttgagtagttctggactgtattcactgcttacttttttctttgctagggtaaaacattcactctttggagaagtgaagaaactcatcacagatgaatttgtgaagcagaagtaagtagtgttcaaggctctgtagctctgaagtgctctggttcaaaagtacttagtgcctttcttacattcagaagggcactctgtgtcctagacctgagttctattgaaaattcttgctgtgaagctgtattgggacccttacaatggggtatactcagaacaggggctcaaaaaaggctaattaatagcacacccacaggaatctggggtaagttttcataggaaacaaaacctatctgtggcattgtgtcctgttgccagtaactactttgcatggaaccatgtatcagaatgagtctgtgtctaaagggccgtgaaagaatttccccaggttttttgtttagaggagattgcttcatctgaggtctagtggttaaataatagttttgcttgtttagaatcaagtttcatttcctttctccaagatatctggaatacaagagggtccccaacagcagaccacctgagtatgaattcttctggggcctacggtcttaccatgagactagcaagatgaaagtcctgaaatttgcatgcaaggtaataaacttcctgagcttggcatgttaatggaatgggatgctcctagctgaggcaggctgtgtacagtgatagacaggtatgggacaatgaatggattgtatataaatacataaagcctcatcaatgttccatactgcaagatatagatctttcattatccagttatttttttatacattgtactagtctgttataaaatattaataactggatggcttaagatacataaattgttacattcaacagttctggagataaaaaccctaggttaaggttcagtacactcagtttctgctattggctctctctctgacttatagatggtaagtttttctgcatctttgcatagactagagcaatcctgagttcattttcatgtcttgtcctataaggacactatttgatcaaaacttcacccatttcactgaagttatattcataaaaggccctgtctgcaattacagccatgatcagttatttagtattcaacataagaattctgggttttcccaaaactcaatctataacatacttagtttcttatcattttccatattacgaacaggaacatttgggctctgtgatatcaacttgtccaaggacataacttgagttcttaagctatcagagatgaagtttgaaatctagactgacccatcagaacactagaaattttttatttatcactattagttttgtgtggatcccataatggatgctttacacataactgtaagggctctttttcttgtaataattatactttccattttaggtacagaagaaagatcccaaagactgggctgctcagtaccgcgaggcagttgagatggacattcaggctgcagctgtggctgtggctgaggctaaggccagggctgaggcaagagcccaaatggggattggagaggaagctgtggctggtccctggaattgggatgacatggatattaactgcctaacaagggaagagttgggtgatgatgcgcaggcctggagcagattttcctttgaaattgaacccagagcccaagaaaatgcagatcctaccactaatgtcctcttcaaccaaggagctactaccagaaatagctttagtgatggtgctggtattagctttggtggtataaccaaccccagtggtggctttggtggcatatccaaccccagtggtggctttggtggcatatccaaccccagtggtggctttggtggcatatccaaccccagtggtggctttggtggcatatccaaccccagtggtggctttggtggcatatccaaccccagtggtggctttggtggcatatccaaccccagtggtggctttggtggcatatccaaccccagtggtggctttggtggcatatccaatcccagtggtggctttggtggcatatccaaccccagtggtggctttggtggcatatccaatcccagtggtggctttggtggcatatccaaccccagtggtggctttggtggcatatccaatcccagtggtggctttggtggcatatccaatcccagtggtggctttgggggcagaaatagcattacttttgggagtgtacccaacacctctgccaacttcagcagtgcaccgagcattagctttggtgacacacctaacactagcaccagtttcagtggcggagccaacagtagcttcagtggcacacctagtactagtgcccctttctgtaacacagcaagcattagctttggtggtgcacccagcactagcaccagctttagcacagcgagcattagctttggtggtgcacccagcactagcaccagcttaagcacagcaagcattagctttggtggtgcacctagcactagcaccagcttcagcacagcgagcattagctttggtggtgcacccagcactagcaccagcttaagcacagcaagcattagctttggtggtgcacccagcattaatagtagtagtggtggatccagcgttagctttggtggtgctcctaccaccagtaccagtttcagtggtggaccctgtattagttttggtggtgcaccttgtaccactgccagtattagtggtggagccagctctggctttggaagcacgctttgcagtaccaaccctggctttagtgcactcagcacaaacaccagcttcggcagtgcaccaactacaagcactgtgttcagtggtgcagttagtaccaccactggctttggaggcacacttagcaccagtgtctgctttggtagttctccctactctggcgctggctttggaggcacacttagtaccagtatctcctttggtggttctcctagcaccaatactggttttggtggtacactcagcaccagtgtttccttcggtgcttcttctagcaccagctctgactttggtggcacactaagcactagtgtcagctttggtggctcttctggtgccaatgctggctttggcggtacactcaacagcagtaccagctttggcggtgccatcagcaccagcactggctttggcagtgcactcaataacagtgccaactttggtggtgccataagtaccagctttagtggtgtactcaatagcagtgccagctttggtggtgccatcaacaccagtgctggcttcggcagtacactcaacagcagtgccagctttggcagtgcactcagcaccagtgccagctttggtggtgtactcaatggcagtgctggctttggtggtgccttgaacaccaatgccacctttggtggtgtactcaatggcagtgctggctttggtggtgccatgaacaccaatgccacctttggtggtgcactgaatagtaatgccggctttggcggtgccatcagtacgagtaccaacttcggtggtgcactgaataacagtgctggctttggcggtgccatgaacactagtgccagctttggtggtgcactgaataacagtgctggctttggcggtgccatcagtacgaatgccacctttggtggtgcactgaataacagtgctggctttggtggtgccatcagtacgaatgccacctttggtggtgcactgaataacagtgctggctttggtggtgccatcagtacgagtgccagcttcggtggtacactgaataacagtgctagctttggcggtgccatcaacactagtgccagcttcggtggtgtactgaataacagtgctggctttggcggtgccatcaacaccagtgccaactttggtggcgcactgactaacagtgctggctttggcggtgccatcagtacgagtgccagctttggtggtgcactgaataacagtgctggctttggtggtgccatcagtacgagtgccagctttggtggtgcactgaataacagtgctggctttggcggtgccatcagcaccaatgccagctttggtggagcaatcagcaacagtcctgactttggtggtgcattcagtaccagtgttggctttggtggcacacttaataccactgactttggtagtacccatagcaacagcattagctttggcagtgctcccactaccagcgttagctttggtgggtctcatagcactaacctctgtttcggtggagcacccagcaccagtctctgttttggcagtgcatctaacaccaacctatgctttggaggctctaacagcaccaactgctttagtggtgctaccagtgccaatttcaatgaggggcacagcatcagttttgggaatgggctaagtaccagtgctggatttggaaatgggctgggcaccagtgctggctttggcagcagccttggtaccagcactggctttggtggaagcttaggccccagtgctagcttcaatggtggcctgggcaccagcactggctttggcggtggactaggcaccagcacggatttcagtggtggactaaatcataatgctgacttcaatggaggactgggtaacagtgctggcttcaatggtggactaaacactaacactgattttggtggtgaactgggcactagcgctggctttggtgatggactgggcagcagcaccagctttggtgcaggactggtcactagtgatggctttgctggtaacctgggcaccaatactggttttggtggcacacttggcactggtgcaggctttagtgtaagcctcaacaatggcaatggctttggcaatgggcctaatgccagcttcaacagaggactgaataccatcattggctttggcagtggttccaacaccagcaatggctttactggtgaacccaacactggctccagcttcagtaatggacccagttctattgttggctttagtggtggaccaagcactggtgctggcttctgcagtggaccaagcactggtggcttcggtggtggaccaagtacaggacctggcttcggtggaccaagtacaggacctggcttcggtggaccaagcactggaggtggctttggaggaccaaatactggaggtggctttggaggaccaagcactggaggtggctttggaggaccaagcactggaggtggcttcggaggaccaagcactggaggtggcttcggaggaccaagcactgcagctggctttggtagtggactgagcaccagcactggctttggtggtggactgaataccagtgctggattcagtggtggaccgccaagcaccggtactggctttggtggtggagcctctagccatggtggctgtggcttcccttacggctagtgaagattcaggtaactgcaatattcctatagccagaatccatggggatagctataatacctgggagatactagaggaaaccctaagctaggaggggccaagtgagaggatgaagacaagaaaggaaataggaggaaatgggccatgtgctaatgtgtctgggtattcggctttgtttttcaggcttgttccccctgtttacagataacgctaactgcaacaatacttcccatggagccaatgtgcagctttggaattgttgtccacgcagcagcctgagcactattacccatcagctgagtgaaacactgaaaaatctgctgttcctgctttgtgtttgcttcctgtgttgttgtcatattttggtattagagttacattaaatttgccaaaggaacctg

SEQ ID NO: 106 - DNA, 24598 bp, mus musculus
taaaggcgtgtgccaccaccgccccaccttcttttttgttgcaacaaagtactttggaagtaaagacttgagggctattttgttgttttcaagcagcaacattgctgggtttgctggctcatacctgtgttcccagcatttgggaggctgaggcaggacgattgcagcaagttcaagaccagcccagcctacatagtgagactgtattgctatggcaactaatattctggtcagatttctaccatcgcattatatatttattgtttcctttaactcccactttttgctaaactgattacaaacatgttaccagagttaaataatagcttctttgttcttacccattcagagtgagacttgtagcacattttgtgttgttgatttttctggtgcccatctcttgattcttggaaattgttgaaattgatgtctttgttcccagctagtcccttaggattttcttattgggttttaagttacagttctcagccatatcaccaattaatcaacttcctgtttaaccctattttgtttggtttactttgcagcctttattcagacttaatttttttatctcctattcttcccctttcctcctcttcctaccccaccctcacttggaccttgaacatattgaatatatttctacaatagtccctaatttttattttttggcagtagtcttacaaggaaggaaattttcttaacataaaagtggtcagatagagaggaatttggctggaacataattaatccctttcctcaggacttactgaacttccttatttatttatttatttatttatttatttattttagtttttcgagacagggtttctctgtgtagctctggctgtcctggaactcactttgtagaccaggctggcctcgaactcagaaatccacctgcctctgcctcctgagtgctgggattaaaggcgtgcgccaccatgcctggcttcactgaaacattttgcttatattaatgctttacatcttgtgtttgtattaaaaaaattcacacaaacaaaaactaagaaactgacaatgcctgattctgtcccctgtgtttccactcacaatcatatacttacagaccttttgaccctatggaaaaatatctaacattcagaactactgataacaggaagaggattttttcttttgagaatgaaatgtttcccctcatattgaactctgaagcaagtactccgaatatgcagcatgctaactggatatcttttggcataattgttacatgtttggtatggatagcacatagtttgggatcttcaaaaggccaacttcctcagacataatgatgacaagttgtggcatggatgtagggaaaggtgagcatttattcactgctggtaggcacgtgtaaactgtacagccaatttagaagttagtataaaggttcctcagaaaccgaagaatagatctgccacattttatggcacacactttgcgtaatgttagttctcatataaccgtgttttttacagaatgtattttcattcatatttttaataaagttactagaagatattttgaacttaaagaaaaaataaaagagccaaccagataggcttcacctgcctcctgcaaaacaccaatagctgcactctggaagcacacatctgttttgaagtcctgagcagttttttgcaccagacactgaaaacagaagttcagtggacttctgttagtatctgatttcatagagtgctacagtatcagactgtaacaatgaagtttcttcatctcccgtagagggcacctcttgtgaggggtttttgtagctagttgtttcctgggtgctttaccaatggcagatagatggacagtcttctttgaaggagccatgatatggacaccaccttacttaccctcccctttggctggagctctgtgactgagaggccatgctggcattatagtgcctggcctgctttctttcttttttttttttctgagtgtgtggtcaatgaggccaaactgtgaccccaggtggacttttagagggaatcccctgtttaccatcttatttctacgcctaatcagccatcccttatgattaaaatcaggtatgttatgaaaagggatatgagcagatgaataatgagtacataacttaatctgtcaatcaaagtagacaaccacacacattttgtgtcctgcaaataaactcttcttttttttcataattttttttccattttttattaggtatttagctcatttacatttccaatgctataccaaaagtcccccatacccacccacccccactcccctacccacccactccccctttttggccctggcgttcccctgtactggggcatacaaagtttacgtgtccaatgggcctctctttccagtgatggccgattaggccatcttttgttacatatgcagctagagtcaagagctccggggtactggttagttctggcctgctttcttatagaaccctggaccaccagcctagggatggcaccacctacaatgggctgcaccctctcccatcaatcactaagaaaatgtcccatgggccaatcttatggagagattttcttaggtgtagttcccttttctccagtttgtctcaatttgaccagaagatcaacagggcacctatgttttaatcttgatgttctatatacctttcccatctaaaaccttaagcctatcttcaaggtaaagaattttcatctgttattaaaaaaatacctgattctctatttgtacctttcctttttcaagaattctgttttgaagattagtttctatatttttcagtcttgttctcacttataacttcttttctttggatttttattcaaattagctccctctgtggtctttagcctgtcaattcagttgttgctgctgtccttaatgaagagcttattttgacttatgtgatgggttacattccactgtggcagggaagtcatggaggggaaagtgtgatgcggctggtcactggcaactgtggttaggaagtggagacagacgaatgctggtgctcagctgccttctgtcttgtcttcctctgattcagtctgggactctagtccatgggatgatgcttctacccatgcgtgtttcaacctctgtggagacacccctagagacacacccaaaggtgtgtttcatagtcctcctaagcagtaacaaatgcacattcaggtgactcaagagaatttcattaagaatttatggagtttacactgagacagttctctgggtattatgcctattacttcctcttgacaggtgatggtctttgccatctgcagctctatcttatgctgaatctagacagacatggcatctgagatttctaaatttcctagttgtcctgaccttctgattaaagcattaatagacattgggtaggggggtgatagcaactctttctctctctctctttttttgtagaaaacaaaaaaccaggtaaaggttccaaaggctgtaagaaggtaagtgggccttaccattaggtgaggtatgggtattgttgggagtcagattagttattgggtgactcctcagagggatggacagatctgtccttttttcccagttcatatggctgtaggagagttacctgaatatctgaagttttttttttttttttgaaagccatatactgctttgtgcttggtttacatataagggattattgacatccctatgtacttttgtagtggtgagtattgagccatactgggccttgagcatatttagcaagggttctaccactgagccacacaccctcaacccccaaaatttctattttttgatcagttctcagggcttgttgctctggcttccaagacctcattttgggagctgtatgtcaagaaaggtttctctttggccttgggaaaccttcctggctgcccttgtccctaccactttcctctcagttcctgcctggttagtagggaagggccttgccctagccagacaagcagatttcaaccctcatccagactatcttccatgctcctctgggtaagaggtggtttccatggattcattaactgtgtttaatttttcttttcttgcttggcaaccagcctgcaaggcaaaatgggaagaaagtaacctccagaccatcatctgctccccagattgttcatggcaatgaccatgccagtcgcgaggccgaattaaagaagaaaagggtgagccttttgtctttggggagtgatggcctggtttgaatctcagctctgcatagttttgggcagaagggcaggggttcttgatgttctttgtggttggggtggggggagtgagataggttaacttgatactggtctaaattttcccatttgtttaccttgttttgccctcccagctctctcgtgttgtctctgtcatttcccattctgtgtgtctgggtgcctccttcctctgttacttagcattttgcagtcttttgctgctttttttcttgtttcccttgttgaggcaggatcttgccttgttgcctaagttggttttgaatgcttgggtgtgtgaaatccttctacctcaaactccaagtatctgtggctacaggtatgtgccagtgtggcagctccctctttctgcctagtgcagcctatgaccttgtccttgtttggacttaagtgttttcctgtcaaagtgcttctctctctgctttgcagctactctttttattttttgtccttttattgttttcaatttttaataatttttttgagactgagtttctttatataaaagttctggctgtcctggaactcactgtgtagaccagactggccttgaactcagagagccacctgcttctgcctcttgagtgctgggattaaaggtgtgcaccgtgatcactcagcacttttactaatttttaaaatataccgttttttctttctttgtggtggaggtggtggtgggaggggcaaatgcaagcttgaacatgccatggttcatatgtagaggttagaggacaacctatgacaattggttctctccttccagtatagatctcagggattgagcttacattgtcaggcttacattgtcagcctttctacccatgaagccaccttgccagcccccaaccccttttcatttttacacttgcttgaatgatatagggtcttgctacgtactctggctggcctggtagcctagaggtcactatgtgatcctggctggccttgatctaataatgacaattctcctgcctcaacctctcaagttgctggatttagagttgtgtgctactacaccctgctcttttattttttctctgccagtctccttcccttagtctctacatttttattctggcatatttttgctctcctgtcttcttccctctatcctcagttcgttccttctatgtcctacagatcaactcaaatccagtcacagtgtgtgcttgtttgttaggtcgaggagatgagggagaagcagcaagttgcccgggagcaagagagacagagacacaggaccatggagagctattgtcaggatgtcctgaaacgtcagcaggaatttgaacaaaaggtgagaaagcagtttttgttgctggctgggattggggtgggtttgctgttttgctgtaaaggaagaaatacctacatagtgacactttgtctcaaggaagggaaaaaagagaaaagagaaggggtgtaaggtcagaagaggaaagggatgagtgcagagaaggaaaacaactggggggggagagagggaagagaagatggagggaggggaccatcggcagcagatgtgcccacagatgtggagaatgcctttcctaagtttgagcctgaagatggaatggcagtgggtctggggagcaggagaggtctgagtagggtgtggcaggagggagcataggaaaggaagactgagagacaccttcctggtgggtgtctttccctttctggcattgttgtctcgctgacaggatgcgcgcttgcagctcccgcacccttgatgacatgcagtaaaggatttgcttcctgctctctcatgcattgttttcttcacactttcttcttgtttcccacctaacacccttgtgaccaagcaagcctatgcctggtgctcacatggagtcagttgtttctttctactggtttcaggaattgaactcagatcatcagacttcacagtgagtgtgtttagtggctgagctatcgggctggcctggtcagtgctacttttaggtgatctgggactcacctgaatcctccagcttcctatgattttcttttaaattttttttttacttatttatttataaagatgtatgtatgtatgtatgtatgtatgtatattagtgctctttctgcacatatgcctgcataacagaaagcatcagatcccattacagatggttgtgagccaccatgtggtcgctgggaattgaactcaggatctctggaagaatagtcagtcctcttaaccactgagccatctctctagccctcctatagtttcccaaagccttgctatatcccccttctttccttatcttcacttctttcttctctctccctacttggccctgtttcccctagactattctctctctcttttttctttttcaggaggaagttttgcaggaattaaacatgtttcctcagttggatgatgaggccacaaggaaggcctattacaaggaattccggaaggtaggaggacccattttccctttttctttgctttgtttttagataagatcttattctttagtctaggctaacctagaactcactagatcccaactgtccttgaactccttgcaatcctcttgcttcatcaagtgttgggagtatatgcttgagttgtataacaagtatccatttcttaaagccccttggtgaggaccccatttatttctatttcttcttcctgttcttttccctagctgagatggagactatgaccccactgctctcaaccttcttcccctgtattttctgtcctgcaggtggtagagtactctgatgtgattctggaagtcctagatgccagagacccattgggctgccgctgtttccagatggaggagactgtccttcgtgcagaaggcaacaagaagctggtcttggtcttaaataagataggtaggtttgagaagggttggggaaggcagggaagggttaagctaaggctagctcagattaggtgctgcgacccagcaactcatttatattgttcaaatttccaaagccagaaatatcttctgatatacgcacagacatacacagaatgtaacatgggttgagggggtagagtctgaacctgtttgccttttagccccctttccttgcaattttgagctagttcaatggctggtcattcttagagacctgtctccacagactggaagtgaaagattggggcaagcacatggcttggaactcattgaaggtgtagtcttatcctactgttgctattttttttttttgggatatcagacaggtcataccagtcacaagaacttctatttctcaaacagtaaagagggtcctggacatctcagtctcatagctttgttatgagaattaatacagagcttggtgtataatccacttgccacaaatcatagccattctgggtgatggcttttctttgacacttagtctgacacagaatgattgggaatgaaatatttgtacacctttgcatggaatgaggtagcttctttacttattttcttgaagaaaataaaccttagggacggccaactgggtccgtggatcaaattgtcctttgtaactccatcctgggcactaggcagggtcagttaggaaaagatgagaaatccgttagtaggaggtagacctagacatgggtgtgtggcttgagagaagccatcaaagtaatgatcttacaagttgtggctgtccctatttttccaagatctcgttcccaaggagattgtggaaaagtggctggaataccttctcaatgaactgccaactgtggctttcaaggccagcacccagcatcatcaggtcaaaaacttggtaagctttgagttaggtggtctagcctctttcattgtggtttggggccatggttatacgtgttaagatttggattgggcttccaactttgagttattttctctagtgggtgacttgttaatttttatttcaacttcttcctgtattattgcccttcagaaagcatgttttttttccacttgtgaggatgtactaatacatgctatctacaggagatctggaaaatagagttaactacttatttttttctgcatatatttttaattaggtattttcttcatttacatttcaaatgctcacccaaaagtcccccataacccccccacttccacttcttggccctggcgttcccctgtactgaggtgtataaagtttgcaagaccaagggtcctctcttcccagttgtcttagttagggttttactgctgtgaacagacaccatgaccaaggcaagtcttataaaaaacaacatttaattggggctggctgacaggttcagaggttcagtccattatcatcaaggtgggagcatggcagtatccaggcaggcatggtgcaggaggagctgagagttctatgtcttcatccaaaggctgctagtggaagactgacttccaggcaactagggtggggatcttatacccacacccacagtgacacacccattccaactaggtcatacctattccaacaagaccacaccttcagatgatgccactccctggtccaaggatatacaaaccatcacaccagtgatggccgactaggccatcttctgctacacatgcagctagagacatgagctctgggggtactggttagttcatattgttgttcctcctatagggttgcagaccccctcagctccttgggtactttctctagctcctccattgggggcccgagttaactacttcttaactcttcaaaaaataactgttttcccccttctttaaaacaaggcataggaggttggagagatgacagctcagtggctgagagttctttctgttcttctgggggacccaggttcagtacccagcatccacatggtgcttacaaccatctgtaacttcagttcttttgacctctccagataataggcatgcatgtggcacacagacatacatacatgcaaaatgctcataaacataaacataaataaatcttttctgttttgttttgtttttctgaggcagggtttccttgtgttgccttggctgtcctggaactcgctggaccaggctggccttgaagttaaagatctttcttctctgcatcctgagtactgggattaaaggtgtatgccacaatcacagtttaagtaaataaataaagcaagttccaggagagtcacaaagaaaccttgtcttaaaaaacaaagaaatacaaaacaaagctccaaacaaggcatagtacttcctattgatatcaatatagaaatacttgtaaaacattaaggtattattgtagcattggttgtttctggaaaggtaaattggttactgggggccaagcttttcagttttgcattattcttttttttacagtgttgggtagggagctcagagcatcttgctctgacaccctaccatcaagaccctattcttcaattttcattgttatttaagtagtatttttttttattaatccacttgcatgtatctccttgggatgtggacaagtgttaatgtgggttaagtactggccaatggtgtggctgggttatatattggacttatgcttttgatattttcttagacactgacaaattattctttatgacagcaatgccaattaaccctcctcccacttgggttgatgggtatgtgaagagaacctcttttcctagaatcttgccaatataaggtgtcccatttacaatcttgtggctccctgctctcccaccatcaaaagtaaaagtagggaagtctggatggccttgtcctgtgtgagggtcaagggaagatcagctttgggcctggaaccctttcatccagcagaggcagagaggccaggcttcccttttgtgcatatgagacaccaggggcccaggaaggaagctagacttttcctcataggcctatgagtgagagagatagtaatgaaatctgtgttgcctcaagctgggatttctgtctctgctgtgggagtcaaaagccatgcatgttgagttagaagcagggacagaggaagttggagacatacagacaacagcaactggaaaccaagaagtgctgggaaggactcagtgggataagcaaccaagtttagcaatcccagaatattccactgcaggttggaaatttaggctcaaattccatctcttccttgatgcacatttttgtaatattcttcattttcagactcgttgtaaagttccagtggaccaggcctctgagtcgcttttgaaaagcagagcctgctttggagccgaaaatctcatgagggtcctggggaactattgtcgcctgggggaagtgcgtggccacattcgtgtgggtgttgtaggtaagactgggtaaattaggcacagggcccaggctcttttggctagtgacttcattgagggaaagggtttggaattttgtgaggcttctttggggaagatgggaagagttctggagtggttttgcatttgccatttggctagtgggacatgggaaggcatattcagattcaacgctgttagagccaaatgcttggtaccaaacactacaggctgtcagctgtgggagggaagtgtgattcacccgcctcttgtagacagtgagacagaacagtgagatctacaaaaggaaacaaggaggagctgaggcttaagcctccgtctttctgaaacccaaatactgtagaaggagatgaaagagaatgggaaaattgaggggcagggaaagatcatcaaagagggaaagtgtctcagcctgagatactgaagagaactctacagactctagctatatgccacactttggaatagacaacagaaaaagaacaaggaggccagattctgaagttggtagataatgaaaaggacaaatttaagttgcagttataaagagaatgaagaagctattaccccaaagaaatgctaaaagggacattaaaaactattttgtggccaggcttgctgatccagacctgtgtgttagctgctttagaaggttgaaagtttgagttcaaggcccgccttagggaacttaatgcgaccttgtttcataaaaaagttaaagctgggagtgttgctcagtggtggaggacttccctagtattcgtgagaccctgggtttagtccccagtgttaaaaacaacaggagataggtaaagacacatgtacagacacatgtagagggtttggtgaagaagagacacttgggatatgtacttgggtagatatgcacgtccaacaaaagaacatgcaggaatgtagacagtttgaatgaaagagatagatatagacacagggatatacaacatatgtctacatacacatacagatcctgaagaacatataaatgcccgtgcatggtgtcatgtacaggtccctaagggacacatctgcaggcacagacagactcggaggcaaaacatgcagcctaagttctgccacactcaacactgtctctgctgccccaaagcaaatgaagccacagggatcccacatgtgcccagacccactgtaactctctgattcaacctggaatcacgcagaggcagacatacctgtgatgaggtgaagtgtttgtatagtgagaattaaagacatagttagggaggcacacaagacaaggcataatgaaacatgaatggggatacatcaatagacacactccagagagaaggaacggagtggccatgtggtcagaagtggaatggacgaggtggagagaatcagaaaagatagtgtccagaatgagaaagaacattctagataccctgagaaacagctgtgagaggtccaacacaaggaaaaagtagtcacatttgaaatgaaaaggaccaggagacacatagagatgcatagacttccaagtacctaccacacctgtacctgagcacacatggaagagagtagtgcatactggtaaatttcagtacccatagaggacagtgagaatgatatccagtgaggcagaaactcacaaagacagccccagactgaaagtggtgcacaggtgctcgctcagatacaaagattccacaggcaaaaacagctgtgcagagaggggggctctggtgagtagtcccttctcccaggggaattacaagttcgaacaggtgggcctgtttcaacacttgatatccaccttctgttaggtcatatctgtgaggccgtatgtggtgcacccctctaggctggttgtggtgggaggtggactgcacatctagagagagggccatgtgtgcctagaatgctgacaaaagagagaactagaaagacccttagaggcttggccagggtctggggtgggaagacaggagtgtacttaggctcatccatggcctggttactgactgtgccaggcctgttcttaaacaggccggcctgaattcctgtgagtactttttgccctgagtattctgctcctactttgcaggccttcccaatgtggggaagagcagtctgatcaatagcctgaagcgcagccgtgcttgtagtgtgggagctgttcctggtgtcacaaagtaagatctgctcactcccccgcttcaaaaatccttgacattaccattccatcctagttcacgtgccttcatcagcccctactaatagtcctcatttacctggctcatcccaggcttgctgccttgctgggtccttcctaacaactacaaatagctctgttgcttagatgaagagaatcagaaacttgtctgagatcctgcagttaagtccccagtataagagagtaaattttagaattagccttgggtctatagcacctcagatctccctccctggcccgacatcttttttttttttttttttttttggtttttcgagacagggtttctctatagctctggctgtcctggaactcactttgtagaccaggctggcctcgaactcagaaatccacctgcctctgcctcccgagcgccgggattaaaggcgtgcaccaccacgccgggccctggccctaaatctttgcacttcacctaagacttatatacccttccctctcttctttgatctccctccaccaccttcccacaagacccaacatttgtgactcaatatcacgtacagctgggccttgtttttccctctagattcatgcaggaggtctacctagacaagtttatcaggcttctggatgcaccaggcattgtcccaggacccaattcagaggtgggcaccatcctgcgtaattgcatccatgtgcagaagctggcagaccctgtgaccccggtggagaccatccttcagcgctgcaacctggaggaggtatagagcagggtcctcagtggatgcatgccccatcctactacttcactggtccttcattccttctcatgggttttcttcttaattttgttagatttccagctactatggtgtatctggattccagacgactgagcactttctgactgcagtggcccatcgcttgggaaagaagaagaagggaggtgtatatagtcaggaacaggctgccaaagctgtgctggctgactgggtgaggtgaggaagggcttgagcaggaggtggtatttattgatgccagtaggacagcctgacttcctggatcgaaggttgggaatcaacattctgtgcctagtggttattcagcagttcaacacattgttgagacgctgttttctggactttcttgtcctgcgtcctcttttggtgggttatttgttcttagtgacatcactagcgacccctccttatctcccaatacagtgggaagatcagcttctatacactaccaccgcccactcacactctgcccacccatctcagtgctgagattgttaaggagatgactgaggtctttgatatagaagatactgagcacgccaatgaagacaccatggaatgtaagtgtggatgggtggggtacctgtgttttcctcatagagcccagacttaatgtcagagcacacatttgatctccccttccctggggctacttgggattaagatttattgtcctgcaaggtagaaaattctagtttgggctgtgagggtatgggtaagggtggtgtttgtggtgaacttttggtagattggctgactaactatagaccctttaggttctctgaaagtgaggcttcatttcttttgggtggaaacattcttttaaaaagctcttgtgtgtggtggggagggggctggatgtttttaagacacagtctcactatgtaattcttggctggcctgtaactcattatgtagaccaggctgaccataaactacctctgcctcccaaatgctgggattaaaggctcaaaaatggctgtgtatgtttacatgggcctgtaattgcagccaaacaactgagttaaacacctaaatggtccttcttcctattctcctccctcctgttgccctaggcttgaaaaaaggatgttgaggattaaacccagagccttgtgcatgctgtcatagcactcctatgtagctttaactgacttagtgctcactgtatagcccaggctgactttgaacttgagataattctctctcatcaggcttctgagtactggtctgtgccgctgtatctggcttcgctacggtcttctcagcttgcttagattttgttttctacctctattggctagtaagatattctagtgaaaaaagattatgtttactgggggtggtggaacataccttttaatcccactacctgagaggcagaagcaggtgttctctatgagttccaagcttgacagagcttcatagtgagaccctgtgtcaaaagagtcatctgaagggctctgatggtagctctcctgttctgttgttttaaattcctcagcagagtagtgaggtggttataagtgtggactacaggaatttaaataaatttaagttttcttcctcatttgttgtatgatattgagcaagtctgttcacttcactctctctgtgataccatttgtaaaacaagaacagtagcacccattccagaagggtattgtgtagatttacctaatttgtaaacgagggcaaggggtatagcccagggatacagctcgtgcttagtattcacaaggccctggttcgaccctcagcactaaaaaacagtaaagcatatagaactatagagcctggcatatagtacatcagtgctctgtagatgctatctgggggatatggaggagtgactttccaaaactggtgaacaggtttctgctcttagacactactatttgtagtcctggtctgtgcctgtagttcctacttcattctctactctgtccaggactctctggccacacattagggaatagttgagaaagcattgtttgacctgcagtcctattttctgctaaaggccagtcatttccttctgtgggtgctctgaagtcctggattacaaatgaggacaagaagacttgcctgccttctagtttattccatgtgtggcttgagtcaagtcagcctgcttgctgaattttaatttctgattctgtcaagtagacagttgagagggacttaaaattatgttttaatggtgatgcttgagcctggatttttaagggcaagaagagtgtcatcactgtagggagaagtcaagggtggggaagaggttataggtaaaaagtatttgaaggagttggtcctagtgtggcatcttgaagagtgagcaggagttaaggcattcagtaaagtaggtaggataaggttggtagaggtgaggtctgagggtggtgtggcactaaagcgatagggatggctgaatattgcactggagctacttctaggcaaggggcaagaggacagaggctggttctaggaaggaatactcatggctgtcttcatcacatttgagccagagtacagtagatgccttctgcttggttttctcttaatcctctaaataagagttatggaattcccatttctcacatgagcaagctgaagctttaaggctaacttccagcaggcaagggttctataatcatgccgttgttctgtttttattttgagacagggtctctcactatatatagcccaggctggtcttgaacacatgatcctcctgttttaccctcctgagtccttagattacaggtacgcaccacctggatttactaagcatgcttttaaatatttgttatgtagcctctaggcagaaacaacctcacctacccccacaacactggtggcaccctcatgtcctttctgctgagacctagcctgaaggctgccagcaagggggagccaggattctaacagtgatgtttgtcttacaggcttagctgtgggagaatccgatgagctgttgggtgacatggacccacaagaaatggaggtcaggtggctccattctccactggtgaaaatagcagatgctattgaaaatagaagcaccgtgtataaggtatttctgcacatcttcatggcagctgtctcatgcacagcgttctgggaaggagtcagttccttctgcatatctcccctggggtggtgaggtgtgagtccctcacatactttctatggacttgtagatgtttgacctggtgtgttttgggctagacagtgacgtgtctaaggagctctttcaagcaagctttcccagccctggtagcagatgactccttccgttgactagtatacagaatcacatacatacattgctagtcaccaaatctatggctattccttaccatatttcttgagacatggtcaaaatctgttatgattcctgtaatcctagtgtatgctttcaggcctcaacttaccaggacatatgctccatggtttcttttgttgctgtttgagacaggatctcatgtagtcatgactggctttgaacacctgatcctcctgcctcccaactcctcagtgctgagatgacaggtgtacatcatcatgcctggctattctatggttctagtctgaacctgttagttcccctgcttaaacacctttccatggcttgctatacaacaccttcagagcatcatataactctgttttgttgttattttctttttcaagacagggtttctctgtgtaacagctctgatgtagaccaatctggtctcagatgcacagagatccacctccctctctgcttctcaagtgctgggattaaaggcgtgctcctccatggttgggccactcttggtttttctagtatcttttttttttcttagtcgcccatctctgctcctccaaagttttcatttcaaacacatagaaggagtgattatgggtgggcagtaataggggaagagcctgtatttaagtgccctaaaatgtactacttgttagttggtcagagaacccttaatctccatcttgaaggctgagttctctgggctcataacagggctcaaagagatggtgtttggagtgaattgcttgtgctattaggtgactggagtagaggttgaaaaagatgaatctggcatctgagcatagcttgccttaagtttgaccttggcccttaaggcaacaagaaagcattgatggttgcctgttttcatttctgggtcaaatctcctccctagttttacatattgaaatttttaactaggcaatatatgcttattagttaaaattgagaatggattgaaggctgcacaatgaaaagtaagtctttgatttctgtcccccattcactctgttccctctttggagacagtcactattatcagactttgggatgtcctttcagacctatcttgtagtgtttatttacacacacacacacacacacacacactagtttgagatagccttttttataaaatttgaggcagggtctttctgtatagccctggttgttctggaactcactctgtagaccaggctggccttgaactcacagagatctatctacccatcactgcctcccaagtgctgggatttaagatgtgcgtcactctatgccagactgagataaattttttgtcagtgctggggaatgaacccagggtctcttatatactaggcaagccctttaccactgagccacatacagccccaagtaactattttagttaaaatagaggaggctttccccattgttctgtactttacttatttcacttacaaatttgtttagtgattacttcaagacctctaattttttttatggtgacataatatctggaaatagttaagaaacatctcttgttgtcctgccagtgagactagtcattcgggttcaggttggccagggaggaaatttccctctaatgagtatgctgtagaaggtaaggtgtgaacgtgtataatgtcggggaccacactcttcccatcttcatgtagggctagaagtttccatgcctaaagaaaaacatctacaaacctgtcgatttaaggcttccttcacaaatatttttcactgagccataagcccctggacatagtatgtttcttagaaactgacagtagtctccccttttgtgctacaagttccagattctatccagggccctcagcagacctccccattacacaactcccaaggaatactatatatgtgtatgctaccttgacagaatcttcattgtggaaataccatagagtgtactaccataaactaagatgctcatggcaggccaccagcacatatgtgacccattgttgcctgaatcatgtttatgtgactgtgtacttccatatttacatgttagattggtacatgatacatagtaaatgctctgttaatatttgcttttactactaacatgtgcccagcacacagatatccttcatactgccctgatgggtagtcagcatgctttggttaggcttagcctagttatttactgaaggtggaagtaagtctaacatttctttgttcccaggtttttcccatatagctgggtccaaagtgggtgttaaaagtactacctgagtaaggccttacaagggttacttcaacaaaggattagttgtcactaatcaagtaaatatttctctctctctttttttttgagacagtctctgtagcccaatctaacctagaactcatccatctagtccaggctggccttatgcttatagcagtcctgcctcagcctttgactgcaaagattacaggtgtaaaccatcactgcttcctttcctttatcaaagtcttgtagccaaggtggtggtggcatacaccttaaagccttcccagcacttgagaggcagaggcaggtttattcctgtgagttcaaggccagtctggtctacagagtgagttccagcacagccagggctgttaaacagagaaactgtcttggaaaaaaaaaacaacagaaagttttgcaagctacccattagtcaccttgttggacagatgaacaaattgaggctaatgggcccactaagcattagttagaatatggtggagccataattggctccagatttcttcttacccatccctatattaggtttctctgtaggagtgtttggagatccagacctcatcattattctttttctttccagattggaaatctcactgggtattgtaccaaaccaaaccgtaatcagatggggtggcctaaacgcaatgtggaccaccattgcccccaaaataaccgtgtagtagaggtcagttctgtggaccgccgcccgatgttgcagaggatcctggagacagacccacttcagcaaggccaggctctggcatctgccttgaagaataagaaaaaattgcagaagcgttcaggtaggggtacttgaccattcctgtgctctggaaaatgtctgatgagggctaggactagggacttttgaataagcatttccatatgtctatctccatggaagagttggagagatggggtttggaaactcacgaactggcaagtggttctcaaaattttagcttgcatcagtgtcacctgaagggtttgtcaaggctgatctttggagcctacacttgtagaaccactgaccttgtctgtgtatcatgctcccatatcttgggaactctctgtctgttatattatcatttgtactctataaataggcagtgcttctaaaactcagaggactcacaatataatctcttaaggcttcttgtcataggcagctggttaatttcttgcccttctttagacagatacatggagaagtcatatgtttcttttccacacaaatgcttgtcactgagcatacagtttttgtctcataatttctccattctgtatcataggaatattttcacatcactatatgaattgtctctttgtattaatggcagtcttttgtgtagttgacatgtacaggttttcaggttacttacagtaacctccatatctgtggcttctgtactacagattcagttaagtggaaataaaaaacatttggaagaaattgcgtctcttaggggctggaaagatggctccattgttaagagcacttgttgctcttccagagaacccagatttggttcctagtacccacacatgactcacaagtgtctgtaactggagttctagggcatccaactcttttgacctctgaaggcacttagcatgtgcttcacatacatactctcaggcagacatacatagacataaaataattttttaaagaaagggtctcactatgtagcctatgtataaaatgtatatatgcatacatatatacactatgtataaaaatgtaagtagtgttgattgactctgtcatctttttttttttttttttttgctacgccatattttatagctatcttgttctggctctacagtgagtcctgggaatccaagggcgacttgcccttaaactccaagtcttgttagagagtatagaggagacaaaacaaacagtggcagtgtagaacagtcaccgtgaggtcacacacacaataagcacttctaggaagcttagcccagcttggagatagggctgatcagaagagggagaagtctggagaagtctcagggaaccccgaggaacaagtgtatcttgaggatgagactgtgagtggtaagcactcaagttcaaagctagtactagtgtgcactccattgctatgagtgattgtttgggggtgggtaggggtaatggaggaatgctaagttcacacaatagaaggaaattattattttagtactcagaagacacaaaaatacttggaatccttcgagtctgaaatcatgagaaagaaactatgctggggtgatcacttataggtgaatggatctccttgtgaggttgacaggtgtaatggcctgttttgttgaatgattagacgtgtaactgagccgatttggaggttggtatgggccaagttagtgattttatttacgtgtggcaggcctgttggctaaggcagctacccagagattgcctgtatttctccctctacagataaaatcgccactaagttgtctgactccatgatgtccatgcttgacctctctggcaactccgatgactgtgcaggtgactgagcagctgaccttccccctcatactgcaagtactgcttcccgtgcgatgggagagtccagatgcctttccattctccctgatgtacttaataggagaacacctccatgtcatgtatcttctgctgccgtgccctccattcttatcaaaggtctggagctgccaaaccctactaccctctacttaatccttcctgtctttgaaaatgaccttgtgtttgttttgtggtgccagggattgaacataataggttctcacaaatgttagacaaccattctattaccaagctgtagtattaccatcattaccatccatcattatcattggggagtctgcttactcaacctcccaagtactgggattacaggcttttgccaccattcccagctcccactgtgttttctaaggtaaataaaatcagcagactcttggcatggtggcaacatatctataaccctgacacttgggagactggagctaggaggactgtaagttatgggccagcctgaactatctggcaagaccctttctcaacaaaacagcccaaaacaaataagcagagtccagctgggcatacacctttaatcctagcactctggaggcagaggcagatgaatctcgtgagtttcaggccagcctggtctaccgagcaagttccaggatagccagggctgcatagagaaactccgtctcgaaaagtgaacaataaaacaacaaaaagaatttgtaattatttaaaaagcaaataagcagagtccaagtgctgacaatgtaccttggactctaaattcctgtgtcgtaccctgtgagttaggctgataagggttaaccttttggacaggtaaatgtcctaaaggctagactgctgagaaacctggtagcagtggcgggggaggtggcggttgtccctggatgggtgatccttttcatttttatcaccctacaagatctcagtgccaaggctcttgcctgtgtattttccaaatcaatagctagctcctcatctgggtagtgtaggagtagagaaggatagtgtgagtctcctgtctctggaagtgtctggggatagtgtagaggatgacgattctagaaagggtatacctatcatagtaagttggaaagccattggctgcaggatgttcaggaaatgtagaccgtacctgttttctggacggttaggggctgagcacaaactactaaacaatgagaaacagttaccacctttaactttcactatatccgtatcaggaaggggtaaggctcagaaagccgacagaatgtgctcatgtcaacagtaagtggtggtgtgctagatgtcaaacttgagtctaatttaaaccttatgctagccttttggtttgcattattttgccttttcaacaagggcacaccactctggtattttctgttgtcatatatttaaaatatattttctctactctgttttttatttttatttatttatttattttttgggtttttcgagacagggtttctctgtatagtcttggctgtcctggaactcactttgtagaccaggctggcctcgaactcagaaatccgcctacctctgcctcccaagtgctgggattaaaggcgtgcgccaccaccgcccggctctgttttttaaaaaatggtagtatttattgaaaaactatgctttctaagtctctttaaatgatgtccaacttaattcactgatctcatcttaagttttgctagacaataatatattagaaataaaagtatctagattcttgggaacataatcatgtcaaaataaaatagaactaaaaccaggtgggtggctcacaccagtgctccaagcactaagaatgctgaagcaggaagatgtctgaagctgagtccagcctgggctgcagagtaagaggcagtctcagggcgaaacaaaataatgtgggactttagatattctaactctaatgtatctcaaggttgggggtagcatgcgcacgcacgcacagagagagagtttcccccatataacccagtgtggtcctgaactttttaggccccccccccattagctttccaagtgctgggattgcaggtgtttgctttcatgcctggatatttctttgttcttaaaacaatttcttgggtctttactctccccttaaaaatcatttttatacaataaatctcatccttcatggttctatggttctgtaagtttagacaccttttttttttttttttttttccgagacagggtttctctgtgtaatcctggctgtcctggaactcaccaggctggcctcgaactcagaaatccgcctgcctctgcctcccaagtgctgggattaaaggcgtgcgccaccacgcccggttatttagacaccttttaacaggggtggcctgccatcataatcaagataagagaattttgtggcatttccccaaacttattgtgtcctcttgtagtatagtcctgcccccatcctcaaatcctagcaggcacagacctctttcctgttccttaatataagtgtcgtaagtcacacgggggcttattttatggcattaagcttttagctttttccttttagatcttacattgaagttagatgcagttgtataagctcggataaatggataaagccgagtaatcattaatacaggacagaagagttctattagcctctcctttaccattcctggtaatttatagtcaaaccttgttctctccctgacagtcacggacttgtgctttcactttatggcttgtcttttgaaaagagttgtaagtggaatttaatagtatgtaacttttgagattaatgtgttataaattatagacttgagatccatatcactggatgtatcaatagtttgatttctgtttcatatgctattgtgtggatgtcttattgcttattcaaccctaagttggattacattctttacagttgaggaggaagttataaataaagctgctaaaaatc

SEQ ID NO: 107 - DNA, 21417 bp, mus musculus
taactgggtctcagcgccgcggtggctgcggctgtctcagcaacggctcgcgcctccccatcccccagttcccagggctcttcccgcctgccgcggtgcagacccaggacgaaggcggagaagcccggtccagcccggtcctccgcccgcacggctggagcatcgttccggaggactgcccgaaggcaagcctcgcagccggagagcgcggcgcacacgcgcgcctcccggccgcggccgtcctctcttccctccttcctctcctctccccctcccctctcctccgcccccagcctccgctgcggcgggaggaagaacccttcccgactagcccagagaacccaggtcgattctcattccgggagaaagagacccccctcggtgggatccggctggccgctcgcccccggctacggaagtgactggtcatctattaggagagctcgtgcctagcgcagcccccgaccctcgcctagccgcagccgcatagacagcgctccccagcgggcccccggccccgccgagcccactccccgcttggggccagggctggcgatgcctggcgcggcaacggcggtggccgcggctgctgctgctgctgccgccacggctgctggccggagcccgggtcgggggctcgagtctccgcagtggggctgagcccgcagccccgccccccgagcctgaggccgctgctccgccgggcgccgggccttctccgcccgcgcctccgccccaggaactggagccaagcggggagcccgggccccgcgcccaggcccggaccatgcatggccaccgagtcccggggggccctgggccttcggatcccgaacgctcagcggcaaatacccccggtgccgctccgctggcctgtgccgactcggaccctggagccttggaacccgggctgccggtgagcaggggctcaggcacggctcttggaggccctttggatcctcagtttgttggaccctcggatgccagcctgggagcgcctccaagctcccgggtcttaccctgcggccctagtcctcagcaccaccgggccctgcgcttctcctaccacctggagggctcgcagcctcggcctggtgagtgatccagacagcatgggaacctgggccacgggcctggtaccgggaacgggttcttgttctaggacttggagccgacatgctcaccctagccccttgggtcccctcaacccctacccccacctcctgcagtattcggtccagtcctttcagcctttgccccttgctcttatctgtcccttgcgccctcaagccttaagactcctttctcttctaactgttgaggctaacaggagaggaagcactccaagaaaagggggcaggatttcagggcagcaatggggatgtggttggaataggagaaaagaagtctcccattagctaagtgactacatttgtgcatggcactgaactgggtacttttacaagggtttttgtttcagcttcaggagccatctgtgaagtggatatcatcaattacatttttaggggtgcagactgaggctttgagaagtaacttgtccaaggtcacactgtcattatggtgcctggatttaaaaacagatcagagtccaaaatctgtggtcttcccgcttccccaaactgaagctggagagtaatgcaagctttctccttatgtgatttccccttatacgactcagtagcccgaaagtatgagcaaaagagagagggagatggtggactgatcctagattgtgcttctgctaggtgtgtgtggccacaggacaaggggaggaagaggtagggggtattgatgagagagaaaggtggagctgagcctggaggaaggggctgaaggcgctgctggtacgaaggaataggacagagaggtcagaagggagagctgctgggccaggagattgtttggaaaaatcatcaggatggttgcttgggtttgcagtgtggtggaacaactctaggtcaggctggggccacagaccccgatgggccttttcatagtcctgagtatctgagcagcctagcagagcctctaggatattctcacgtgggcctgagtctgggagccttgaaggaagaacagtgtatggatctgccctatcttcactgggactgaaggaggtggtgagcttttagcagcttccagggctcatagctcaccttccacagatcactaggactgtggctcaggaccaggtagtaggaacagttggtgaagcataaaacatgggcagaatacgcctctctctgctgtctcttctttggatagttatggaacctctgggagatttcaggcgctgccccccctcacccccttgtgaactggagataggcagctgacactctttaatgctctgccctgcttgttgcttctgctggcttcccaaactcccctggacacatgctactcatacatacatacatacatacatacatacatacatacttgatcttagctcctcccttcaaatccctaaacagccagagctctcccactgcagtctgcatttgctttgccttctgcctgttagctcttccctcagccctccacctggcttgctcctcatctttctggtctcagctcaaatgtcccctctgagagaccttccctgaccactttaagtagggcctcttgtgaatctccatcacagctgccagtgtgtgtctatccttacatttaatacagtctgaaagtgccctcttgtatgtgtctacttgtttattgcggctcatttgccaccagaaagtgagctcctcgagggcgagggggctgagtctgttttgttttaccttgtatacctaagggactgatgtagtgcctaacacgtggcaggtactcagtgtctcgatggatggtaagggaacgcatagtaggccctctgtaactattgcctaagaggactccgagctcccacccagcaaatactcttggtctgggagacaaagctaggaaggtcttgacccttggtctctgccctctctagtcaacatagggttgataatgagcaagcttttctactccaccagttcttccaaattccaaagcagagttcccttcccagaccatccccctcttctcctcaaccaatagtgttgttttcaggatcctgtctcccccccccccacccctgcccccagctaagtccttgcctctgtaatggcttgagtggtatcttttagtttacacccctccccccttttgtttttcaaaatagggtttctttgtgtagccttggtggttctgtaactcagaaatccacctgcctcttcctcccgagtgctggaattaaaggcgtgctccaccactgctccagctagagtcttttaatcaaaagtaaagattgggggtagaaagggaaagacttggtctcccgtctggccatttctcacttactgtgtgtccctggatgaatgacttcagttctctgtgcctcagttcccctcgtctagagagtgatatctaggaatccatcagattcttttttgcaatgctttcagcaatcagggacttaaaaaataaaatacgaggagagaaaacccttcgagaaaacccttctgaagaagaggcggaggaatttctcaagtcctgacaaggcgggcactgggccatgtgattcacagtagcatgggctgtgagaggcccgcctccccctctgcacagccagctcagaggtaggcacaagcaacttgcttctctccataggacttgcctataattggctcagaatgggcagaggtggtggatggagggagagcaagaaagagggagagacagacagaaagtcgagcttcagttaaagggttagaaacattttagtccacctgctaagatattcgtgtgtctgctgactttctccttcagacttttattgaatcaccagccttacgtcccagtggtgcatcccagagcagcagggggtggtggtgtgaaaataataattatatcttatccatgtgaagagctctgaattacctcccctggccctttctttttgttattctgtctagtacctggtggagagtgttatgttcgtcttctaggctgataaaggccaaccaaggcttccttggaccactgggataacccggtgagatactcctgtccctaacacttggacagggttagcagagggcttccaagtgtaggtttatgggtagggttttgggagaatcctactgtagtcctcaagactgaggcctagaatgctttctcacatgttgtggagttggtgaaagcttggcctaaccctagctcagccaaaggagttggacttgatgtcagggccattttgttggggagatgagagaaacagccaatgtaagtagtggaagggttgcttctttcttacttggttacatcttaagagactcaaagatttaagcttaagctaaagagtccttagacaccggctgcttctgggttttctagccttagtgagcatcagaatcctttgttgaccttgaagaataaatgtcagtctcaaactccaactcgagatccagagcctcggagttacaacccgagaatctggtttcaaagaacaagtcccagacaagggacaggtgtgacacacctttaatgccaggcagaggcaagagggtatcttgagttccaggccagccagggctatatagtgagagcctttcccaacatcagggattcccagatgatgttgatgcatggcctaggggagaagccaggcctgttttttccagttgagtcaatggagacccagagacaatgattcagccaaatttctatagtgagtgaacactggtctccccctccaaagtcttcttcccagaatcatatatgaatctccctcaactcaacttttagttcagaagagaagcatgggatataagaaagcaagttaaccccttgcccccacctctaactggatgcctcagtttacctttctcccttgcttttgtgaatggctgttatttgactattttaagttggaaggcagttggaataatggaactccaggcatgggaaatctggtatcagcatttctcaatgcaaggcccccatcccatcccaagtgactggatttagaagtatgtcaactaagacttaagacctagagaacatggaggtcagtccagctagaaggtctggtgtcagcaaagactcgcaaacactgcttaggggcctagtattgggaagggtggaaaaataaggctagcaaatagactttgtcctgaaggcaaacaggaaccatcaagggctcattcacaggggaatgatgtacttaagtgctagagtttcagagctctcttaggtgcttatggagaatgggtggaaggtgttaaatagtgcaagtgagtggaggggacaagcctggctgtcacatatattttgagaggtgatggtagcccaggttaaagttgcagcaggtggattgggagtacatttaattaccaacatgggcaagccttagtaagggctgtagaggccaaggaaggaggaaaaattcaggatgtttctgggtagtttttctgaaaccaactaactatagtgacctagtggatggtagtggagccatgtattcaagagaagtagacctgtttctttaggggacggtgatgagttgtgtttgagacttgctgagcttgaaaggtccaggaggatatcaagatagtaatggtcaccaggcatttgggtttaggattataaatctccaacaagatttctgtgtgagagatgcatggaaatgttcaccaccaccatgtaccatagaccacaaggtggctcttattcgaagtatgtgtgcttctgaggaacagttgcatccttgaagacagatgctgaggtcagcagagccacattctggtaagtccctttgtgtgcatccgctttaagcatttgcagggagctgaggtctattccacacacattgaggatagctggctttcataacgaaatcctaaaaggcaaatcaaacattcccaaatatttgtgtggctccttccttgtttttcatgctgagagtatttgagaggccctaaaggggtttttctttttaagggtctctgggataggaatagtggtgagctaggtggtgaggtttgcaggatttcaggtgagcctggtaggtttggggactatctcagatttagtttctagtcatctggagccattcagaccaatacaatgtcaaggctggataggtgggagctaggtggtgaggtggctaggtgagcaaaggaacttctccagattaaaggaattgaaagtttcaaatatagatgcttggcacctccactcagtcctttcagatgtcctgtccaaggagggccctagggccctcctccctcaacagtgactgacagttaacagtaccctactcagtggctttctgcagccagttagctaaatgccttaggcagatgtggtgctggccagacgctggctgggtggggctgggacctgtctggaatgagggcagaaagcatagcctgtcattggctagctacttggagttaagttccttaatgcaaagagaacaaacatccttggagttgaaaatccagcccttcagggctctggtgtccagtagctggatgctagaaggcattgtatctccagaacacttggagacaaggttataggatatccagtgaaggacctcagcattccggaatctgccattgattcatttttttccctaggccttattcccatctcaggactttatttccccatttctaattattgcttctcatttgcctgacaagcataaacactttgtgaacctgtaaggtagggaaaggaggctgttttcttaacgtgtctattgagtgcttacagtgtgctcagctctgcaatatatcctgagatatggccctgttttcatagagctcccgtttagcaggaaagataaactgcaagtcacttgccagcacagccgttgcaggggcacatggaggggaggcaggtcagacattaatgttcagacctgaagcataaatagatgtccagaggtgaggagatgtggaaaagcagttcatgttgcaggaacgacatgtgccaaagcctcaggcggaagaaagcactttcgaggaatagacaagaggccattgtggctcaaggatgggtgtggggcagtgttcatgagcttagggctttcttgttcctatttggagttcaccccaaggctagggtaagcctggctgggctttggaaagggccctgaggatagagggaagcagtagagactggaagtggattgtatggattctagagctaagaaagggccctgtctgcaggacttggagttagttgattgtgtgagttaaggttaagaggactggtggagaaaggccagtctgacttggacagcttggatgattggaggtctttgctgttcctggggtggggaaagcaagaggaggagtcagctaaaggctggctagagtagggatgcttgttatttttaggatacactaagtctgaggcgccccaacataagacatctagaatagtgcacaacaggcaccagctgtgttttcctgggcccctgagtaagaacaggatggtgaggtcacaggtgtgtggccagagctgcccagccacagcaggctctcctgttgccctttccttctctgttgtctgctccacttcctgtgttatgcttcacagtggccctgaaagggaaagggttaagtcactgagcaaaactcttctctggaaagtgggaaaggcaggactggcagggctggcccctgggagctgcagctggcatagaagcccttccgctagccagtaaggccagagccgcagcagccgcccacgctgcctcctttgctttgccttcaccttcgctgctccccttccaccttcttcctggctgcctgagtctgggcctccctacctaatacattccaggtgtaggtgcagcccctctcacactgcagggcagcgggggggggggggggggggggggggggtgttagggaaggtggaagtctctgttgctgtgtgtcttttagggtgagtttcctaatctccgggactgttgttctctgtaagattcttcagggatctttcagccatatctctgacaatgatggggagaggcctccccccagacctccgattgccaccttgaaaagtttcatgtggtcggtcttgttactcgtgcctcagttttcttatctataaaatggcttgtaattcccacctcttagtaccattgaaaggattaaatgtcacaggcaaagcccagaggcctattgtagccatgctcaacaggtggccctggcctgccattttgccttgtggcctgcatccctctgtgacctccatgccttatgccaactactgtctccattcagacttgtcacactttctgtttggtctttcatacctatctggatttctgaaggtttcctgctttttgattccttgtctttgtcccagaatctttctttattaagcattgtttgtttcttcttttagacagggttttatgtagtctgggctggccttaaactcactatgtagttgaagctggccttgaaccctgggtccttctgcttctgtttcccaagtgctatgattactgccatgtaccactatgtctagctttctataaaaggtcttttcctttcctaattcttctgtgtatgcagttttcagatttgaccaggcttctagtgggagggggctagatgcatgggtttaggggacaaccctggggtcaagacaggagtcagagggatcattcctctagtggctttgtctttcttgggagggtaatgctagccagcgtggcagccctagcactgggtaattactgtccccagtgctcccagctgcagctccactcccttcccttcctgtcctctgaagtccctagctcctcccaggggtggagctaccaccccctgtccttttctggactctggtccagagaagaccagcttaagtggccaggccttcatagcaatcaagcagatggaagcaggatgggttgcttgtgctcttagcagtgtgtgtgtgtgtgtgtgtgtgtgtgtgtgtgtgtgtgagagagagagagagagagagagagagagagagagagcgcttgtcctcttggcagtccttattatccccatgggttgttttgtgttttactagtctttctagtgcgtgtatgttaatttgcctgtgtgtctgcatatatccatgtgggtctgtatatatccacgtgggtctttgcatcactttatgttgtgtgttgtagatttatgtcatttggctcagtcttagtcctggaagtttctagctgcttctctatgtttatctgtttctgtgtctgtcattatgtcccccataagtcagtgttctaatagtggtggctggggtgccttttgatatttcctgccagatcttcctattctggaactttcttacaaagccagcacactgttctttagtcacatgcttcatctacacaccttctcaggtatccataattttgtccacctttcttccctcatctgtaggaccatcctgaccacctatgtttgaaataaaaacacactctactctggacagctcaacttaaaatcacatccttcagaaagttgcctcatccctccttccaaatatgatttctttcccagttcagcaaattcacaagaaacgtgctctgtgactacacatgaacacaccttggatccagccacagctcacttactctagccatatagcctctagtcaggtatttccctctttatgcctcacttttctttcctttctttcctccttcccttgttcttccttttctttttttttttaaattgagacacagtctcactgtgtaatcctggctggcttggaactagttatagttggagaccaggctggcctccaacttacagagagccacctgcctctgcctctgcctctctgagtgctgggatcaaagccctgtgccaccacacatgtacctatttctttgtgtacaaatggcaccaataactcacatagcatgccacaggaaagtgccaacacaatgcctgacctagaagagatgtttaatatgcagttgaatttccatacctcctgtcatcttttagaacgtaacagcttagtatgtgcggggtgtgtggcttcattggtagtgtgtttgcttggtatgcttgagtagcatgcacaaagccctgggttgaattttcccagcactgtataacccacacaaactggtgcatatccataattccagcactctgcaggtagaggcaagagaatcactatgattccaagacgagaactactcagtgggttccaggctagcctaggctacaaagtgcagccttaccagaagaacaagaggaggaagaggaagagaaggctgctgctgctgagccaggcatgtactctatatatgaagacacagagatcataagttcaaggtcatcctagactatatagggagttgaggtcagtctaggctagagacccctgtctttaaggggaaaaaatgacagcttaagttctagagaattctacatatttttcagtctttaaaggcagattttaattcagggactgcctgacaaatattatatgaaataactcccttgacatgaaagagacagggccccttcaagggatgagactaggggcttccaaggctaagggccagaacattatcaatataggataaagagcaggcctgacaagttgttttaggaggtaaagcctgtgaacctgactttagtccccagaacacatgtcaaggtggaaggagagaactgacttcaccaagttctcttctgagctcctccccaccccagctctcgggttctgtctctctaaataataataatagtaattaatgaacagacttttaaaaaaggtcaacagcaaaaatataagaggcctacataagtagttaatatgagaacccacaaagttggtctctcgagttttattttgattcaattgatctgctcagtcttattttattttattttatttttgagacagggtttctctgtgtagccctggctgttctagaacttactctgtagatcagggtggcctcaaactgaagagacctttctgcctctgcctccccagtgctgggatcaaagggtttgtgccactattgtctggtatggctgctctcttaaagttaggggagtccacctgaaacccttgattattggaagatctgaaactaggcaccattcgtgcgaggtaacagctggatggaggggatggattctgtctgtagtgtaagtgatgcaggtgctctatggcttccctgcttctcactgttccttccctattactgtagtcagtctcggtctacggaaagcttctcacttgacacaggggtgcacagtttacagaaaggtccatccctttataaggaaaaattcctctgtttaatggacaagttttctccttcacttactggcaggccatctgctttacagtgggtttctgtagaactctcctcacttacagaatatcccttcactttgaagaaagaaatcacttccattttatagaaattctttttttacagaggaaccttaaaacctaaaacaaacaaacaaacaaacaaaaacccaaacaagtaaacaaacccaaagaggtggaaacaggaagattgggagttcaagtttgttcttggataagtttgaggccagtttgggctactgagaccctgttttaaaaacaaaacaaaacaagcagaaagttaaaggaggactgcagtacacacctctaaacccactgcttagaaggctgaggcaggggaattaccatgagtttgaagttagccttggctacagagtgagttataaacaagcttggcctatatgatgagcctctgtctcataaatgcaaagcaaaactaaaaatcaaagagaccttttatagaaacctgttctgcaggaggacacggaagctccttgctctccagatgcctcccactttctgaaggtgtctttgcactgatgaaattaccccattttttgccaaacctttatagtcagaagatgagtagacttcagagaatggttgggctccccttgggttcgagcaaagaacacatttcacagagctttgtgcttggattccgaaggaacgtctactagtccgagccaggtctggatgtagtcttaccctgaaggtgggctgagatggtgaagctgcagctcactcgtgctcaggagacaggtgggaagagtgagggcagctgtaccttcagcccttgctttctcccccagtccgagagaccatcctctttacccgccgacctagtttcccaaaagttctttcctttttgctgttgttctttcttctccactccctctgttctctgttgccacccaactgcaacctcagaaattccagctgtcccaggcagtccccctcttaagggaaggctgcatcatcctggaggaggcctgactgctggggttatgggtggctccccccacctctcactagtttctcacaatgaacaacacacacacatatagtgccccaaatttgcaaatgggaaaatgagcccagagctgtggagtttttggtcccaggttatcagagagttaacagccaaggctggtctgcagctctcatagttgtcttgagattaagccaaggctacagctgggagaagggagacaggatgctgctggccagggaaggagggagagctggcagctgaactttccagaaagagatgcaggagaagcagggtcaggttccagtgagaatgggccagaggaggagtttttgtcttcaaattcagctagacgctgaacctgctctgccatataaacccagaaacatgtcctccaggcatctgccaaacaggcacatgccaaaatcagaaacaatatcttgaataattttactattttttctgtttttttcaaatttcctacagtgtattttgatcatattttcccacttcccctgacttctcccagatccatcccacttccctaccaacccaactttatgtccttttttttttaagccccattaagtgcagtttgtgctgccaatatattcttagatatgtggcctttcaccggagcatggttgatctaccagtgactatactctaaaacaaaactgactcttcctctcccagcagctaccaaattgccaatagctactcatctagggatttgtctgacttgttcaggtcttttgtgtgctgtcacaactactatgacttcatatgtataactttccttctgtctcgagactaacaatgttttcttatcactattcactatctctggctctaaaaatatttctgccctttctgttacaatgatccctgagccctgggaggaaggtctgtgatgtatgtgtatcatacccattcatccctcccttcctgagcatcccacactctcttagtctctgcaccttgaccagttgtgggtctctgtgttaatcaccatctactaaaacttagaagcttctttgatgggtgtcaataggtgggttaatccgtgggcacattcacaatgcatcaggagtcagtttaataccaagtcaagttattctgtcctatgccttgatgtcccatgctcaatcctaatttaaccctccagcttccattattcccctttagccctttgtcacttccattgaaagctccctgccatggcttcttactaatttaccaaccactatggatattccaaatggaactcacatatctaaagatttagagctaacactcagaaatgagagaaagcatttaacatttatctttctggttctggggtatcttactcagaatgattgtttctagttccactcagttacctaggaatttcataattcctttttttcttttctcatttcttaagacagggtttctttgtgtagccttggctgtcctagaactcactatgtaaaccactggcctcaaacacacagagattcacctgcctctgcctcccaagtcctgggatgaaaagcatgtgccaccaccgcacaagcaccaattttatttttcttaacagccgaataatattccattgtgtaaaagtactacatgtttatccattcatcagtgatgggcatctaggctgcttccattttctggctattgtgaatagagtgtcaatgagcacggagcaacaggtacctctatagtaagatatagaatcctttgggtatagggctgagagtgataaagctggatcatgtggttgatctgtttctacatttttgaggaaccttcatactgatttccatagtggcctcaccaatgtgttctcccaccatcagtgaataagtgttctcctttccccacatctgtgccagcagataaggatgcagtttcatttttctatgtgtatctatccattttgactattctcttttctccagggttgctggcctctataaaaaagtcaggtacctataggagtgtaggtttatatgtagcttctcaattctagtccattgattagtgtgtctgtttttatactagtactgtgctgttttcattactatacttctgtagtatattgctgtttcttgaactgaagctcagtagtaaagttcttgcctagtatgtgctagttacagcattatagcacacatacaatctccctctccctccccctccctttccctctccttctctccctcccccctccccctaaaccaaccaaccaaaaatccattgcccttacagccagctgagggcttagaggttgttgaggtaaagtaagagagtatatatctcacttttacatctgagcttaggagtacctgggaactctaggatgctctgggtgtgcttcctgtcgttgctgtgagctgtgggagtactgtagtggttgggttatgcatgttgtgctgagcacactgcatactgataggatacatcatggtggctctgtggttctctctgggtctttgagggctgtgcacagttggcatgtggtacggggtgttagaagatttatgatgactgtgtgtgagagaaccagcagggactctggtagacctagagatagaaggagcagtgctggtagagagccttcatgggggtgtgggtgggtatatttgtgtcagcaaatgttttaaattaattatcaaccataagaaaaatagtctggagcaaaccaatttaggatctaggtgggtgggatggatggggaaataggaagtactgtggtttttagaaaggaggaagtgggccctactctagtagctcccttgagggcaggaacgagattttctgtctctgcacagggtctagcagctgcaaaatatagttcacttactaaactcaactgagggaaacccaagagttgagcagggctataaagggccactgagatctagtgaagatgtttatattttcccatgggtagaagggagttatggaaagttcctctggtaggttgtgtgatctgtctataagaagattccaccaagaaagagtaagccctggggcaaagggagtcactgaagataacaggagacactgggaagaagggatctacagaagtagaaggcagggctcttggatcttcccttcagtgggaccttatcatggccatctccagactcctgaactgaaaccctgctgtcctgtgggcagggttgtcggtatcctttttactagtcacaatttcttttttatgacactagtgtcctctcctgtctcttgtggctttcctttggaaagcagggttaggtttagtctacctgagagtcagctatttccttgttgtgtgattgtgggctagtcaccaagtctttctttgtcttcatctcttcacaagaaactggacagagaatccctgcccacctcatctgggactccagggtatccctgaatctcaacttcactcagtctgttctacaggactgcttataaggaggcagagactagagaggtagcctgtgcatctcctataggagggtcaggtggataaggagaatccagaatgggccagggcagagccttagagaatggtaggccacaccagtctgagaagcaggggaatagaaggacagaaacccaaccccctcacaagagccctgctgcctagctgttggcctggtggggaggatttacttagggcagcttacctgctttgaggtgttaagggctggaaagcagatagagagcccctgggaccatgatacctgtgtatgtctacgaagggtgcatggcagtgtgtttggccttgttcagcaactctttggccacaactttctctggctgtgtgtccttgcaactatgtctacacctgtaccaccctccaggtgattcatcctcctcaatcctatgcccagagaggacagggcagggccagccaagatgtgctgagctgggcaggataaacagctctactgggccagaggtgagaagaagaatactcttgctatgcaggctgggctctgcctgctcaggtaggaaggcacaggaggaaacgtcacccaaagccaggtacaaggtagaagaaacccactggggccaggatctagagcacatgttccctcaggctgggaaggctctgtatccaggataaggccaggagttcatggaagctgctatagaactgggttccctctacaactaggagaacccaaatcccctgcaactctttctgctggtgtcatctggtgagcaagggtatggatgtctctatatgtaaagacagcatatgacagcattgtttagagcaggaagagacatgtgtcctgttgttttgtatctgtgtttgtctatatccttgagctaagaccctcagataccatggttatgtttgttgcaagatcgtgatataatcaatcatgaaatgtgtctgatttgggtccatgtttctaggtatgtagtggcttatgactttacactgttttgctgttgtatgtgggttttttttccataacctggtataatggatcctgtgtggctgtgatctttatttgtaactatgcttgtaggcatttaaaggtattgttaatgatatatatgaaagtacatgatcctgtaatataaatggaaaaataccctttgtaactttgtgtgcttgaacaatatatggcggtatataaagttatattgtggtatgtgttatattgtggttaagtgattttgtgtaagaactaccatttatgttttttatgtctttatgattctgtttcatctttttcttttttctttctttcttttttttttttttttttttgagacagggtttctctttgtaacaaccctggctgtcttggaactcactctgtagaccaggctggcctcatactcatagagatctacctgcccctgtctcccaattaaaagtgtgcaccaccattgacccccccacacacttgaccttattatagatgatttcaatgctgtgtaatcatatgtggaattgtatctgctggtctgtgaacttgtatgtgcccaggctttcaggagagtgaagacatgtgcttggatgtttgaatttgtgtgacctggcagttgtgtgaagcgctataaattccatgtgctcttgtgtctttggggacccatttgtgactgtccacttaagagactgtgacataaagtaaaagccttgagatgagatgccacgtggctgtggcacatcatgctctccttgtagctgtgggacttgttatttgtttatttgtgttcagttgggtttttagtatatagcccaggctggccttgaactcattatccttctgcttcagcttcccaggtgctaggctcataggcccatactgtgcctggttggtgctctgggagttcttgactagtgctcgctccatcgtcctcaccttattacaagcacctctccctacacagtgcttttcatggcctctttcaccacagaaaagttgagcagcttgtattctgaatactggtggggagggtggggaggtgtgaggtggatgttgaaatagaggaaggtaaacaaattagtaagacactgggatttttttttatttaataaaatattttttattaggtattttcctcgtttacattttcaatgctatcccaaaggtcccccatacccacccccccaatcccctacccacccactgcccctttttggccctggtgttcccctgtactggggcatataaagtttgcaagtccaatgggcctctctttccagtgatggccaactaggccatcttttgatacatatgcagctaaagacaagagctcccgggtactggttagttcatattgttccacctatagggttgcagttccctttagctccttgggtaatttctctagctcctccataaggggccgtgtgacccatccaatagctgactgtgatcatccacttctgtgtttgctaggccccagcatagtctcacaagagagagctatatctgggtcctttcagcagaatcttgctagtgtatgcaatggtgtcagcatttggaagctgattatgggatggatccctgcatatggcagtcactagatggtccatcctttcgtcacagctccaaattttgtctctgtaactccttctatgggtgttttgttcccatttctaagaaagggtaaagtgtccacactttggtcttcgttcttcttgaatttcatgcgtttggcaacttgtatctgacactgggattttaaagagaaaaatgtttgcttataaaatatagttccaccagtgtgcaatgtgtgcacatagtgggactggaacctaggccttgcaaatgctaaacaagtgctccatcaccagctaactccctagttcctagtttcatcatttcttctaaagacacttagctgtacaaaattgtagataagaaagttcagatgttcttagggctttaagaaatgggataaagatgacagaaatggtagtttatgcctataatcctggcactgtgaaggctgaaacaagattgtcatgaatgtgagtctagcctatgctacacagtgagatcttgattcaggtatgtgcatgagctttaggatattcacgtctatcctcaacctagttgaaatccagagtttgctttaagtccttaattacttactgacaggcatgggatcaatatactaatcacagagaattataacttcgtgatgaaaatagccagtctccaccttgggcctggtttctgtctaaagcctggaagagaggcttcctggcaaaaccatgtggctagcacaggactcaaaggagcctagccctagataccagctaagatatgctacttcctattctcccttggggtaaaatcagtcagtcacttcatgtctagtctccctttctacaggactgcaccagggaaaccggatcctggttaaaagtttgtcccttgaccctggccagagccttgagcctcatccagaaggtccccaacggcttcgctcagatccaggccctcccactgaaatccctggcccacgtccttcaccactgaagcgggcaccgggcccaaagccacagggtaagtgcttccattaagagcagagaaatggaccagagaagtgtacaaaaggaaaggagaaattaatgcatggcagaagaatagggaagtgcccttatctcaaagggcactgagtgatacctatctaatgggcagaaaggtgttgtctgtggctaatatagtctactaagatttcacatcagtcagtcctgctctgtgctgccaacactcaggaggttgagacagggtggttgctgtgactttaaggtcagtcagggctagctatggtattgtgaaattaggtatagcctggtcatagtcacctcgaaatccagttcagtgatatctctcctctcttctccatccatcactccagttcccccaaagcccagctacctgcagatgccccgggtgcttcctcctcctgagcccattcctccaccaccatcacgccctctgcctgcagaccctagagtggccaagggactcgtccccagagctgaggccagcactagttctgcagcagtatcatcattgattgagaagtttgaaaggtgagtcttgtccccataggaccctgtgagggaagggtggatctgggacaggaagggttcttgtagaagaggcctcttggtcatgctcacaccctgcctccatgtctgtccatcacccacctcagagagcctgtgattgttgcctcggataggccagcccctggcccctgcccagttcccccagagccagccatgttgccacagccacccccgcagccaacagggtcccagctccctgagggtgaagcttctcgctgcctgttcctgctggctcctgggccccgggatggtgagaaggtgcctaaccgggacagcggcattgacagcatcagctcgccatccaacagtgaagagacctgcttcgtcagtgatgatgggccccccatccacagcctctgtcctgggccccccgccctggctagtatgccagtagctttggccgacccccaccggcctggctcccaggaggttgacagtgacctggaagaggaagaggaagaagaagaggaggaaaaggaaagagaaattccagtgcccccgatggagagacaggagtctgtggaggtactgacttatgcgttacccaagaggcaggaccatgcagagaaaggaggagcttggcttttcccagcttggtatttctcaaaacaggccattgcttccacttagtcgatttagcacctagtatggagcccaagtagcaaaactctgctcctctcccaaatgactgtgaacaccaaaatggccattcctcattctaaatgccggttaggaaggtggctccactttcttcagagaaccactaatgaacctcagtcttttcacgacccagtagctgtgtgacactgaggatgtctcttccctttccacttctcactacaagcctcagtttccttgtttgtatgccagaaactcttacatgccagagatacttctcagcaactagaggaggggctcagagccagagccccaaaggagcctgactgaagctttaggttgggaactctttccatgtgttgtctagctgatgtttcttcagaaggaatccttgcactcacgtaaggtctcagccaggagacctgctttcccagaactaagcacagctgtggggactggggccaggagtaccgagatgaaatgatactcagcaagtgtgtagcctgcaaacaagaaagtgagccagcaggcataatcttagacagttttgtacttctgtgcctttctcacagcccacgtactcagcaagcctttgctgacagcgagctgaatgagtgactgagtagctggtatttagacactgtaatccgcagtctgttctgtttttatttataggaaatcttttagggatgggagtgtaggaaaatgtagagcatttgcctagcatacatgaacccccaagtttaatccccaacattgc

SEQ ID NO: 108 - DNA, 40294 bp, mus musculus
taactgggtctcagcgccgcggtggctgcggctgtctcagcaacggctcgcgcctccccatcccccagttcccagggctcttcccgcctgccgcggtgcagacccaggacgaaggcggagaagcccggtccagcccggtcctccgcccgcacggctggagcatcgttccggaggactgcccgaaggcaagcctcgcagccggagagcgcggcgcacacgcgcgcctcccggccgcggccgtcctctcttccctccttcctctcctctccccctcccctctcctccgcccccagcctccgctgcggcgggaggaagaacccttcccgactagcccagagaacccaggtcgattctcattccgggagaaagagacccccctcggtgggatccggctggccgctcgcccccggctacggaagtgactggtcatctattaggagagctcgtgcctagcgcagcccccgaccctcgcctagccgcagccgcatagacagcgctccccagcgggcccccggccccgccgagcccactccccgcttggggccagggctggcgatgcctggcgcggcaacggcggtggccgcggctgctgctgctgctgccgccacggctgctggccggagcccgggtcgggggctcgagtctccgcagtggggctgagcccgcagccccgccccccgagcctgaggccgctgctccgccgggcgccgggccttctccgcccgcgcctccgccccaggaactggagccaagcggggagcccgggccccgcgcccaggcccggaccatgcatggccaccgagtcccggggggccctgggccttcggatcccgaacgctcagcggcaaatacccccggtgccgctccgctggcctgtgccgactcggaccctggagccttggaacccgggctgccggtgagcaggggctcaggcacggctcttggaggccctttggatcctcagtttgttggaccctcggatgccagcctgggagcgcctccaagctcccgggtcttaccctgcggccctagtcctcagcaccaccgggccctgcgcttctcctaccacctggagggctcgcagcctcggcctggtgagtgatccagacagcatgggaacctgggccacgggcctggtaccgggaacgggttcttgttctaggacttggagccgacatgctcaccctagccccttgggtcccctcaacccctacccccacctcctgcagtattcggtccagtcctttcagcctttgccccttgctcttatctgtcccttgcgccctcaagccttaagactcctttctcttctaactgttgaggctaacaggagaggaagcactccaagaaaagggggcaggatttcagggcagcaatggggatgtggttggaataggagaaaagaagtctcccattagctaagtgactacatttgtgcatggcactgaactgggtacttttacaagggtttttgtttcagcttcaggagccatctgtgaagtggatatcatcaattacatttttaggggtgcagactgaggctttgagaagtaacttgtccaaggtcacactgtcattatggtgcctggatttaaaaacagatcagagtccaaaatctgtggtcttcccgcttccccaaactgaagctggagagtaatgcaagctttctccttatgtgatttccccttatacgactcagtagcccgaaagtatgagcaaaagagagagggagatggtggactgatcctagattgtgcttctgctaggtgtgtgtggccacaggacaaggggaggaagaggtagggggtattgatgagagagaaaggtggagctgagcctggaggaaggggctgaaggcgctgctggtacgaaggaataggacagagaggtcagaagggagagctgctgggccaggagattgtttggaaaaatcatcaggatggttgcttgggtttgcagtgtggtggaacaactctaggtcaggctggggccacagaccccgatgggccttttcatagtcctgagtatctgagcagcctagcagagcctctaggatattctcacgtgggcctgagtctgggagccttgaaggaagaacagtgtatggatctgccctatcttcactgggactgaaggaggtggtgagcttttagcagcttccagggctcatagctcaccttccacagatcactaggactgtggctcaggaccaggtagtaggaacagttggtgaagcataaaacatgggcagaatacgcctctctctgctgtctcttctttggatagttatggaacctctgggagatttcaggcgctgccccccctcacccccttgtgaactggagataggcagctgacactctttaatgctctgccctgcttgttgcttctgctggcttcccaaactcccctggacacatgctactcatacatacatacatacatacatacatacatacatacttgatcttagctcctcccttcaaatccctaaacagccagagctctcccactgcagtctgcatttgctttgccttctgcctgttagctcttccctcagccctccacctggcttgctcctcatctttctggtctcagctcaaatgtcccctctgagagaccttccctgaccactttaagtagggcctcttgtgaatctccatcacagctgccagtgtgtgtctatccttacatttaatacagtctgaaagtgccctcttgtatgtgtctacttgtttattgcggctcatttgccaccagaaagtgagctcctcgagggcgagggggctgagtctgttttgttttaccttgtatacctaagggactgatgtagtgcctaacacgtggcaggtactcagtgtctcgatggatggtaagggaacgcatagtaggccctctgtaactattgcctaagaggactccgagctcccacccagcaaatactcttggtctgggagacaaagctaggaaggtcttgacccttggtctctgccctctctagtcaacatagggttgataatgagcaagcttttctactccaccagttcttccaaattccaaagcagagttcccttcccagaccatccccctcttctcctcaaccaatagtgttgttttcaggatcctgtctcccccccccccacccctgcccccagctaagtccttgcctctgtaatggcttgagtggtatcttttagtttacacccctccccccttttgtttttcaaaatagggtttctttgtgtagccttggtggttctgtaactcagaaatccacctgcctcttcctcccgagtgctggaattaaaggcgtgctccaccactgctccagctagagtcttttaatcaaaagtaaagattgggggtagaaagggaaagacttggtctcccgtctggccatttctcacttactgtgtgtccctggatgaatgacttcagttctctgtgcctcagttcccctcgtctagagagtgatatctaggaatccatcagattcttttttgcaatgctttcagcaatcagggacttaaaaaataaaatacgaggagagaaaacccttcgagaaaacccttctgaagaagaggcggaggaatttctcaagtcctgacaaggcgggcactgggccatgtgattcacagtagcatgggctgtgagaggcccgcctccccctctgcacagccagctcagaggtaggcacaagcaacttgcttctctccataggacttgcctataattggctcagaatgggcagaggtggtggatggagggagagcaagaaagagggagagacagacagaaagtcgagcttcagttaaagggttagaaacattttagtccacctgctaagatattcgtgtgtctgctgactttctccttcagacttttattgaatcaccagccttacgtcccagtggtgcatcccagagcagcagggggtggtggtgtgaaaataataattatatcttatccatgtgaagagctctgaattacctcccctggccctttctttttgttattctgtctagtacctggtggagagtgttatgttcgtcttctaggctgataaaggccaaccaaggcttccttggaccactgggataacccggtgagatactcctgtccctaacacttggacagggttagcagagggcttccaagtgtaggtttatgggtagggttttgggagaatcctactgtagtcctcaagactgaggcctagaatgctttctcacatgttgtggagttggtgaaagcttggcctaaccctagctcagccaaaggagttggacttgatgtcagggccattttgttggggagatgagagaaacagccaatgtaagtagtggaagggttgcttctttcttacttggttacatcttaagagactcaaagatttaagcttaagctaaagagtccttagacaccggctgcttctgggttttctagccttagtgagcatcagaatcctttgttgaccttgaagaataaatgtcagtctcaaactccaactcgagatccagagcctcggagttacaacccgagaatctggtttcaaagaacaagtcccagacaagggacaggtgtgacacacctttaatgccaggcagaggcaagagggtatcttgagttccaggccagccagggctatatagtgagagcctttcccaacatcagggattcccagatgatgttgatgcatggcctaggggagaagccaggcctgttttttccagttgagtcaatggagacccagagacaatgattcagccaaatttctatagtgagtgaacactggtctccccctccaaagtcttcttcccagaatcatatatgaatctccctcaactcaacttttagttcagaagagaagcatgggatataagaaagcaagttaaccccttgcccccacctctaactggatgcctcagtttacctttctcccttgcttttgtgaatggctgttatttgactattttaagttggaaggcagttggaataatggaactccaggcatgggaaatctggtatcagcatttctcaatgcaaggcccccatcccatcccaagtgactggatttagaagtatgtcaactaagacttaagacctagagaacatggaggtcagtccagctagaaggtctggtgtcagcaaagactcgcaaacactgcttaggggcctagtattgggaagggtggaaaaataaggctagcaaatagactttgtcctgaaggcaaacaggaaccatcaagggctcattcacaggggaatgatgtacttaagtgctagagtttcagagctctcttaggtgcttatggagaatgggtggaaggtgttaaatagtgcaagtgagtggaggggacaagcctggctgtcacatatattttgagaggtgatggtagcccaggttaaagttgcagcaggtggattgggagtacatttaattaccaacatgggcaagccttagtaagggctgtagaggccaaggaaggaggaaaaattcaggatgtttctgggtagtttttctgaaaccaactaactatagtgacctagtggatggtagtggagccatgtattcaagagaagtagacctgtttctttaggggacggtgatgagttgtgtttgagacttgctgagcttgaaaggtccaggaggatatcaagatagtaatggtcaccaggcatttgggtttaggattataaatctccaacaagatttctgtgtgagagatgcatggaaatgttcaccaccaccatgtaccatagaccacaaggtggctcttattcgaagtatgtgtgcttctgaggaacagttgcatccttgaagacagatgctgaggtcagcagagccacattctggtaagtccctttgtgtgcatccgctttaagcatttgcagggagctgaggtctattccacacacattgaggatagctggctttcataacgaaatcctaaaaggcaaatcaaacattcccaaatatttgtgtggctccttccttgtttttcatgctgagagtatttgagaggccctaaaggggtttttctttttaagggtctctgggataggaatagtggtgagctaggtggtgaggtttgcaggatttcaggtgagcctggtaggtttggggactatctcagatttagtttctagtcatctggagccattcagaccaatacaatgtcaaggctggataggtgggagctaggtggtgaggtggctaggtgagcaaaggaacttctccagattaaaggaattgaaagtttcaaatatagatgcttggcacctccactcagtcctttcagatgtcctgtccaaggagggccctagggccctcctccctcaacagtgactgacagttaacagtaccctactcagtggctttctgcagccagttagctaaatgccttaggcagatgtggtgctggccagacgctggctgggtggggctgggacctgtctggaatgagggcagaaagcatagcctgtcattggctagctacttggagttaagttccttaatgcaaagagaacaaacatccttggagttgaaaatccagcccttcagggctctggtgtccagtagctggatgctagaaggcattgtatctccagaacacttggagacaaggttataggatatccagtgaaggacctcagcattccggaatctgccattgattcatttttttccctaggccttattcccatctcaggactttatttccccatttctaattattgcttctcatttgcctgacaagcataaacactttgtgaacctgtaaggtagggaaaggaggctgttttcttaacgtgtctattgagtgcttacagtgtgctcagctctgcaatatatcctgagatatggccctgttttcatagagctcccgtttagcaggaaagataaactgcaagtcacttgccagcacagccgttgcaggggcacatggaggggaggcaggtcagacattaatgttcagacctgaagcataaatagatgtccagaggtgaggagatgtggaaaagcagttcatgttgcaggaacgacatgtgccaaagcctcaggcggaagaaagcactttcgaggaatagacaagaggccattgtggctcaaggatgggtgtggggcagtgttcatgagcttagggctttcttgttcctatttggagttcaccccaaggctagggtaagcctggctgggctttggaaagggccctgaggatagagggaagcagtagagactggaagtggattgtatggattctagagctaagaaagggccctgtctgcaggacttggagttagttgattgtgtgagttaaggttaagaggactggtggagaaaggccagtctgacttggacagcttggatgattggaggtctttgctgttcctggggtggggaaagcaagaggaggagtcagctaaaggctggctagagtagggatgcttgttatttttaggatacactaagtctgaggcgccccaacataagacatctagaatagtgcacaacaggcaccagctgtgttttcctgggcccctgagtaagaacaggatggtgaggtcacaggtgtgtggccagagctgcccagccacagcaggctctcctgttgccctttccttctctgttgtctgctccacttcctgtgttatgcttcacagtggccctgaaagggaaagggttaagtcactgagcaaaactcttctctggaaagtgggaaaggcaggactggcagggctggcccctgggagctgcagctggcatagaagcccttccgctagccagtaaggccagagccgcagcagccgcccacgctgcctcctttgctttgccttcaccttcgctgctccccttccaccttcttcctggctgcctgagtctgggcctccctacctaatacattccaggtgtaggtgcagcccctctcacactgcagggcagcgggggggggggggggggggggggggggtgttagggaaggtggaagtctctgttgctgtgtgtcttttagggtgagtttcctaatctccgggactgttgttctctgtaagattcttcagggatctttcagccatatctctgacaatgatggggagaggcctccccccagacctccgattgccaccttgaaaagtttcatgtggtcggtcttgttactcgtgcctcagttttcttatctataaaatggcttgtaattcccacctcttagtaccattgaaaggattaaatgtcacaggcaaagcccagaggcctattgtagccatgctcaacaggtggccctggcctgccattttgccttgtggcctgcatccctctgtgacctccatgccttatgccaactactgtctccattcagacttgtcacactttctgtttggtctttcatacctatctggatttctgaaggtttcctgctttttgattccttgtctttgtcccagaatctttctttattaagcattgtttgtttcttcttttagacagggttttatgtagtctgggctggccttaaactcactatgtagttgaagctggccttgaaccctgggtccttctgcttctgtttcccaagtgctatgattactgccatgtaccactatgtctagctttctataaaaggtcttttcctttcctaattcttctgtgtatgcagttttcagatttgaccaggcttctagtgggagggggctagatgcatgggtttaggggacaaccctggggtcaagacaggagtcagagggatcattcctctagtggctttgtctttcttgggagggtaatgctagccagcgtggcagccctagcactgggtaattactgtccccagtgctcccagctgcagctccactcccttcccttcctgtcctctgaagtccctagctcctcccaggggtggagctaccaccccctgtccttttctggactctggtccagagaagaccagcttaagtggccaggccttcatagcaatcaagcagatggaagcaggatgggttgcttgtgctcttagcagtgtgtgtgtgtgtgtgtgtgtgtgtgtgtgtgtgtgtgagagagagagagagagagagagagagagagagagagcgcttgtcctcttggcagtccttattatccccatgggttgttttgtgttttactagtctttctagtgcgtgtatgttaatttgcctgtgtgtctgcatatatccatgtgggtctgtatatatccacgtgggtctttgcatcactttatgttgtgtgttgtagatttatgtcatttggctcagtcttagtcctggaagtttctagctgcttctctatgtttatctgtttctgtgtctgtcattatgtcccccataagtcagtgttctaatagtggtggctggggtgccttttgatatttcctgccagatcttcctattctggaactttcttacaaagccagcacactgttctttagtcacatgcttcatctacacaccttctcaggtatccataattttgtccacctttcttccctcatctgtaggaccatcctgaccacctatgtttgaaataaaaacacactctactctggacagctcaacttaaaatcacatccttcagaaagttgcctcatccctccttccaaatatgatttctttcccagttcagcaaattcacaagaaacgtgctctgtgactacacatgaacacaccttggatccagccacagctcacttactctagccatatagcctctagtcaggtatttccctctttatgcctcacttttctttcctttctttcctccttcccttgttcttccttttctttttttttttaaattgagacacagtctcactgtgtaatcctggctggcttggaactagttatagttggagaccaggctggcctccaacttacagagagccacctgcctctgcctctgcctctctgagtgctgggatcaaagccctgtgccaccacacatgtacctatttctttgtgtacaaatggcaccaataactcacatagcatgccacaggaaagtgccaacacaatgcctgacctagaagagatgtttaatatgcagttgaatttccatacctcctgtcatcttttagaacgtaacagcttagtatgtgcggggtgtgtggcttcattggtagtgtgtttgcttggtatgcttgagtagcatgcacaaagccctgggttgaattttcccagcactgtataacccacacaaactggtgcatatccataattccagcactctgcaggtagaggcaagagaatcactatgattccaagacgagaactactcagtgggttccaggctagcctaggctacaaagtgcagccttaccagaagaacaagaggaggaagaggaagagaaggctgctgctgctgagccaggcatgtactctatatatgaagacacagagatcataagttcaaggtcatcctagactatatagggagttgaggtcagtctaggctagagacccctgtctttaaggggaaaaaatgacagcttaagttctagagaattctacatatttttcagtctttaaaggcagattttaattcagggactgcctgacaaatattatatgaaataactcccttgacatgaaagagacagggccccttcaagggatgagactaggggcttccaaggctaagggccagaacattatcaatataggataaagagcaggcctgacaagttgttttaggaggtaaagcctgtgaacctgactttagtccccagaacacatgtcaaggtggaaggagagaactgacttcaccaagttctcttctgagctcctccccaccccagctctcgggttctgtctctctaaataataataatagtaattaatgaacagacttttaaaaaaggtcaacagcaaaaatataagaggcctacataagtagttaatatgagaacccacaaagttggtctctcgagttttattttgattcaattgatctgctcagtcttattttattttattttatttttgagacagggtttctctgtgtagccctggctgttctagaacttactctgtagatcagggtggcctcaaactgaagagacctttctgcctctgcctccccagtgctgggatcaaagggtttgtgccactattgtctggtatggctgctctcttaaagttaggggagtccacctgaaacccttgattattggaagatctgaaactaggcaccattcgtgcgaggtaacagctggatggaggggatggattctgtctgtagtgtaagtgatgcaggtgctctatggcttccctgcttctcactgttccttccctattactgtagtcagtctcggtctacggaaagcttctcacttgacacaggggtgcacagtttacagaaaggtccatccctttataaggaaaaattcctctgtttaatggacaagttttctccttcacttactggcaggccatctgctttacagtgggtttctgtagaactctcctcacttacagaatatcccttcactttgaagaaagaaatcacttccattttatagaaattctttttttacagaggaaccttaaaacctaaaacaaacaaacaaacaaacaaaaacccaaacaagtaaacaaacccaaagaggtggaaacaggaagattgggagttcaagtttgttcttggataagtttgaggccagtttgggctactgagaccctgttttaaaaacaaaacaaaacaagcagaaagttaaaggaggactgcagtacacacctctaaacccactgcttagaaggctgaggcaggggaattaccatgagtttgaagttagccttggctacagagtgagttataaacaagcttggcctatatgatgagcctctgtctcataaatgcaaagcaaaactaaaaatcaaagagaccttttatagaaacctgttctgcaggaggacacggaagctccttgctctccagatgcctcccactttctgaaggtgtctttgcactgatgaaattaccccattttttgccaaacctttatagtcagaagatgagtagacttcagagaatggttgggctccccttgggttcgagcaaagaacacatttcacagagctttgtgcttggattccgaaggaacgtctactagtccgagccaggtctggatgtagtcttaccctgaaggtgggctgagatggtgaagctgcagctcactcgtgctcaggagacaggtgggaagagtgagggcagctgtaccttcagcccttgctttctcccccagtccgagagaccatcctctttacccgccgacctagtttcccaaaagttctttcctttttgctgttgttctttcttctccactccctctgttctctgttgccacccaactgcaacctcagaaattccagctgtcccaggcagtccccctcttaagggaaggctgcatcatcctggaggaggcctgactgctggggttatgggtggctccccccacctctcactagtttctcacaatgaacaacacacacacatatagtgccccaaatttgcaaatgggaaaatgagcccagagctgtggagtttttggtcccaggttatcagagagttaacagccaaggctggtctgcagctctcatagttgtcttgagattaagccaaggctacagctgggagaagggagacaggatgctgctggccagggaaggagggagagctggcagctgaactttccagaaagagatgcaggagaagcagggtcaggttccagtgagaatgggccagaggaggagtttttgtcttcaaattcagctagacgctgaacctgctctgccatataaacccagaaacatgtcctccaggcatctgccaaacaggcacatgccaaaatcagaaacaatatcttgaataattttactattttttctgtttttttcaaatttcctacagtgtattttgatcatattttcccacttcccctgacttctcccagatccatcccacttccctaccaacccaactttatgtccttttttttttaagccccattaagtgcagtttgtgctgccaatatattcttagatatgtggcctttcaccggagcatggttgatctaccagtgactatactctaaaacaaaactgactcttcctctcccagcagctaccaaattgccaatagctactcatctagggatttgtctgacttgttcaggtcttttgtgtgctgtcacaactactatgacttcatatgtataactttccttctgtctcgagactaacaatgttttcttatcactattcactatctctggctctaaaaatatttctgccctttctgttacaatgatccctgagccctgggaggaaggtctgtgatgtatgtgtatcatacccattcatccctcccttcctgagcatcccacactctcttagtctctgcaccttgaccagttgtgggtctctgtgttaatcaccatctactaaaacttagaagcttctttgatgggtgtcaataggtgggttaatccgtgggcacattcacaatgcatcaggagtcagtttaataccaagtcaagttattctgtcctatgccttgatgtcccatgctcaatcctaatttaaccctccagcttccattattcccctttagccctttgtcacttccattgaaagctccctgccatggcttcttactaatttaccaaccactatggatattccaaatggaactcacatatctaaagatttagagctaacactcagaaatgagagaaagcatttaacatttatctttctggttctggggtatcttactcagaatgattgtttctagttccactcagttacctaggaatttcataattcctttttttcttttctcatttcttaagacagggtttctttgtgtagccttggctgtcctagaactcactatgtaaaccactggcctcaaacacacagagattcacctgcctctgcctcccaagtcctgggatgaaaagcatgtgccaccaccgcacaagcaccaattttatttttcttaacagccgaataatattccattgtgtaaaagtactacatgtttatccattcatcagtgatgggcatctaggctgcttccattttctggctattgtgaatagagtgtcaatgagcacggagcaacaggtacctctatagtaagatatagaatcctttgggtatagggctgagagtgataaagctggatcatgtggttgatctgtttctacatttttgaggaaccttcatactgatttccatagtggcctcaccaatgtgttctcccaccatcagtgaataagtgttctcctttccccacatctgtgccagcagataaggatgcagtttcatttttctatgtgtatctatccattttgactattctcttttctccagggttgctggcctctataaaaaagtcaggtacctataggagtgtaggtttatatgtagcttctcaattctagtccattgattagtgtgtctgtttttatactagtactgtgctgttttcattactatacttctgtagtatattgctgtttcttgaactgaagctcagtagtaaagttcttgcctagtatgtgctagttacagcattatagcacacatacaatctccctctccctccccctccctttccctctccttctctccctcccccctccccctaaaccaaccaaccaaaaatccattgcccttacagccagctgagggcttagaggttgttgaggtaaagtaagagagtatatatctcacttttacatctgagcttaggagtacctgggaactctaggatgctctgggtgtgcttcctgtcgttgctgtgagctgtgggagtactgtagtggttgggttatgcatgttgtgctgagcacactgcatactgataggatacatcatggtggctctgtggttctctctgggtctttgagggctgtgcacagttggcatgtggtacggggtgttagaagatttatgatgactgtgtgtgagagaaccagcagggactctggtagacctagagatagaaggagcagtgctggtagagagccttcatgggggtgtgggtgggtatatttgtgtcagcaaatgttttaaattaattatcaaccataagaaaaatagtctggagcaaaccaatttaggatctaggtgggtgggatggatggggaaataggaagtactgtggtttttagaaaggaggaagtgggccctactctagtagctcccttgagggcaggaacgagattttctgtctctgcacagggtctagcagctgcaaaatatagttcacttactaaactcaactgagggaaacccaagagttgagcagggctataaagggccactgagatctagtgaagatgtttatattttcccatgggtagaagggagttatggaaagttcctctggtaggttgtgtgatctgtctataagaagattccaccaagaaagagtaagccctggggcaaagggagtcactgaagataacaggagacactgggaagaagggatctacagaagtagaaggcagggctcttggatcttcccttcagtgggaccttatcatggccatctccagactcctgaactgaaaccctgctgtcctgtgggcagggttgtcggtatcctttttactagtcacaatttcttttttatgacactagtgtcctctcctgtctcttgtggctttcctttggaaagcagggttaggtttagtctacctgagagtcagctatttccttgttgtgtgattgtgggctagtcaccaagtctttctttgtcttcatctcttcacaagaaactggacagagaatccctgcccacctcatctgggactccagggtatccctgaatctcaacttcactcagtctgttctacaggactgcttataaggaggcagagactagagaggtagcctgtgcatctcctataggagggtcaggtggataaggagaatccagaatgggccagggcagagccttagagaatggtaggccacaccagtctgagaagcaggggaatagaaggacagaaacccaaccccctcacaagagccctgctgcctagctgttggcctggtggggaggatttacttagggcagcttacctgctttgaggtgttaagggctggaaagcagatagagagcccctgggaccatgatacctgtgtatgtctacgaagggtgcatggcagtgtgtttggccttgttcagcaactctttggccacaactttctctggctgtgtgtccttgcaactatgtctacacctgtaccaccctccaggtgattcatcctcctcaatcctatgcccagagaggacagggcagggccagccaagatgtgctgagctgggcaggataaacagctctactgggccagaggtgagaagaagaatactcttgctatgcaggctgggctctgcctgctcaggtaggaaggcacaggaggaaacgtcacccaaagccaggtacaaggtagaagaaacccactggggccaggatctagagcacatgttccctcaggctgggaaggctctgtatccaggataaggccaggagttcatggaagctgctatagaactgggttccctctacaactaggagaacccaaatcccctgcaactctttctgctggtgtcatctggtgagcaagggtatggatgtctctatatgtaaagacagcatatgacagcattgtttagagcaggaagagacatgtgtcctgttgttttgtatctgtgtttgtctatatccttgagctaagaccctcagataccatggttatgtttgttgcaagatcgtgatataatcaatcatgaaatgtgtctgatttgggtccatgtttctaggtatgtagtggcttatgactttacactgttttgctgttgtatgtgggttttttttccataacctggtataatggatcctgtgtggctgtgatctttatttgtaactatgcttgtaggcatttaaaggtattgttaatgatatatatgaaagtacatgatcctgtaatataaatggaaaaataccctttgtaactttgtgtgcttgaacaatatatggcggtatataaagttatattgtggtatgtgttatattgtggttaagtgattttgtgtaagaactaccatttatgttttttatgtctttatgattctgtttcatctttttcttttttctttctttcttttttttttttttttttttgagacagggtttctctttgtaacaaccctggctgtcttggaactcactctgtagaccaggctggcctcatactcatagagatctacctgcccctgtctcccaattaaaagtgtgcaccaccattgacccccccacacacttgaccttattatagatgatttcaatgctgtgtaatcatatgtggaattgtatctgctggtctgtgaacttgtatgtgcccaggctttcaggagagtgaagacatgtgcttggatgtttgaatttgtgtgacctggcagttgtgtgaagcgctataaattccatgtgctcttgtgtctttggggacccatttgtgactgtccacttaagagactgtgacataaagtaaaagccttgagatgagatgccacgtggctgtggcacatcatgctctccttgtagctgtgggacttgttatttgtttatttgtgttcagttgggtttttagtatatagcccaggctggccttgaactcattatccttctgcttcagcttcccaggtgctaggctcataggcccatactgtgcctggttggtgctctgggagttcttgactagtgctcgctccatcgtcctcaccttattacaagcacctctccctacacagtgcttttcatggcctctttcaccacagaaaagttgagcagcttgtattctgaatactggtggggagggtggggaggtgtgaggtggatgttgaaatagaggaaggtaaacaaattagtaagacactgggatttttttttatttaataaaatattttttattaggtattttcctcgtttacattttcaatgctatcccaaaggtcccccatacccacccccccaatcccctacccacccactgcccctttttggccctggtgttcccctgtactggggcatataaagtttgcaagtccaatgggcctctctttccagtgatggccaactaggccatcttttgatacatatgcagctaaagacaagagctcccgggtactggttagttcatattgttccacctatagggttgcagttccctttagctccttgggtaatttctctagctcctccataaggggccgtgtgacccatccaatagctgactgtgatcatccacttctgtgtttgctaggccccagcatagtctcacaagagagagctatatctgggtcctttcagcagaatcttgctagtgtatgcaatggtgtcagcatttggaagctgattatgggatggatccctgcatatggcagtcactagatggtccatcctttcgtcacagctccaaattttgtctctgtaactccttctatgggtgttttgttcccatttctaagaaagggtaaagtgtccacactttggtcttcgttcttcttgaatttcatgcgtttggcaacttgtatctgacactgggattttaaagagaaaaatgtttgcttataaaatatagttccaccagtgtgcaatgtgtgcacatagtgggactggaacctaggccttgcaaatgctaaacaagtgctccatcaccagctaactccctagttcctagtttcatcatttcttctaaagacacttagctgtacaaaattgtagataagaaagttcagatgttcttagggctttaagaaatgggataaagatgacagaaatggtagtttatgcctataatcctggcactgtgaaggctgaaacaagattgtcatgaatgtgagtctagcctatgctacacagtgagatcttgattcaggtatgtgcatgagctttaggatattcacgtctatcctcaacctagttgaaatccagagtttgctttaagtccttaattacttactgacaggcatgggatcaatatactaatcacagagaattataacttcgtgatgaaaatagccagtctccaccttgggcctggtttctgtctaaagcctggaagagaggcttcctggcaaaaccatgtggctagcacaggactcaaaggagcctagccctagataccagctaagatatgctacttcctattctcccttggggtaaaatcagtcagtcacttcatgtctagtctccctttctacaggactgcaccagggaaaccggatcctggttaaaagtttgtcccttgaccctggccagagccttgagcctcatccagaaggtccccaacggcttcgctcagatccaggccctcccactgaaatccctggcccacgtccttcaccactgaagcgggcaccgggcccaaagccacagggtaagtgcttccattaagagcagagaaatggaccagagaagtgtacaaaaggaaaggagaaattaatgcatggcagaagaatagggaagtgcccttatctcaaagggcactgagtgatacctatctaatgggcagaaaggtgttgtctgtggctaatatagtctactaagatttcacatcagtcagtcctgctctgtgctgccaacactcaggaggttgagacagggtggttgctgtgactttaaggtcagtcagggctagctatggtattgtgaaattaggtatagcctggtcatagtcacctcgaaatccagttcagtgatatctctcctctcttctccatccatcactccagttcccccaaagcccagctacctgcagatgccccgggtgcttcctcctcctgagcccattcctccaccaccatcacgccctctgcctgcagaccctagagtggccaagggactcgtccccagagctgaggccagcactagttctgcagcagtatcatcattgattgagaagtttgaaaggtgagtcttgtccccataggaccctgtgagggaagggtggatctgggacaggaagggttcttgtagaagaggcctcttggtcatgctcacaccctgcctccatgtctgtccatcacccacctcagagagcctgtgattgttgcctcggataggccagcccctggcccctgcccagttcccccagagccagccatgttgccacagccacccccgcagccaacagggtcccagctccctgagggtgaagcttctcgctgcctgttcctgctggctcctgggccccgggatggtgagaaggtgcctaaccgggacagcggcattgacagcatcagctcgccatccaacagtgaagagacctgcttcgtcagtgatgatgggccccccatccacagcctctgtcctgggccccccgccctggctagtatgccagtagctttggccgacccccaccggcctggctcccaggaggttgacagtgacctggaagaggaagaggaagaagaagaggaggaaaaggaaagagaaattccagtgcccccgatggagagacaggagtctgtggaggtactgacttatgcgttacccaagaggcaggaccatgcagagaaaggaggagcttggcttttcccagcttggtatttctcaaaacaggccattgcttccacttagtcgatttagcacctagtatggagcccaagtagcaaaactctgctcctctcccaaatgactgtgaacaccaaaatggccattcctcattctaaatgccggttaggaaggtggctccactttcttcagagaaccactaatgaacctcagtcttttcacgacccagtagctgtgtgacactgaggatgtctcttccctttccacttctcactacaagcctcagtttccttgtttgtatgccagaaactcttacatgccagagatacttctcagcaactagaggaggggctcagagccagagccccaaaggagcctgactgaagctttaggttgggaactctttccatgtgttgtctagctgatgtttcttcagaaggaatccttgcactcacgtaaggtctcagccaggagacctgctttcccagaactaagcacagctgtggggactggggccaggagtaccgagatgaaatgatactcagcaagtgtgtagcctgcaaacaagaaagtgagccagcaggcataatcttagacagttttgtacttctgtgcctttctcacagcccacgtactcagcaagcctttgctgacagcgagctgaatgagtgactgagtagctggtatttagacactgtaatccgcagtctgttctgtttttatttataggaaatcttttagggatgggagtgtaggaaaatgtagagcatttgcctagcatacatgaacccccaagtttaatccccaacattgcaaaaattaaaaaacaaaattatatgaattatttgtctttataatggggactcttaaatacagaaataattcggcaacttacacatgctagtgaatggtaggtatactaggatttgaatccagaagttggacttcctacttcccatgtttagccaccaaaccatgctcaatgagtagagaaagtagaccaatgggtgtatgactgcccgtatgaggaagtttgtatattcagcattgagggacaaactttatgaaggatgcaactacaggaatccttcatgagtgatacttgtgctttatgaatcagatcagagttatctcagggaggaactaaggttagagcatcgtgtgcacttagaggagtcaggcatggtgacattgcctggagtccagccactgggaaactgatgtaggagtatcaatgacttcagtccaagtgtttgagggcactctgagaaacatagcaatacccgataaatgagagggtggggaagggaaggagagagaaaaatgtacagaaggagctggggttaaggtagagatgatgtatcaacggtcacttcttctttacagctgactgtgcagcagaaggtgttccatattgccaatgagctcctgcaaactgagaaggcctatgtttccaggctccatctcctggatcaggtgaatggcccctctggggtcccaggaccctaggatgtggtaggtaggttccatagaggaaatgaggccctaagcctaactccaccgttaggaccagaatccagaagtggtaaggtctctggctgaccttgaagccagttgtgataatgttcacaaggtcaatcgtcattcctaactcttaacagacatgaatcaaccctgtgactctgacacttctgactcttcccctcatctttaatgtatccatcttcatggacctcattctaaccttgacttttttcttcactctgcatccattagaatccctgagggtagggttctttatttgtctttcattgttccatcctagcctccaggacagtgctttatacactagacacactcataaacatttgttacaataaagggatctaattccagccttctctctaaacctgaatctctttctgaccttgctccaatcctaacttgccatcatcccagttcctaactccaggtcctaatcttggtgacgtgcaattctctaaattcccactctccttggtctcaagaccagtactaatctcagaggttcacagagctgcccacaaataaatgcctttacctgcaagctgccctttccccagctaagctctcatttcaattgggctgagcactcgtgccttgctccaccaggtattctgtgcccggctgctggaagaagctcggaaccgcagttccttccccgcagatgttgtccacggcatcttctctaacatctgctccatctattgcttccaccagcagttcctgctgcctgagctagagaagcgcatggaggaatggtgaggggcctcagagccagtctgcctcttctggcatcaatttacatgctaagcccagatgtattcagagagattcattcctgggctgaagatgttgagatgtagctcagtgacagaattcttgccaagaatatgcaaggccctggattccatccccggcttcataaaaataagttcaatcttacctaccttcttctcttctgaataaacaaaaccaaccaaccaaacaaacccaaaaaaccaaaaccgcccaacctctgccttcttggccctcccaatctaatatggaacacaaatgaaggcctagaatgctacagcagaatagcagaacccttgagagtatgcgaaagctcatgagatagctcagttggtagaggtgcttgctggcaacctgaattcaagccctggaacccatataaaaatggaagaaaagaaatggctctataaagttgttctttctcttgccctacgacaccaccaccaccaccaccaccaaacttaagacaaaagaaagtattgagatttagctgttccagttggatgcctataattccatcattagggactctgtggcagatcaatgaatttgaggccagcctagactgacatagtgagactcttgtcttattttttaaaaaagctaggtggtggtggctcaggcctttaatcccactacttgggaggcagaagcaagaggatctctaagtttgaggctagcctggtctacagagtgagttccaggacagccaggatacacagagagaccctgtgttaaaaatcagatcccccccccccaaataaataaaaagaataagtttaaaagctaaaatgagccaggtgtgatggcacacacctttagtcccagcacttgggaggcagaggcagaggcagatagatctctgagttcaaggctagcctggtctatagagtgaattctaacacagccagggctacacagagaaactctgcctcaaacaaacaaaagaaaaagctaaaatgattaggttcaaattctgcttctgctacttggctaaatttaaggaaatttcttaccatgctgttccttggctttatttacatcttggttcatgtgtgtatttttgtttgtttttttgtcatgttaaggattaagcctaaggcctaatcctagacaaatgctataccactgagctatactcaaaccttccttgtctttaaaatgaagacaataataagggcctaccttgtaaagttattctaataattaaatgtgttaatacatgttcagagcttaaaacagtttctagcatataagaatttgaagcttgggctggtgagatggctcagtgggtaagagcacccgactactcttccgaaggtccagagttcaaattccagcaaccacatggtggctcacaaccatccgtaacaagatctgactccctcttctggtgtgtctgaagacagctacagtgtacttacatataataaataaatcttaaaaaaaaaaaaaaaaaaaaaaaaagaatttgaagcttatgaactgctgttttgttttgagacagagtctcactctgtagaccaggctggcctagatcttacaaagtaccacttaccgctgtctcccaagtactaggattaaagacgtgcactataaatgtggtagtgctaagaatgggagactggagatgcagacaaatggaccaagtctagcctaggagtaaagaagaatgatttgaggagaagcaaatgcctgaggtaggagggcagggtttataggggctgactctggccttcaggttctcttcttctaatagagcctagagcgtcgtctacaccacctgtttaaatagtctacccaaataactaccaggccatggcattacctgcttaaaattgtcccaatgttccctacattcacaggataaagtatgcctcttttacaaaactatgactgcagagggctagcataaagcccagttcctacatctcctttaccatcctgtgacctgaagtctgctttgtctctcacatcacactgtagacagtgagcgttcagcaagacttggttacttttcctaccctccaagatggtaaagctcacaggaattgactgagtatggctcagtactgtatctctggcactacccaacaaaggctaggcaagaatcaatgatcagtgtgtgaatagcctttacggtatggcaagagcggctgttccaggatggtaatgtttctggtacttaagcaggacagagttaggctagggtttcacagcctcaaactgagtccctcagcctaattggcctatagcataagaagcatttcctaaaaaggaaaccagttgaaaaatggctttcttcctgaggctggagaccatgtcagcccctgcttctactctagggaccgctacccacgcattggtgacattcttcagaagttggcacccttcctcaagatgtatggcgagtatgtgaaaaacttcgaccgggcggtagagctggtcaacacatggacagagcggtctacccagtttaaagtcatcatccatgaagtacaggtaagaagtgaaactggatgaaccatgctacaggaggaggaaaagtctacaaggacctgggggaggcctttaggtagacctgagcttttctgcttctgtcacagaaggaggaagcctgtggcaacctgaccttgcagcaccacatgctggagcccgtgcagcgtatcccccgctatgaacttcttctcaaggactatctgttaaagctgcctcatggctccccggacagcaaggatgcccagagtgagtgtgtgcccctaggccctcccaacttccccgcactggtacctctagccagacttctgagtcagggttctagatttcactcacagggttggtctgctaatgttgaatgattaaaatctccaaataggatctctaaactgaagggcctatattgaggctctgtgttgagattttaggatgaacctccaagttcattactctgcattcatgacccagaaagaacccagttaggaactttggactggaactgtacagtctaagaggtatgcttagtctgattgtctttaggaaaccatgcttttattaggctgaacccaagattcatctctcagtgaagttgggaatgaaagaacgcctaaccctccagagcctagcttgaatccttcaggccacgcccattttattaattctccatgggtgagctcctaagtcaaagccccatatagtcagacttctactttcccaccctctagaattagagctctactccaggtctattggctactcccaagaatgagcctctctaaagaatttcaagtgtgatcagacttgttcccgtattttatgcctctcaggtttggatctataggctgagatacctcctcctcggactgattcttcatttactgaatcactagaaaagtagttggtttagattccttccatatttacctcatctgtatcaggccaggcctcgggtgcagctcttgagtctagcccacttgctcttccttgaactcatattgtcatttattcatcgctaacataacaggcaagtgcttgtgcattgttctaggcaccgggaatagggaactgagcaaaatagatgaggtccttgactcagggagtgtgtgttctagttggagagagcctataaacaagtgtgataaatccacaggaacatatttgcaggatgctaaaagtgtgacttggagacgtaggggagtgatgtaagggtgactggatagtctactttcagccagtgacttctatgcagggaagatggctaaaccaaaacctgaataacaagaaagttgccacaggcaaatgggaggggaaggctctaggcagctacagttgtaaatgtagagtccccaaagcagggggagatgggcaagctgatagaggtagatgtatgtctgtgacagcaagaaggccagtatgacctgagttaagggagggcagaatgatagaaaagagggttggaggagcaaagctttggaggccaagatgaggtttattttgagtgtagtggatagtcacgggaaggtcgtggttaggattggctgaagatatgagaaggagtcagaaaatctgggggaaggtggggtcgttttggtaaatgcagtaaagtgtcaaaaaggtggcttggataaagatggtaggagcagaggagatgagaaaatggttccattccggatagattctgtttgaaagtagcactaggataccacggatgctgagattgggagagtcaagaatgatggttcttggggctagagagatagctctgtggttaggagcacatactggctaggctgtggtggcacatgcctttagtcccagcacttgggaggcagaggcaggcggatttctgagtttgaggccagcctggtctacaaagtgagttccaggacatccagggctacacagagagaccctgtctcagaaaaaaaaaaaaaaagagcacatactgttcttccagagaaccccaagttctgttgctagcactcacatccagacagctcacatctccctgttgtactccagagggaccagatgctgtcttctgggatccttgggcacaacagagctgccactttagctacttagatgaggctagaattccagggaggaatttaagtaccactggtgcacagtttagtatttaaagccgtggagcaagtggcatttagcaaagggagtgaatctaaacggaaaggaaaccagaaggacgcagtgaaagcttaagacagtgaggtcagcaaaggagatgaagcagcagcccaaaagggggaggaacagagaaagtgtacaagacacaggagtggggagcaaacacttgtatactgtgctgtacctaagggcactttgctccccagcctggactttgaaaagagctaaacattccaggaaatttggtgacttaagttctgcctagaaacaggtacatattaaataccatgttcctctcccaaatgagagccccactgaggggccagactaaagcataaaacttaaatctgaagaaagtgccacgtactgtgtctgtaattttaattaatctggaggccaaggcaggaagatcggctacctgggctacaagtcaaatccaaggccatcctgggcaaattaataaggaaaaaagcaggggtaggcatgttagtgggagagtacttgcttagtatgtgtgaggccccaggttaaatctctagtactttaagtaaaacaatcctaaacccagctgggcgtggtgacacacatctttgatcccagcatttgggaggcagaggcaggtggagattgttgtgttggggctagcctgatccacatagcaagttctaggatagctagggctatatagagaagccctgtgttagaaaacacaaaataggggctggagtaatggctcagcggttaagagcaccgactgctcttccaaaggtcctgagttcaattcccagcaaccacatggtggctcacaaccatctgtaacaatatctgactccatctcctggagtgtctgaagacagctacagcgtaactcatatataataaataaataaatcttaaaaaaaaaagaaaacacaaaataagaaagataaaaaacgccaggcagtggtgacgcatgcctttaatctcagcacttgggaggcagaggcaggtggatttctgagttcaaggccagcctgatctacaaagtgagttctaggacagccagggctatacagagaaaccctgtctcgaaaaaaaaaaaaaaaaaaaaaaaaaaaaaaaaaaaaaagaaagaaaggaaggaaggaagaaagaaagaaagaaaaaaaaaacccaaaaccaaaacaagcaatacagcataaaaccatgtgtgttttccagaaagctgcccaacttcaggctcggttttcttataagcttactaggaatgataatgtctacttcatagaattgttttgaggctaaatgagataatctagttaaaacttttagcagagtacctggcatttgactcaataaacattagctatttttgatgactaaatgttctgggtaatgtcatccatactgagttagccagcaggttgagtttattaacttcagtttcctgttttgtactagcctcaaccatatccaagtctctagaacagatctcagcattccatttattgactctaaaggggactactcccacccacacaaataaacttcgtaggatggtttcctacctcagtctttgactgaggacctcgaatgagagccggctaagatctgcccattgagctacccagctcaagatccgatgcggagatccctatattttatgactcaaagtaaaatccttaagccgagccccactgaatcatctttctggttctgctgactgactcacctacagactaagctccaaagcctggactcagtccacaaactgccttcttgggactgctgcctgcagctacctatctacacttagcccaaggctgaagtctagactgagactccaggctgccaaggccagcttaggccccactaaagcttctaacttaaggctatcatccccacaacaaactctcaacatagcctgggattcccagaaatgtccatctgtttcctgcatggtacatcactagacaggtcctgacagcaaacacagcttccagtctgagcccagccatgtatgcaggcctaagttatgtacccccaactcaccagttttcttgcccctttggactctactggggtgtgaaagatgcagcatccataggagaaaaagcaatgccaccttctaggtagataaccacctgagtctttggcttggttttgttttgttgttgttgttgttgttgttttttggttttacaggacagggtttctctctgtattcctagctgtcttaaactagctctgtagagcaggctggtctcgaagtcagagcactgcctgtctctgcttcctgagtgctgggattaaagacgtgacaccaccacttggcaagtcttagcttttaactctgataaacttgtcttctgaggttctgaattagagaggctaatttatactaagcatctgtttgggatccctgaggaaggtagtgggaactgagccccttcctcggagactccatgtgtactgagggattcagatacagtgagtgaagagcatgcagtatgactagtgaggcagaaggagcaaggacagtgtcctaactcatccttggagcttagggaaggcttctagacatgttaagctgaatccagaagactggatggcagttggccaaatgaagcaagacaggacatgtttagggaggtgcatatggaggaagccacagcggtcaattggagcccgtcaccaagggctttgaatgctagacaaaagagctgggtctttgatgtgctggcagagtgaaacattgacagatttaaacagaggggaaacagtaagctgtgtgcaagaaagctccttctggctgccagggctgaaggggagttggagaaaggcccagcacctgaaaggcatatggagacctgagctggagcagtagccacggatcctctttagtcccagaatgtgctcgtcttaggaaacagggcctcctttgccatccatgtggacatgtgattctccagtacaggcataagttctgaggagggaatctactgtgtcaagtgggaaccatgaagctgcagctggactggaggcagaagcagggatggtttaacatgtgaacttttatggagacttacttcattttttttccattatgacacctggtcactgtaggaagtgtgggaatgacagaaaagaagacagaagtgggagtaagaaaccccacctgtgacctgagccccatgataaatgtttaagcatacgttttttagatgtgtgtgttagcaagaattagatcattgtatatattcaaatttgtatccttttcctaagacactctgaacatttcccatattatcaaaaaccctaaataagtatcattgttaaagattgatatttttattatatgtgtgtgctgtaaattctgtaactgagctcctatggttgaacatttgttttaggtttgacagtgctataaaaaaacactgcaaggaaagtgtatttgtgcatagaacaagtgtgtatagtcagaactaggaagacaaacaatagtgttttttccttcttcccttcctggtgtactagaattgaatgcaaggcctctaacataaaacacaagtgctctaccaccaagccacatttccacaattcctctttgttttgctactgcagctaccactgccttatctttatcatcatcgtcttcattttcttatgtgtgtgcatttgcgatagggtcttacatatcataggctgacctcgaactggctgtgtacctaagaatgaccttgaatttctgatcctaccatctctacctcttgagagctggggttataggcatgcatcaccacacccagtttctgtggtgctagggatggaccccagggccttacacatgttagacggacatttcaccagctgagcatccccagtcctctttactttttttaatatttatttattatatgtaagtgcactatagctgtcttcagacactccagaaaagggcatcagatctcattacggatggttgtgagccaccatgtggttgctgggatttgaactcatgaccttcagaagagcagtcggtgctcttacccgctgagccatctcactagcccctctttacttttaatcttttgttgctgctgctgttcattagatttgagcccagaattttgagatcacccaggggaatatagaaagattctgtctctaaaacaaaacaacaacaaaaacaacaacaaaataaacctatccatagtcccactagccagaaacaactgtctaaacatgaccatgtttcctgccagttaattatcataatcattttaccaagcttacattttattggctatcccatatttctgctactgtgttgttaatccaggcagtttctgatttgaaatgatgtggtcatgaacatcttttgaggctggcatctgctgggaggtggagagtgtagttaggccaaaaggatactcatggagtagagatgtcctgcagagcttcctttctgtttgactcccatctgatcttacttctctgtgccatagagtctttggagctgatagccacagcagcagaacactctaatgctgccatccggaaaatggtaagtggcccttctagtcctgtccttccttggccatccctctgtgtgtgtgtgtggtggtggtggtggggacttgtgacttgaggacatttaaggggaggtattgtccaccccaatctttacctttcactccctgccaggaacgaatgcacaagctgctgaaggtgtatgagctgctagggggtgaggaggacattgtcagtcccaccaaagagctcataaaggaaggccatatccttaagctgtcagcaaagaatgggaccactcaagatcgatacctcatattagtaagtgccaggtgtgcttatgggtgggcatgccctcgggacatagataacctggcagtcattcgagagtagacctctagccagctgtcctttcctccagcattcattgtatttgcactatgttagctagaaataatttttgcttttgtacattatgtaactacaattatgtatgagatatgagttggctaaggttactaactaggaagtgactcccatgacatttccttatcatgtccttgctctttcctcattgctgaatccagtttgaaatagctttgtgtgtgtgtgtgtgtatgtgtttgagagagagagagagagagagagagagagattttttgcgtagccttggctgtcctggaactcactctgtagaccagactggcctcaaactcagagatgtgcctgcctctgccacccgagtgctggcattaaagccttgtgctaccactgctgacaatttgatgtatctttcatccatttattgccttgcatccttagcagtagtatgagggtgaggagactcaccatctacactaagcctctgtacacgcatctcaaatcttcttcctagttcaacgaccgcctcctttactgcgtgcccaggctgcggctccttggtcagaagtttagcgtgcgggcacgcattgatgtagatggcatggaggtaagcaccctgagaattggagatgtggagtggggcattggtattgggaggaaattgcctactctgtccccagtctatgtatacatatgtgtaggaccctatagagtgtataggcctcaccatgatccttcccttctccttttagctaaaggagagctccaacctcaacatgcctcggaccttcctggtgtcaggaaagcagcgctctctcgaactgcaggccaggtacctgtccttgcctatgcgttccctccaattcactctttttgtttgtttgtttgtttgtttgttttttgagacagggtttctctgtatagctctggctatcctggaactcactctgtagaccagactagcctcaaactcagaaattcacctgcctctgcctcccaagcgctgggattaaaggtgtgcaccaccaccgcccagcccaactcattctttacttcagatatgctgaggcattccaggccagagaaagagtgaacacctttccccaaaagatatggccttgctcctcagctatgtgtgtgtgtgggtgattctgatgatgacacatgtatatacatggtatgggaaaaggtggtatgtcagtcacaaaagcattttggagaatgaacaaactccagaatgcagggaagagtgggttacttaccactatcatgaataacatcaccaatgcctaccaccacacatggctaccatcagtccattttaaagctgaagaaattgaggcacctttcctagatccagccagcaggattagagctgaaattggagcttaggcttcgtcagcttggcacatgggttcctgaccactgtccatactactttctgagactccaagtaaaggtgtctaacaaggtcctgatcagggcctcaaagtactgagtgcacatcagtacatatccttttctgataggctacttggaagtgagaggtgactgatgatttcatggaggcagaagggagaagagataagcaacctagtagttgggccgggcagttatggcacatgcctttaatcccttgggaggcaggagcaggaagatctctctgagtttgaagccagcctggtctacagagtgagttccaagataaataaagctacacagagaaaccctgcctcaaaaaacaaagcaaaacaataacaccaagcctagtggttgggctttgaagttctgggagaccaagagaacctccctgaggcctgcactgatacaagcagcaggaaggaacaataggcccagcaagacagaaaacaggaccatctaggaaagacacaagccataaagacatggcatctgcttagagatgggggttatcagaagagtgctgggtacagagggccctccaggcagtgtttgatttcttcctagtctcaataggatggcatggagagatgactttgtaatcagatttattgtctgtaattagctcaggttggacttgaactcaaaataatcctcttggcttaagtctccctagtgttaactttttatttaaatgtttattttgaatattttaaaattatgtgtatgcatgtatctgtgcaggggtatatgcatatgacaggtgactttggagtctgtaagaagcaacaggcccattggagctagaattacaactgcaggacatgggttgtgagaactgaccttgagtcctctacatgagccatctccagccaattacattttttttcttgaggcagggtcttactatgaagccctggcaggcctataacttgcttatgcagaacaggctagcctcaaactcacagagaaccacttgccttttgcctccagagtgctgggattaaaggcacgtactaccacacctgactccactagttattttttaaattaattggttatttattaaaaaattttgaatgtttatgggtgtcttgcttgcatgcatgtctggcaatatgtacatacaaggattccagaagatggtatcaggtactctggaactagagttggatatggttgtgaagtgggtgcaaagaattgaatcaggatcttctagaagaatagcaagtgttcttaactgctgagtgagctctagcctcttaaaaatcttttaatgaaaaatttctggtgtgttgggtttctgcctgtaatcccaccatttgagaggcccaggcagggagattgccagaaaattcaaggcaagcctgagatagaacatgagaccttgtctgaacaaggttaattttaaatatacaagaaacaaaacaaaaccaaacccaaacagtataagcatccataatcttaaatatagcttagctggttcttatcttggcaatttatggaatcagctgagaactttaaaaaaatcccgatgcctgggcttcatccccaaagattccgatttaattggcctgcaagtattgccaaccaagctcctcaggtgattggatatacaccaggactttgagccagtgattaagagccaatactacagatagaagcagagaactcgcctaccatccagaagacttgggtcccatctccagaacttctctttttccacacacaagacacctattgacattttttggtttggtttgtgacattttcccccaagccatccttggaactcctgagttcaaatggtcctcctgacttactctcatgagtaagtgggactaacaaatatgaatttcatccttatataccttttgaatggccacaaattccaccataattcttaaaagtccagagtaacacttgttcacagccaagaaatgaaaagttgaaaaatataaataattttttatgactatattcagaacaaacctcatctcgttgctgggcttatagatatttgccacaatttctagcttccgtgtgggtcttagggtctgagctcaggtcttcatgcttacatagcaagtgttttaatcactgtgccatttcctagtacctgctgccacattttttatgaaccttttccaaagtacagaaaactagaaagaattacagtgagcactaatgaaccaccatctagaatatacaagggttaacgtgctgctgtgtttagcttatcacatgtctatgcttttagccacccaccaatccagtggctttaccctttttattggtatatgtccattgttcataatgataggttgttcatttgtttttgtttttcaagacaggatttctctgtgtagctctggctggcctggaactcactttgtagagactatgctggccttgaactcagtgatccccctgcctctgactcttgagtcctgggattaaaggtgtgtgccaccacacctggcaagacatttttcatacaagtatgtatatcctgtactttgaccatactttctatctataactccctttgcttcttccccctaacagtcttgcttctactttggtgacatatataaaaatgattttgtatatatatatatgtgtgtgtgtgtgtgtgtgtgtgtgtgtgtgtgtgtgtgtgtgtgtaatctagactccagaaatgatatcaaacacataatacatgtttttcttcatctggcttatttcacttaatataatcatctgtagttgcatccattttctggcaaatgacattttattctttatgggttcgtgaaaaactccataattcacacatacattcacattcatactcagacacattttatctaattgccagttgagaacccagggctgattacataatggctattgtgactagtgttgcattaaagatagatgggcatgtaatttctgtggtatgctgactaatctttcatacacacacacacacacacacacacacacacacacacacctaggagctgggtcaatatttgaattatcttcatgcttgatttcagcatatattacagagccataataattaagtaacatggtgctggcacagaaacagacatgtagattgatgggatatatagggcctagaaataaacacacacataaacacacacacacacatacacacacagccatagccaactaatttgtttagttttgagggttttgagatggagtcttatgtagccctggacagccttgaactcctgatcctgtctctacttcctaactgccaggtttacagatatgtcaccatgctttacttagccacttgatttttgacaaagatgttaaaatcatacattgtagaacagacagcttctttagcagatggtgccaagaaaactgaatatccaatgactttatgtatatgagtgtgtatctgtgtatgggtttgcacactgcaagtgcagtttcctgcagaaatcagaggcattggatcgcattggaattggaggtttgaggtacacagtgtgggtattaggaagtgaactctgcaaggttacatgtcctttaccactgaggcttttcagtgacttctaaatacattgcaaaataagtaaagccttaccatacataaccctcccttagagtctggcattagtagaaaatcattacctagagtttagtacttgtttcagtcactgccaaacccttctcttggcacagtcggcatagtgaaatgcataggtcttaggtataccacaggtgaggtttgacaaacatttgattacaatgaacatgcattaattagtgcatgtgcatgttgctgcaagtactggagaaggactttgtatgctaggtaagcattcagtcactaacttgcatccccacatccctaaatagtggctcaacatcataacttgtttcacattcttacttttcacatagtggtcctaatgatgcagtcagaattcatattagaaaaatacatttgaatcttagaatgtagatgtagaaggaaaatgagagtctagatgggagatagcaaagttaggggtcctatttctaggggtggttgacaagtttgcaccagggcagagggcttggagaacacaaggtttctagaggggctggagagatggctcagaggttaagagcactgactgctcatccaaaggtcctgagttcaaatcccagcaaccacatggtagctcacaaccatttgcaatgagatctgatgctctctgaaaatagctacagtgtacttgtatataataaatgttttactaaaagggttctagaagggttctctagaagaagcaaagaagaacaaaaggaagttagagcaggagttatagcagacaacatgctgggcacattacataatcatcagtgttgcttagaacacaggtaagcccatcttcatgaaataaaaaaaaatactgcctccttttgcaaagttgacaggttagcagttggatatagtttcatgtatgttccatactcttagacacacttcacctttatccttcttaggcctagcacctccctctggaaacctttcttaaaagtcccactcaaacataggctgaggcaggcccccttctctggactcctcagtcttcattccctctagagccagcactgattctctcatactgtccctgtcagtctcctatagtgcatcatgagctccttgatctggaagacattgaataagctcaggttatgtgacttgttcaaggctacataaagtgaaaaagtgtagtgacgcctaggccctgtaactcttaaaataccattcagattgtgttttattggcctgcctaactcaacacctttcttttctcccctgcaaggactgaggaggagaagaaagactgggtccaggtaacacccaaggctttgtggtaggggtctggaagggtcttaacaggtttcttaggggctgataatagataaaataagcagaacaggctcgggacatcagctttgtacagatgctattatcaccctcttacagataagcaagctgaagtcctgagattagatagaaacattcttttaggaagtcagttcctctgaaccaagctttgtaaaagcttgcacgcagccagcagcaggagggccttctgagattttccatccaccactcccctttcccacatttgatagttacaccagtcatagacctggatttagggagggattttcccagtcatgtgtagcagggacagacctgggtctagaactccaggctaaggcataggaaggtgtggtgagggcagagataggttgtcgtggagtgatctgacctctcatttctcacacctcttcgccaggccatcaattccaccctcctgaagcatgaacagaccctggagactttcaaactgttgaactcaacaaacagggatgatgaagatactccccctaactctccagtaagagtcctactttcctcagtactgggatctccttgaagctccatgttcccacctttttcttgagatgatcttttccttttccaagaatagggacctgagaggcagtgcagacaagcccccagaagccagcttctgctagtagggctacagattgcaccccagaaagtgaagtgacttacctccaataatagtatgctctccccaaccccatgatgatttaagtggcaaagcagaggcaaggtgggctggctggactggactgaggagctatctctaacctgggccctaaccctccccctagaacgtggatcttgggaagagggcacctacgcctatccgggaaaaggaagtcaccatgtgcatgcgctgccaggagcccttcaattccatcaccaaacgcaggcaccactgcaaggcctgtgggcatgtgagtgttgggaggcaggggcagagctaaggtggggacaggctgacagcctaaaggcccacttctgatggggtaccctccaagaaggaggaggctgcaagttggctgtggtagttgatacactgaagagaagccaaaggcaattaagctgttcgtgcccacttgctgccccaggtggtttgtgggaaatgctctgagttccgagcccgactcatctatgacaacaatcgttccaaccgtgtgtgcactgattgctatgtggccttgcatggagcacctgggagcagtccagcctgtagccagcatacaccccagcgcaggaggtccatcctagaggtaagaactggctgggttcctaaccacaagcctcaaagtatgccatagttactgacccagggtaagcactcattaatcaggtaatccagacttgaaacaaggaaaatgagtgtacgggttaaaaggatactttttattacagaactttacacacttaactcttacagtaactgctcaactcttacccttagtttacatag

SEQ ID NO: 109 - DNA, 40294 bp, mus musculus; identical to SEQ ID NO: 108

SEQ ID NO: 110 - DNA, 915 bp, mus musculus
atggctagctatctggtactcaacaacggcaccaagatgcccactctgggcctgggcacctggaattcccctcctggcccagtgactgaggttgtgaaggttgctattgacatggggtacggccacattgactgtgcccaggtgcaccagaatgagaaggaggtgggagtggccctctaggagaagttcaaggagcaggtggtgaagcaccaggatgtcttcatggtcagcaagctgtagtgcacgttccacgacaagagcatggtgaaaggagcctgccagaagacactgagcaagctgcagctggactagatggatctgcctaattcactggccaatgggcttcaagcctgggcccgactatttcccactggatgcatcaggaaaagtgattcctagtgacaccgattttgtggacacttggacggctttggaacaactagtggatgaaggtttggtaaatgcaattggtgtctccaacttcaacccttttcagattgagaggatcttgaacaaacctggcttaaaatataaccctgcagttaaccaggtcgagtgtcacccatacctaactcaggagaagcaaaggcatctaggtgactgcatgcagtcctcttggttctcctgacaggccctgggccaatcctgaagacccttctctcctggaggatcccagaatcaaggcaattgcagccaagtacaataaaactaggtgctgatctggttccccattcaaaagagcttggatagtgatccccaagtctgtgacaccagctcgtattgctgagaactttaaggtttgagctgagcagcaaggacatgaccattctactcagctgcaacaggaactggagggtgtgcaccttggtgagctgtgccaaacacaaggatgaccccttccatgcagaagtctga

SEQ ID NO: 111 - DNA, 915 bp, mus musculus; identical to SEQ ID NO: 110

SEQ ID NO: 112 - DNA, 60411 bp, mus musculus
cctggcggtggcggtggcggtggtggtggcggcggcggcggcggcggcggtagccttagctcctgcgccccgtgccgccggccccagcgctgtctcccgggccccctagggcccccgggcccccgagcccggtgcgcgccctcgcgtcccgccggccccctcccccggctgggcccgggggagggtggcgccgtgagcgagcggggactgggctctcctgcccgttcccctgtccctgggccgccaggatggaggcggggtccggtcctccgggtggcccgggatctgagagccccaaccgggcggtggagtacctgctggagctgaacaacatcatcgagagtcagcagcagctgttggagacccagcggcggcgcatagaagagctggagggccagttggaccagctcacccaggagaaccgcgacctgcgggaggagagccagctgcaccgtggggaactgcaccgggacccccttggcgcacgggatagtcctggccgcgaaagccagtaccagaacctgcgtgagacccagttccaccaccgcgagctgcgggagagccagttccaccaggcgtcccgggacgtgggctacccgaaccgggatggcgcttaccagaaccgggaagctatctatcgggataaggagcgagaagcctcctatcaacttcaggacactaccggttacacagcccgcgagcgcgacgtggcccaatgccacctgcaccatgagaacccagccctgggtcgcgagcgtggcgggagggaggctgggccagcgcacccgggccgcgagaaggaagccggctattccgcggcggtgggcgtggggcagcggccaccgcgggagcggggccagttgagtcgtggcgcatccagaagctccagtcctggcgctggcggaggtcacagcaccagtaccagcaccagcccggctacaaccctccagagaaagtaaggaatgtgtttgcggcccccaccccacccattcctttccctctagatccctctccaacttagctggcagataaagtatatgaagcccatgcctgatcccatttcctgcttcgcctgtcccaatcgggagaaggttctcctcaaccggctgacatgctttccctagccaccacacattggtttggtcagacgagtgcgggcttcttttccctgtagaaccaaagccagttagagactaaagcaattcccactacctccctccacttcttcagcccctagctgtatcctttccagaggatggattaaataatttttagacagaggtggtatcaactcaagccccctaaagagagaaacactcctacacaccttttttttttgggggggggtgatctcgtctcgaggcaggtggggaccagaatggaactgcagcacatcttggcatggggagggggggtgatggtggcaaagatgggggagcaaagatggaggctaggcccttggttagtttctcaaagtccagctggtctccacccttcaagaaaaacaacacccatttaaagagccctaccaggaagggaagtccatagatctcccatctgttggatcagcttcagacctgtgctggggtttgtacatgtgtctgagacaggttaggaatattttctgagttgatgggacatggacaggatctacttttcctatgtagatcccattgtgtgctgattgggataaatgtattaggctgtgagtcaagggcacgaaggctcacagggatgccctaaaggccctcctattgctttactgctatactgaaaagaacattgaattgggagatgggagaactggcgtccccttccagctctgttgcagattggctttgtgaccttgactgagtcccttcttttgccagtctatgatttcccctagatattttttttaaagccagggactgccaactgagattcaatgggtatgttactaacccaaccacaccaaagagcaagtctgaagtcctttagcaaatggacaggcttccccctcctctcactgctcagctggtcctaccatgtgccacaactagtggagtgtctcttggaggctgggctgggggtggggaagccttctgcctcaggaaatctgccgggagacagctctctgcaactcccccatggtgaggcagcaggctggggtgctgggttgagatggctgggccccaggagcagcagctgcagcttgagggcttggctgggctccactgcagtgcaccctcagctgagtgttgaggtagaaggacagccccagaatggggggcagagaaagactggatggggcattgtggtccttgagcctggttgcagacttctctagaggggtcaggcctgtgatggagggagcaacctcaatatgtatggctccagggggcagatccaggaacagagggaacatctgagataaaatcaagagaacttttcaacctagccagttgtgatgcagtacattgcctcaagggatgggggtggtggctggcctgagtggtccagttgaagtctaaagggggtctgagagagctggaggaagcatatagttcctgatttgagcattaagcccaatgaaaagacctgaatctttctcaatttccgaattccattgctctcagattctctaccctgcagacatcaggtctgattttcttggctggctggaagcccatttgcccttctgccatccttgcgggcctgcttctgactccttccttctttttgtacactttccaggttgcttgttggaatcccttgcatcacatttcctactggctaataaagaggtttaaataacactttgggtttctctcaaccacatattaactgcttgcctatctatgattgcttcctttggacttcacagcccagcccactcagtgagcatcagcaactccattttagagagggagaaactgaggcttcaagatgaaggggccttattcaaggttatgctactatttgctaatggagctgcgactagaatctaagtctgcctgtcttaaaggcatgttatttgttccctacagcttaactactcctaggagtcttggcctcaggacctgctgaggtactgaactgggaaaagccaaaagagccttaggtatctccaggttttgaactagaagagatgggtctggaatgagtggaggagttgatgagaagaaaagacagctgtcttcctctttcccaccttcctccttgcccggtgtcaggagaacctgtagccattgctgtaaccaatgctgctgcaagcgactcccctgctaggcctgttctgggtttgtaaggagtgggtgagaaggctgctgttggaagcgcgggcaggcagggtgggagttcagcagctgaggctgcagcattgggggaggacaggcagagctggtacaggctgggctctgttgggccccaggctccctctggtggacagactaggaagactagggcctgggtcaagatgtagcttgttgggagcctgttctgccccagactcagttctcccaacaaccctttgtgcatctgtcattaccatcatgtcacagcataagaaacccagggctctgagaagtgatgtccatcagaggtcatgctactaacacaacatgctcccgttcctgtgaactgggccttctttgctttgggcatcacccatccttattcggatcatttacccaggactcccacatccttccctactgctcttctggacaggttccagaatgccagaatctctgctgccaggctctgggtgtggccttcctagtgtgacagaaagcaacatgagtccctacctccttctggtcactgctacatgaggatttagttgtttgcttactagttgttgatcctgactaatactcagatctttttatgtggagctctcacctcctgccatgatttaaaaagagatcttttttttggttgttaagcttggttccccccccaccccacccccaacacactacagttctggcacatagaatgatttctagaggctaggactcactgctgagtgccctgtgcccaagagagctctgttcctacattttctgcatgggcctagcttttatctctgctgtatgcagtggtgggttgaagccagtatagtggtaactgtctatcctctgctccctcctccccaccccacccccctgtgcaagctagctcacatttagatactgaacctagagaacgccagcgtggtgttcttggcacccagggcgatgcatagtcctaccatttcactgctgaactatcatcatgtgcgtgtgctgggttgtcagcatgctccccataggggcccaggctactgagaaaatgaatacgtgagagcaatcccagggtgaggctctgggggaagtctgtcccctttggcgtgctggattctttttctagggtgtctctctttccttttaggagggaaactatttattgtcccctctgccgtgttgtgagcattatgctggtatgggagaaaatgataacgttaagtttaaggagaattgggagtcttgctttctctgtctggatctggggcaagaatggggttgttgtcatccacaaatatttcttggctgtgttcacagagcaggaggggccaccaggcttagcaaacaccatgctcttggcacttgcagagccctcttcccaccagccaggaagacagggtttcgggcttagtcaggccatagacagtacagaggacaaagtgaaccgaaagggtggggttcctcagaggatagagggaccaaagtgagccaggccactgtttgaggacctgggcagtagaggaaggtgctttgaagaagtgcacagtcccttggtgttcaattgacgttcgctgcctgttctttctctgtccacctacctactatggcctctgaatttgctgggggcagagtaaaagcctggagcatggtgaagaggccctgttcatattgagtctcagctttctgggtggtaggcactatcctatgcagctttatgtaataatagctaacattttttttagtgcatttactgtgtgctggacactgccttctatgtgcttcccatggaatcattccttctgtcttcacatgcatccctttatgtaaattgttattaactccattttacggatgaagaagctgaggtctagaaacttcaggtaacacagccaaggtccctaagtgaatacgtggcaggactacaaaagagctagtaggaacccaggctgggctccagagcctgtagcattcttgacattcttacccatcaggcagccccatgtcttatctcattgtcacaaaccccttgccaggtgggtgttactgctatcctcagatgaggaaatgaggaatcagagaggagctgtaaaggaacctgctgatgagacctagaattgtatggctctcaatcgttcaatgcactgttccctgccagaagaggggtttagagacatggaccatagtcacgactccggctttcctccgacagaggttccctcttacaattacctcctgattgttgccaccatgtatttctgttaagcctctgaatagctggagccaagccatgtcttcagtctggctcctatgtttttcattgtctttctgtttctgtccacagattccccttctctcatttttgtgagtcccttgtcctcagtccagacttgagttagccttgtgctgccatcatcagctcactcaggtctctgtgatttgactaatgctgttccctcatctttggttgaatttttaaggttgaattagctaacacctcttcacacctctcctgtgtttatttggtggtccttaatttgttaaaaaaaattctattttgtgtctgtggcttttttttttgcttgcatgtatgtatgtgtaccacatatgtgcccatggaggccaaaagagggcactagattccctgaactgaaactgttagctgccatgtgagttgctgagaatcaaacctgggtcttctagaagaacgaaaagtacttttaattattgagccatctcccaagcccttgttggtccttcttcattttttttaaagatttatttattttttattatatgtaagtacactgtagctgtcctcagacataccagaagagtccattggatcccattacagatagttgtgagccatcatgtggttgctgggatttgaacacaggaccttcggaagaacagtcagtgctcttaaccattgagccatttcaccagcccttattggttgttcttaatgctcagtttatccttggcgtttgcaatgagcagattatcctttttatcttctttttaacctttttttttttaactttatgtatagggaagttttgcctgcacatctgtgctcagtgtgcattctctgcttgtagagaccagaagagggcatcagatcccctgggactgcagttacagattgtgggtgctggaaattaaacctgggtcctctgtaagagcaactaatgctattaaccactgaaccatctctctagccccaggtctagctttttacaatacctccgtagttgttcacatcttgtgcctcctactagcctctaaaacagcagttctcaatctgtgggttgcaactcctttgggagttgcatatcagctatcctgcatatcagatatttacatcacaattcataacagtagcaaaattacagttatgaagtagcaacaaaataatcttatggttgggggtcactgcaacatgaggagctgtattaaagggccccagcatcaggaaggttgggaaaccctgtgacttaactgacatgtattgagtacaagttttgtattggattctgtgcttggtgcagggggcataacaaagggccgaagaacttggaagtactttgcataacacatagctgcccagtcaattctgagtaaacacatgaatgtctaattaagtcctggtgagctaatggcccagtacctcagtttttctttattctggactccttttgagagaaatgtcaacttcaaaattctcttggccttttccacttgctccctggaggcatttggcttatgactttcctgccttttacacccagtggtctcccaattcatatagtgacagagaagcaggattggatgagacttttaaagatatacaggctgccgggcgtggtggcgcacacctttagtcccagcacttgggagacagaggcaggcagatttttgagttcgaggccagcctggtctacagagtgagttccaggacagccagggctacacagagaaactctgtctcgaaaaaccaaaaaacccaaaacccaaaaaccaaccaaccaaacaaaaatatacagaccaactgctcatcattgtatctccttagcatgccatgtctgtgtcatgcgacattcttgatccttggaacaaaatcctctcccttgagtgaaccaggcagtcctgtacaggacctgtatgcagttcacccaagtctggttacaagttgttgatttataaatttttccatttcttttcccctttttgtttccatccagtctttattgagaagataaccaaggccacgcacagcatcttggggtgggaatagacttggcctttttggttccttccctggcaggagccagtgtcacagggaagaaaggtgaagagatgccttatttcctccttggtggggatcggctaaggctagacaagaatagatgatacttccctgccccctagaggcgaaatgcgacaaacaccgtgaaaacagtcctatcatatcttagccaaaacaaagatggctaggccagttatatgactgattgggattgttcctctcatgctttagatgtaaatgaaccaccaccatcacccgagaggtacccttcactcatagaagatgcatttatgtggcattatgtgatcttttttagactataagtttcatttattttttttgttggcgcatggaaataagagtgcagttgtatggttcttgtgctttcttaaaaggttagtatgactgtatatccaggtcttatgatttcctactggatctcaggttacagtgtattacactcacctgaatcaaattgtcgtagggtctctattgctgtgaagagacaccatgaccacagcaactcttataaaggaaagcatttaatcgaggcttgcttatagtttcagaaggttagtccattattgtcatggcaggaagcatggcatcatgcaagcagacttggtgctgaaagagccaatagttctacaccttgatctgaaggcagcagaaagagaactggcttgagcttctgagacctcaaagcctgatccctagtgacgcacctccttcaacaaagccaagtactccaacaaggctacacctcctaatagtgccctaatagatcactatgggtctatgggggtcattttctcttaaacctccacccaagccaaggttttcttctatataatcatgttagaattactgtcattagagattatggtgtagtccttactatgtgtaagggcctgggctcactttctgttgtattccctgaagaataataaacatttgccatgaggaagaattgtaaataaattagttattttctctttagggtagagctcagtttattcccagcattggaaaaaaattgctgttgttatatatgatgtgatgtacctaactggcacctcacacaactgcacatctgctgtgttagccacttcttgagtaacgcaattcagctgtgcttgtgaaaaattgaatatgacaaagccaatcacagcacacagtacatgtttgtttattgataaacatcattactaacgatagttttgtaaagctctgtgctatgtgaggggaaggagtaagaggccatgtaagcactccccacaattctaagagagaggttaacgaagtgaatatttgtgtgtctggtgcatgtggcaccttgtgcccttaacaagtgggctttggtgtatttgcactgcatggttctgggctcagggtgaagaaagcagttgtggaaacagatacaaatacagtggtattcaatgtgatattgccagagggacggacaggaagtaccgtaaggattggtggctgcccagacacatcagggaaggcttcctacaggaggtggtctctgaatggaggctcagaggacaagttggagttgtctaggtaaaagaggactacacgtaggttgctgggaattggggccaaatgagacgttaaggaagggggaacagccttccatccatgtatatccatccatgaaataagtgcaaagagaagcaagacatttatcagtcaaagcaaactagagcagcacctgagagacagggagctttatcaaaaaggaggagaccttggagcattggtcatcccaaatcatgaggacataagaaatttagagttttaagctagggagagaggtgtctgttgcacagtatattgaaagtcacattttggaacaatctccctagaagtgcaggtcataagatagacttgaaaacatctagtgaagaagtcatataacaatctagatgagagatggtaagatctgcactcctattcacaaaagccaagatatggaagcagtgcagatgcctattaacagataaatcaagaaaatgtgtatatataaacagtgcagttttatttacccctaaaaagaaataagtagtgtcatttataagaaaaaatgaatagaactggaaatcatgctaagcaaaataagccagacacagaaagaccattttgtatgtttttctcatatgcagaaactgcattaatatatagatatagatatagatatagatatagatatagatatagatatagatatagatatagatatagatatagatatagatatagatatagatatatgtgggctagggagatggcatagtggataaaatgcttgttgtgcaattgtgaggatctgagataggattcccagcacccactaaaaagctgggtgttttggtgcacccctgtcatcccagcgctgggatgtggagacaccccccctcctccctgtaggaggattcatgaatcttgtcagctagtcagtctaaccagtcagtgagttccaagttctgtgagagatcctatctcaaggataaggtgaagagctgattcggaagacactcaacatcaacctcaggcatgcccacacacaacacacacacagagacagacagacacacacacacacacacacacacacacacacacacacacgtgcatacacaattatatgtaacatgaaagcaaaaatgggactatttgcagggaagaagggcaccagtgaagggaggagagaaatgtaagagagcgcattgggggcatgaatatgagcaaaggacaagagtccacatgtgaatattatataatgagcctttagtcccagtactggagaggcagagggaggtgaatctcaagttccaggacagccaaagccctgtagataaaaataagaaaggaaggaagaaaaaaccagcccaatgaaactaattttaaaaagaaaacaatttgttaagatagtagatctcattaaaaggaaaaaaaaaaagacctgctcacttgggtgccagagagagaatagaaatgacactaaattcttcacataccatcacagaagggaacagagctcgctgccggagctcagagagatggcaatcattcatgatcagcagggttgtaaatgtcaggtgttggagctggaagggccagaagtatgaggctaaaggagatttactttgcaggtgagaagactgagaacagaagagacaaaagactgtttagggccatgcgaggtgtgagcaggggagaggtgtgagcaggggagagcggtcctgactgcaagagtctctctagtattaatgccaatgttcagagcagcttccctctaatgtgctgtttcctgctctaaaatcttaggaaggtggaattgttttgtgttctacttatagaaaacccaaatgaaagaaagaggaaagctaggacgccaagagactaggtgacttgttggggatgaagcttgaatggtagactggccttctgctccattttggctccttaggaccaaacttcttgctgctggattttgtcttgctaggatttgtttggtgtatctgaggcagctcggacgcaatttctgccttgatagccaggcttggacacctcccctcctccctgtttcaactttcatataaaggagggctgtacttttgagaaagacagacttgtgtctgaatatgaatctgcttcagtgtgctagatgacctcagtgaaaccattttctgttttataaacttttatttcctggtctttaaaatagaataacaacgcccactgctcagcgttaactgagatcatttgaattgcaatgtcagatgcttgtatgtgctcaataaacaatcattttcattctctttctggatccaggactaggccaagctttgctttcctgaaaattgtatattttatccttgctaatatggggctgttgggatgttcattgtgtcttcctttctgcctcagccaccagttgacttgaaatatagcttgaacaacatctgttttgatctctctctctgtctctctatctctgtctctctgtctctctctctgtgtgtctctctctgtctctcacaccttcttattgtttggttcaatttctggtctgcccttatctgtgctcttggaataagtaaccttaaatccttcatgactccagcaggtataaataattgctggatgtaaatagtttagtaaatggaaggctggatggggtttggaatggtaatggtgatgtttgaagagggtggtgcaggctgagctggttgaaaaggcatcagtatagatggctgtagggagccaaagtattagtttagagcagtggttctcaacctccctaacgctgtgaccctttaatgcagttcctcatgttgtggtgacccccagccataacagtattttcattgctacttcataactgtatttttctactattgtgaatcataatgtaaatatctatgttttctgatggtcttaggcaactcatgtgaaagggacatcaggactcccaagttgagaaaccgatggtttagagtatccagtcctgtgcccacctctcttgcttcttccctaaacagaagcaaacactggagaccagaacctcatatcaggagagttatcactgtctgtgcttggtatgtacagtatgaaagacagagatcccagaaaaggaaagggacttgattttagaattttaaaaagcattccagccaatcaaggtggcacccagctcagctgggaggctgaggcaggaggattacttgagcgcagaatttcaagactaacctggccaacactatcaagaccttatctcaaaaacaagagaaacaaagtgagcacaaatcaaagcagtgtatatattcaatattatttttttatttctaactgacatagtaattatatatgtttattacatacagtgtggcattttaatatatgtatataatatgtgatcatcaagtcagggtgcttattaaactgtactcaaacatttatgtctctttgtattgggaacattaaaaaccctctctactagctaatttgaaatattccagtagtttttgtcaaccattgttatactactgcactataggacgataaaaggtattccttctgtctgctagcacctctgtacccaggaatcatcttccctccattcccttctcacccttttcagtcttggtaaacattattctgttctgtatttctgtgagattaacttttttgttttagcttctacgtataagttagatcatgtagcatacacacacacttttaaatgacactcaaggagttgtagaataaaaagcccatgtcttgtcgggcacaatggcatatggctgtaatctcagctcttgggaggctaaggggggggggagccaggatagtatacataggcgctcccatgcaccactggatatggtcagttggtcatttagcttttctggtagtaacttcatttctcttttttattattatattgttctctctctctctttcttcttcttcttcttcttcttcttcttcttcttcttcttcttcttcttcttcttcttcaacatgcacttatttgttgcattctttctttgtcagcttcctccatttcatctttttggttttctttttctagaatgttggaagttggacatactagattgatttgctaggccacgtaccttttctctcctattttctgccttgcagactgtgaatgacttcatataaactcttattctttgtatctccagaatcgcttgtccattcgctggttttgctcagtgattcaacagggagctgattgttataatggatgtctttcaaaagccaaaatgaaaagcagtttatttgaggccactaaaatgtcactagacactctaatccatttctcatagcttagttcctttctccaggagccctgtgacattttgcctttgcgagaatgccaggcagcttgtattctgagtctagtacttagagtgactaggaaggaaggaaggaaggaaggaaggaaggaaggaaggaaggaaggatggattttgttgttgttgatgatgatgtatgtgtgcacgcacacacaagcactcacgtgtcatggtgcacatgtggagatcagagcacaactttcaggagtcagttttctcattacactgtgcagggtctagggagcaaactcaagtcattacacttgtatggcaggtaccttcacatgctgagccatctcccttgacctgaaaggatattattgtggttttgagcatagcctttaacagctgagccatctctccagcccctgaaaagattgaaaagattttatatgttgtcagtttatcccttgtcttttgtctccccccccccccccgttatatctattcttcttgatacataccaaggctaagtctggaatctctctcggtctctcatgacccaagttgctccctcctcaactgcagcctcctctgaggtgttcttcaagagccttcaactccctgagtcctctttttaacttgtttttgctttcagaaacttgttgaaatctcttactcactgatgcttcgctctcccaccctatttcctgatatgatctcatacttgcactttattttattcctttacttgtattttactacagttctggaagagaggcaatacatatttatgctcttgagttataggctttggctccagctaagcctgattgaaaccagaaatattagtaactccacattcccagtagcgtagcttggatggcctcatcttgaccctatgttactattggtcaaaaccagcgtcatgaacattcctttagcaggcctggcacatcccttctgtcaagctcctctccctagacctcaggtgaagaacagatacctgggctctgtctccatctggctattgcatccttaggaagccttcaaaccttctccttcccctcgctgggtgctctgtctgtgacttgataggcttctggtctgctgtgcacaatcactccaggattggctaagtgcttgaggagcagcccatcttcaccttggtagtgaaagcaggcgggccagaggtgatccccaagcacactgtaaggggttagaggctgagtttagactttctcaacagaaggcttgctctagctgcctacccttctgcagacaccgtttcatcatggctgaacacttactcctgtacgtccagcagaaaaggagaaatgtaaggccaatagaaccaattccattttcctgtccccctccattgatctgcaatatttgtatccacccccactttctttttgtgtgcgcccctcttctgccccttctaaaagagcttgttgtagctggagagatagatggttcagcagttaagagcactggctgctcttccaaaggacctgagtttaattcccagctcacaaccatctgtaactgtagtttcaggggatccatctcctttttctggcctctgaaggtaccaggtaccgcgtagtacacagacatacatacaggcaagccactcatacatatagaacaaaaataaataaatataaaattaaataaataaataaaaataaaagtgcctgctaaatgtttctggtataggatacattgggctatgctatatggaagggagatgggagacaggggaggaaggaaggccaagtctgcaggctggtatgagagatgaagtgcctcttagctctgctgtgccagaaaggagcaaaagttgtggcagttgaagaagtatttggtgtgcgtgtgtatgatgacacatgctgagtcaggaggctgaagcaggaaggcaacaagttccctacaagcattcagtgcatagcaaagtcctgtcccaaaaacccaagcaatcatacaagtacagattttcaactcggacccaccacttattagctgggtgagtgtgcatgaatcacattgatccaccaagcgtcagtttctaaaccccatatgatgagaacaactacctcggacagatgttaggactacctatcgcatgagtcccgggccattgtaaacacataataaatagtggcattgttattgtttgggttattgtatgtttggctatgatataggccaataatgcttgcttgttatatttattatgattatataatactcgtttaggatgaaaaggaggcattccttgtatgaagcctccctggagcttcccagaaattatagggcaatgtttatattctcttacctagtttttaagtcttcggttgtcgtctttgttttcctcaagacctaaatataaagtgatctttgcctctttagttctggaacatgatatttaagaaatgatagccatgtgtagcggtacatgcctatagtcccagctcttagaaggaagaaatgggaggatcaggatttcccaggcagccagagctacctggtgaaatctcgtctcagaaaaataagaataaatatagacaaatatttagtctaaagtttgaagcaatctttaccatcactactgccactatcatcatcgttattattatttcagacttgttcagagagttatggtgaacaagtctgaaataatagaaatagaaaacctaatggccaacgacattctagaaagagcctttatacatatgtatttttttttctctagaagcatttaacatctttttttaactctcagtattctgaaatggtatagctgcatatcttgaggtgggtctctgttttgttgatcttgtggcctctcatcccttcaattctgggaaacggtcttatactgtgtctttgagcatttccttcctgctgtttcctccggcttctatttctggagctcctattgttagacggaggaattcctcaattaatcctctaattttcttatcttttcccttctgtctttctctttcttatgttatcttctttcctaggatatctttccaccttttatcttctaattccactgacctttttattctggctctcactgtttttcctttttaaaaaataatctatttatttatttatttctatttcatgtgaattggtgttttgcctgcctgcatgcatgtctgagtgtgagggtgtcaaatcttggagttacagacagttgagagctgccatgcggttgctgggatttgaactcaggacctctggaagaacagccagcgctcttaaccgctgaaccatctctatagtcccctaattatttttcactcttcagatttctttttctattttcattgtctttgtgcctttcagattccttcttaagtttgtttttttggtccatctgcctccaagttggtggtctttctcacacagctttgtagcatatagtactttgactgcctagaacttcattgcctttaaaaataacaatttttattaaggtttatttaatataaaataaaatatacctagcttgtgggttggagcggtggatcagcagttaagagcacctgttgctcttgcagaggactcaggctcagttcccagcacccacatggcaatttataaccatctataactacagttctaggggatctagcatccctttctagcctctgccagcaccaggcacacacacagtgctcttatatacgtgcagttaaaacattcatacatataaaaaaaatcttaaaaacagaaaccctaacttaaatgactttggatgttgccgctttgaaactagttcccatgacactacacaggtgcacccgactttgctgttggaaggaggagagtagcaggaagttagggtaccagcatttcccagggaagattcctttgcttttagctctgtttcaccccatctgccactgcacctggtgttctcaaatccaaagcgtccggttgctggcctggtgctggaggtggagagaatctgactggacagcattgaggacagctttgcaatcctatatttagccttatacctcactccaccttttgaggtgtacagtacctctaaatcctgagcactgaaggggttctataagcagcatggtttacttctggtcagcatcttaggctttctctttctgtctcttgttgccgttatttactcacattttggtgggatttgggaatggagacaaatcaggttaattaactcattgtgattagatgaacagtcctctttttatcctaagcaactgctattcatcttccatgactcgtgtaggcaccatatcctctaaagagtttatgttcatgtccgtagggtgggttaagggccccttctctgttctcctgtgatatcctcttcttccctctcagccattaatgaaatggcctatttcaagcatgactaagagacatcttctagtggtctggagctatgcctcatttcttcccatagccctagcttgggatcatagaagtaccgagtgaatatgtgtcactggaatgaatgaatgaatttagacatagctagagggaatgattatctagaaagagaaataagctgtgtgcagttgggctgatataaggtttgtttcttaaaggccatgtgttctttaaagctgtggtcaggaaagtctatctaagcccaatttaaaccaatggaaaactatagctgcttctattttgtacattcagggaatggttgactatatcatgacaaatcaaaataatggtaatgaagaatatgcacttacgtgaggaaacatgcaaaagaaaacacaatgaaaatcatgcagtgcaaaaccattttttaagatttatttatttatattttatgtatatgagaacactggtagctgtacagatggttgtgagccaccatgtagtttctgggatttgaactcaggaccttcggaagagcagtcagtgctcttaactgctgagctatctctccaggcgcaaaatcatttttacctccatgaagaaatgcagagaaatagagcaactgttcagggttgttgctgcctctgtgtggtaattatgcacacttctctcctctctttcccaaggttttcatggattttctaatggaagaatgcattcagtgcacagtttttaaaaagctattcagaactgaagatcagtataccgaaagacctaaggatgaaataccccaatggatatcctgagaatcagtgcatttgcttagtagggtttgcagtaaaaggtgcactgaccacagatcctgtagttcttggcctgtgggacatccctgaattacaaagcaggacctagtgaaggaagcaaaaagaggaggttcttgcttttttttttcaatttttattagatattttctttatttacatttcaaatgctatcccaaaagtccctataccctcccctcacctgccctgctcccctacccacccactcccacttcttggccctggcattcccctgtactggggcatataaagtttgcaataccaaggagcctcttttcccaatgatggccgactaggccatcctctgctacatatgcagctagacacatgagctgtctctagggagggggatactggctagttcatattgttgttccacctatagggctgcagaccccttcagcaacttgggtactttctcaagctccaaaagaggaggttcttgggtcttagtttactacaaatcacaatatcatgcatggactgccccaagaaacacaggtctgggctccaaagttcaaagacccctccccacaaacaagtatctgtggagctaagttcattaggaccccatcccttctaaactatactctgggtatctggggtcccaaattccttgtccagatttctcaaacttttagcaattgtatcgtcttattatccaagtctacttattaggcccaagtgtagcctaaggagctggggagggggagcacaaagagggtatgatatgcatgtgtacatgcaaacatacatagatagatggatggatagatgatggatggatggatggatggatagatagatagatagatagatagatagatagatacataggtagatagataggcagatagatacatagatagatagatagatagatagatagatagatggatggatggatggatggatggatggatggatggatagatagatagatagatagatagatagatagatagatagatagatagatagatagataaataggcagatagatatttttctacacacaaaggtgtgtccctgggtctttggttccacatgtggacagctgagtctacttgataagagaaataaacattggggttttgaagaaagtaaattttttgtttgttgttcttgagacagggtttatctccatagctttgactgtcctggaactctctttgctgtccttaaactcagagagtcacctgcctctgcctcccaagtgctgggttcaaaggcatgtggcatcactgcctgacagaaagcaaatgttttaaagcttaaagagtgcttagaactcaactaatacagctgcatcattttacagatgaggaacaaagatttagagaagtgacttaccagaattaacactgcctgctacagaccaaatcctaacttcctaccactttacactccctggagtaggaagcagattgaccatttgttattcaaggcaatgttcctcaaaaaggtgccagatcactctatattgatgtttgttgccttaggttttctattgatgtgataaaaccttttggggagaaaaggctttatttcagtttatgcttctttatcacagcccatcactaaaggaaatcagagcaggaactcaaggcaggaagtgacacagaggccatggagaacactcttttctggcttgctcagcctgcttttctatacatcccaggactacctgtccaggagtggcagcaccctactaggctgtgccttcacacatcaatcattaatcaagaaaatgtcccatagacttgacctacaggccaatttaatggaggcattttctcaattaagattccctcttcccaaatatgtctaggtttgggtcaaattgacaagaactgaccagcacagttgttatccatatacaacatactgaatgcttagtgatagatccttgagatgggatgcaccctcactttggatcttatggtgctatagcctcccaaatgaggaagaattagtccaatgtgagaagatttgactaatacactctgcatcaggacttggacaccccccccaaccccactgccatcttgagaagtgtaacacatcacagaaatactttggaagcagaaatactatgaatggtacacagtagatgcttgttggttgttcaggatgatgatgatgatgatgatgcagatgatgcagatgatgcaattgaactccttgatcaggtagttgtctttccaggttagagcctagggtatagtcaactggataaatgtatgctgggttttgagatgggtgcttgtaagggaaccagactctttggagcaggtgattaatattagagatgctgagggttttcgctcccattctgtaggcagctggggagtcattgaagtttggctaagcacttgatacttgagaataactgagctggaattcggaagctgtcttgttgctatagatgcagtggagagttttagtaactgtggtaaaatctgctgtggccttgattcactgttcctttatggggacaaaaaagacaacaggttggtaccactgatcagctgaacatgcaacaggtgtcaggcactttaagcctcaaagccattccatgaagggagggattcttatcactgcccccatactgccccgtttactgagtgaaaaaaatctgaggttcttaaatagcaaggtgatttcttcaggataatgtggctagcaagcagtcaactcaagcaggtagactcacccgagtaaagactgtacttcagcaccctgatacttgcctgtcctaccttgctggagcgcgcgtgcgtgtgtgtgtgtgtgtgtgtgtgtgtgtgtgcttgagaagcagccagagacatccaggttcagatattgcctctactacttaccatccctgtgacttaggcaagctacttcatttctctgagtctaagcctcagtttccccatttgtaatacaaggttgcatatgtgtgcacacatgcgtgcacacatactcagtctctcaacaaatgctcttctaaaatcatcctctcaacatagatatggatgatatccacaggaaacataagaatatatcttggctctctcagctgaagacagagccttatgtgtttatctctatgccttttacagctcagcctaggagaggacctgaggtgtggggtaaagagggaggaaggctactttccatactctcacacttccagggcccccagttttcctttctctcctcttctggtcccaatacagtagcttctctgtcctaacctccatcacacaagtacatgtgcatacatacatacacacatactgtccatgtgactaatcgcttgtacaagcatgtgcgcctagacaacacacactcccctcggggaggaggagtgagagaggaggtgagtgggcctagtgttgctcatttcctggctttcctcagagctggccctcactccattttctttcacccttcttttgcatcgggggccatgcataatgaagaagacggtcagtacagtagaaaggaatctagcagctgactcatttaccctctcagcttgagtctgttcatctggaaaataagcaggtcggactaggcagttggcaaagcctcttatatcttgttaataatgtctggcatttgtctgcttggctccaaagagcttaatcatcccaagaactctgtgaggacaaatggggaaactgaggctcagactcagagaaatgaagtagcttgcctaagtcacagggatggtaagtagtagaggcaatatctgaacctggatgtctctggctgcttctcaagccacactccaaggaaaaccacactcattatgagcccagctagttctgtctccacacaccttcaatggcccttcgcttgcttacctagctgaccagtccttctccctgttgctccaactgactaagcactcaccatcatggtctttgcacttgctgttctccgtgcatgaatgaaacacgtgtgtgtttttataacatacattggacctcaacgtggggtaagggggaagagtggtgaacttatattgactgttgggttttccccgtttctctttcagatctgatggtgagaattccagaacagtcaggtcagtttctttagtagtacttgggggatggggatgggcctggggaggaggtgttttctggttattactttgggatccatgggtaggggtcaatggcagggttcattcccccattggtattagaagtgggtgtggaatggaagggaggacagggagaatgtggcaggcttagagatgatggtgttaaagactgtcattcagtccttatagttctaggggacttgagagctttgctgcacacctcaggggctcattaagacatcagctccagaccttctattttcttctttcaggagggaaggaacaatggacactaggcttgcccagtcttattttccctttgtctcaagtaatggggcttacattgactttagatgtgatacattctagatattagaaacatatatggtatgctgggtggtggtggcgcatgcctttagtcccagcacatgggaggcaggggcagttggatctgtgagtttgaggccagccagggctacatagagagaccttgtctcaaaaaccctggaaggaagaaaggaaggaagataatggagacaagttttgcatgcttggttaaaagtttctaagctttgttaaggtttaaaggtgatctgttggtacttgaggaagcagaactagggctctttgtgcatgcctctggacctcatctgtcagaaacctcaggaaggcagaagtgtcagaaataggaataaagtaaggatggtgaggcagtttggggtgtggtctggtcttagaatctggattgggaactatggcttttgagataagatgggcccaggcagtagagacatacattaggaacagtctgtactctctaggcttgcactagtaaatatgacatctttgtgattggtagaaaacagctcacttaagaaactattcttctttccgaatggatcaattggaaaatgttccctttcttgtgagccttgctcaccaggctcttcaggttggtgaacaaagcacaaatgggatgttagcccctattcactacctctcagctgtaaacccttgggtggggcacagcttgcccaactatgtgtaacagtgcagttcctattgtgccatgcacattactggacatgggccggggtcagaagttgtctgtgtacagacagaatttgtcctagcatcccccttgcaggaggtacaggaggtctgcagtgagcaaattggtacccaggtccaacggggagggtggacacatgctgaggccagcattaaatcagtgagaatgtggtggctatagtgagccctgatgtctgggcaagaggtctgtgatggcacataattaatccttgcgtgcagccaaggagcatggccaggcacagcttgttctagcacttacgatggcacttgtctaagaaaggacacagatctcaatgtcctttctgcaggtttggagaaaggcagcctgggatgacttcaagcccggggcctcccaaaagcatctctgataatgtactgctaacttgttgaggaaccaactgaactcgtctctagttgtcagctcctcccagctcgggagcttcaggaaccttttagttcatgctatttaaaaatgaccataatcatgagtcatgtgatgacatgtgctgagcctttagagcttaacagaacttgtggaggatttgctttatttgatccacccagtgacactgtggaggaaacctgcgctggccttatcatctatgttttacagttgaggtgaggaaacaagccaggattcaaactccagtcagcctggcaccaagcccagattcctgcctttcctgtcactgtaggacttcttaacagctttgcagatgatgatcattctcaccatcatccaaatattagtaatcataataattatcattgattcttcaaatactaagaactgtaaatatggtcttatttaatgcttacagcagctgcattaggcatggattatgatgtctgatctgcaattgaagaaaaggagcatggtgtggaggcaaattcctttaatcccagcacttgggagacagaggcaggtagatctctgtgagtttgaggctgacctggtctacagagcaagttccaggacggctggggctacatagtgaaatccttgtctcaaaaaacaaaagaaaacaaaagcaaatgaggaaacggatatcccaagtaggtcaatcccttacccagggaaagatcaatggggtggggcgtcattcttctgatgaatactctgaagtctctggttctgaagctagtgttgattttactcggatttgcttcctggtgtgaatactaggctcatattcaaggatgctctaacagctctgaggactcagcaggcagaccaaactctggctctgggaagggcctatagcagtaggacatgtaaagcaagggcttgcaaaatagtaggcagaccctttaatttggaaccacagttggatgggactctctgaggatactttcaggccccatgcatgcatgctcaggttcactacagttagggtgtttactgggggtagacggtatctaagcaggcaggagtacacaggactgactttacgtaagtagagtccatggatgtagaatcagagtgactagaaacgcaagggatgtgtttaaagccagggaccaatcagttgggctaaaacagacatgagcaggaaagcacttctaaaggtaaggaccatgattggatcaaggatgtgtcgcagatctctttaggcatgtccagccttttgactttatgacatgatgtcatctacaaacttcacacaggggaaccatgtaaacagatgtttacaaaacaatgcaaaaaaaatctcagctggggagaaggctcatttggtaaagtgcgtgctatgtaagcatgagacctctgttgatgcccagaagccatataaaaagctaagcatgatggcgtgatctggtgatcacagtgctaaggagacagattcctggagctcactggccagccatcctgacaaatcagcgagaggccccatcttaaaacagaaaaaaaaaaaattgaagaagacacctattttcaggctctggccttcacacacacacacacacacacacacacacacgcaagcacacacacatacacacacacatgcatacatacacatgcacacacatatatacacacacatcacatatacatgtccttctgtacccacatgcatgcataccatctacccacacatgcacatatacacacatgttcacacatgcatgcacacacacaaccaatctcatattgttttaaatgagttcataattttgcggttgcatcacttatagctattttggggtgtaggcggcctccgagttgcacgagaagctaaggaaagtaggctttgtggcacagaaaacagggagaaactttggatccaggctaagggctccatttgaggctaggttgctttctagctatttgactgggcaaattggtttgtctcttgtaaaccccaagtttcttcatccagtaagcatctgcattcacgagtgtgaacatacaagggcacatgtatgactggagaagaattgagtggtggggaaaaatgcaggaagaagacaaataggcctcagctagtgtaaaaaactgaatagcaaggagagaacatggcaggtagactgcaaactacccatgttggggcccaggctttaggaattcagtacaagagtgtaattaaaactgaacaactgacagtggggcaaggggccaagatggatacctgggtttcctgtatatgcaacagaaattgtcagacctaaaggcaccttaagcaaagtccagattacaactggccatacctaaagatcacaaagctatcagcatagcctgcttcctagctatctgacttttgccatcacttaaatactctggtcctttgtttctcttttataaaatggttctgatttcactgaattgagggaagttgaagtaaccctatgctcaacatcaaatatcagtgcaaccaactgcgctacagcctcccttagactaactcgtaactgtatgatatagagtcatgctgcaaaatgtggacaagtttgttaaaagcaatcagacaggaggggctagactgatcccatcagcagaaggtaagggagttccagatgtcccagaggaaatcatggctgtaagaggtcaggctggaactccatggccctggggaccaggctgaggttgctaggcatgcaatgataaaagcaagaggtggcctgttgctagggaaggagggagggggtaggggagccactgacaccctctgagccagggacatccccatggcaacagaagccactggtgtctggagaagtgggaggaggagcaatggctggctttgttcccagaggaggcctcccactctgggcctcagtgtccctatctgtcccactgaaattttggtttaggtattttgaagattcttccttgttttgacctcctaggatgactaaaaccttacaatccttccttggctcccccattcacatatctgagatactgtaaccattccccagagccgccccagctatgtccaggcctcccctcccatatgcttcctgttcagctctgcctggctacccaccctgcccaactactgcttcctgtgcttgcagcctttttcacttactgcctgtaacatgctctctgtctgggaaggggaagcaattcccatcctgtacagtgtgggaagcctgccccccatccacccggactgcttcctccatcctaagcttcacggatgtcaaaggtctgataacccccccatttgtgatcactggtgcaatttattgagctatttctaagagctgggctctccacatgatatttggcaggtacatttatggtgacatattgtgattccccactttacataagactgttgggtaagctcctgggacttgtctaaggtctttctgatgccctgtggtggtccaggtttagaacttgtctctgtatcattccttctgccctagcctcgggtgcaggtgcgatttttcctcttgagcagcagcagccctaccaaacgatggctggatactttatacgtagtctctagtttgtcttcactatattcttaaagcctatatatatacgtgttattttacaaaccaagattctaaggcttagaaagctaagttaatttgccctgcggtaaaaattaaggtgagaatctagatcatcagattggtaattaccacagtgttgtgaatttagcctgattactttcctgaagcatggaaaaattcatttcctgggttggacaatctgtttttgatgaggggtgacaaagaaagaggtaattgggggacccctgcctacagggagcactaagtctagggttgctacgggcaaagatgagttagttttagaatgtgacaaggtagatggccagtgtgtaagaacaagagtctggagggattgatctggcttctgataacaagacagaaggaaggacggagggggactgggtaattttcccaaaggaggaacttttctggaagctccagagagatgagttagggcaaatggttcctcttctccccttcctctctgggttctcctgcctctgcttggcccagcccccggaagtgggtgacccctaagctggctgagtgcctggttagcaccaaaataaacttgccttccctctctttccctccccttgcctctgtcccctctgtcctggctttaattagcagccctagggatgagtcacttggcagctggggagggaggctatgcagagcccagttaagcttcgactcttgccctgagccttacaggcagcaccacagtgttcatatgtgtgggtgtgtattactgcatgtcagggaggctctgcgtcattgctgctgagaaaagtgcaggggcaactttgcatgctgcctcaaggccatgcatgtcagggtgtctgcacataagcaaatctggtggttgctgcatttgtctctgtgtgtcactgagtgtctctctgtgtgaacgtctggctgtaatagcaagtgtcaggaaatgagagagggagcatttgggctaacaaagacaaatgccataataattgcagtcacttctcctgatgtttcccgtataccagccccgtgcttgcattcccaaatttcacttgttatagtttgggtacatcttgttgcagggaacagaaatttagccaagctagctcaagaatagagaggggaggactagactgaggctacacctcacaaaattaagaacaataaattaatgatagccatgcattttcaccaccaaaatcaagacccgaagtcaacgaacaagattgctctttgactctgtgaatctcttgggcctatgtcttggttttatccctcatagcttgcttgacccctcccccctctttgcaaattcttctctgtggctttttctgctgctgtggtatactagcatggtcacaacctagaagctatgtgacttaaggtccctgtcatttaactgcaaagatcctgtccagcctctggtaatacaagacatcgaggtggatttctgttctcttgaaaatggatgagggtagagagataaaatacttagaacctggtatttcttttgcactgagcaaggtttttacatgcacaaaagcgagcataggagttgggtgtcgtgcgtggcacatgcctttaattccagcacttgggtagcagacacaggagtttgaggccagccaggtcttcagggtgaggtccatgacagccagggctaaacaaagaaactctgtctcagaaaacaaacgaacaaaaatttgaggtcagatgttaagattgcccatccactgagtttttggtctctacttaattccaggtgacctttcttctctgttttcaagttccatgttcatatatcaaaacactattatatataaaacaaattcttcactttttcttatgatatttgtattgaacccagaacctcatgcatgctagacatatgctctattcctaaggtaccctgcttatttatttattttaagtcaaaatgccttttaaacttttttggggtggaggcaggggaggatggagccccactatgtatccctggctaacctggaactctctatgtagacacatctggccttgaactcccattgagagcattcctgagtgctggaattaaggggatgtgccaccatgtccagtccaaaaatacctttcaagtgcatagtacaaatgatcattgctaccagtttgtggcagtcttcatagcctcagaacaactggcataatggtcctgatggtgtagctgctaccaaattcatggtcactttagatatttttctgttttgttagttcagtgactacatttatagttatttgtagtatataattacagacacacattatcaatattagcaacatgacgcttgagcttacttctccattaatacaaaccctgcagtttctacattaattacagagggaattaatgaccccttagacaagttttcacctattagtaaagagttaggaaccagctgtgccagtaatgactggtctccagatgtgagggcaatgcccatagctctgaagttgaccctgacctagcatcctctagctaaaactaaagtcttcttaacacctcatctggggccttctggttctggtccagcaagagatgctgatattatttttaataaatatgtagtattactgttaagtctacgtgacagagattattccaggctcgggcagagtctcttttcttttctcctcttcttactttgtttttattattccaaatactaattattgcttttagctctgaaaatatctattgaattttaggtagtgttagagactacttgacacacattatctttagtcttcatgaccattctgccaattagaggcgatttaagggtgggcaaacatatctagaggaagtgaagtgactcgccaattcatgcattttgtccttcattcaaagatgatttattgagtagctaccaataccagttgattcaatatggcaaataagatggtgcacagtaaagtgatggaccctgcgctggactcccctgtctggttaggaaacagaaaatatccacaattataagaatgccttagtgtcttagtatcagggacaattcccaagctgatggtccaaactgagacttagaggatgagtagaagtgatctaagggaggatgatgtggtgtgagatgaaatggacagtattatatgctggaagtgtgggaggcgtggttggcacctggatttgtgcggaactaaagcttcgtctgcagtgggagtgggttgttaagagaagaatctggaaattagaagagtgtactttaggaggctggaactggggcccccgtcagttgtaccactgctagggagctacagggctcagctgaggagtttccatgcttcctgggctccttgaaatgtgtacaggaccaggcaacctcctaggtgggtctgtatgttagcctcactatattatagtggcttcagtgccctctagtgtccactggcctatcttgcagctgtgctgtgtatatcgtctcccaccaacatttataaccagctgggcctgtgctaggtgctggggacattgggatcagtgagacacctgttcctacagatttccaaattaagtagatgaaactgtgaacagtgttgagagaaggtggctgagagacgagcagggtggaaggggactagggaggtgattcaccctgcctagatgggatcagggcaggttcccagaagacacagcttctagctgatttttgaagactattcaggtggggaggtggctctgggaggccagggggagagcacaagttaagatgaggcatggaatatgaatcagaagatggcctggtcggccatcagtggaaagagaggcccattggtcgtgcaaactttatatgcctcagtacaggggaatgccagggccaagtgggagtgggtgggtgggggagcgtgtgggggacttttgggatagcattggaaatgtaaaagaaataaatacccgggctggtgagatggctcagtgggttagagcacccgactgctcttccgaaggtccagagttcaaatcccagcaaccacatggtggctcacaaccatccgtaacaagatctgaccccctcttctggagtgtctgaagacagcttcaatgtacttacatataataaataaataaataaatctttaaaaaaaaaaagaaataaatacccaataaaaaattaaaaaaaaaaagatgaggcatggagccgctgagtatgcctgggaattagaagtcattctgtctgggtgaggtgcaggttggggggggggatgtggtacatttctgtaaccataatactgataagatgcaggcagaaggagctcaagtgtaaggccagcctggactctgaggtaaaaccctatctcaaaacaaaacaaaatggagggagaccaagattagctgaaggtggaagatgggagctaggtcacctaaggatctatgatacctgcttatttactgggtatttaaagcatggaatctaattgcaagcttctctaccctttggaatcacacatccatctaggtatcggatggaatctagaaaatatatttctctgagaatactttccatacaactccaggggctttacaggtactcccttccctgcctagcaatgaaccatagacttccaaacttaccctagtttaagtaaggaaagcctatgatggcctccaaggatttgcaatattgaacccctcctgcacctccagcctcatgtgtgttctgcaatgttacctctgccacattggcctctttgaagttcctggaagcagtagctcaggtcttttcttctgcatagaattctttctccttcctgtctccatgtgaacataatatctgtctccgctcagacatacacttcctgaagacaggacattatctccctttagaagccagcactgtgcctagtccacagtacctgccagatgaaggacttactagtaccctgtggctggaagaaagttcctcactctgaattcattcagctccttgtgagtcattatataagtttatgtaacatgcttagatatgcctgaatcatacaaaggcagttcattaataggtattttcctagaattcttccccatgcctgaagcaaatgggcttctcaaaagtaccccctctatccactgggagctgttgctcaaacgatactcttccattatcatgagcatacttgagcctatggaaccttgacaagaacctatgaggtaagccaggtgtggtggcactcaacaagctgaaacagcaggactgctgtgagtctgaggtcagtctgggtgacataaccagtagcaggacagcccaaggctatgtagcccccatctcaaaaaatgacaaatgaaaaaacagcgttgtggggtaacggagcatggtgggatggcacatacctgagagactgaagcaggagaattatgaatttgaggcaagccaggctacagagcaagatttttttcaaacaaacccaaaccaacctctggagtgggggatgtcagtgatctttaggtaaccaaagtgagtctcagggggagaaacccagacgaatgattacattgaacctactgggctccacagtgaggaggttttgaactcctcagagagtaaaggagacttgctcaacgttgtatatcagcagccttacagtcaggcgtacaatttctgtcctcaaccgctgccaggttaagaggaaggtctgggccagaggtgacacagctgcaggagctgggagagttgagattgaggtaactgagcatggtaggcaatctgcaatctcaggagagggtgaaacagatttgtgaatctgaggcaagcctgggctacagagcaagactctttccaaacaaacccaattgaacctatggagtaggggattgtcatttctcttctataggtaaccaaactgagtgatctatagaatagaggagacggcagaggtcccgcagataccagacctgtagtggtttggagggcctctctcttcctagctgccttggctttcttcagatgagccagttgtcctggtagggagacaggaaggctggcctgtggcctgtcatctcctatttcttctgaatcactgaccaccctggcccttcccaggagccttctgctcagaacagtcaggagcctggcctctggggccatgaaagactggaatgctcaaagctggacccatgctcctttttttaaggaatgttcccatccttcagaccctcaaaattctgttttctctgatgctacccatatagacagtagagattgccaagtgggtagacggtgccgtgatatatcaacattgctgagattttttgcttctgtccaggcttcggttgttgcacctgtagaaccaggatggacagtcttcctggacgaacaacctcttgattgtaaatggcgtgtgcttttcagttgttttgtttttgccagtgtagaaaataacagagaagtgaatgacagcttattatagtcataaagaatagtgttcctggccacgccctcatatcagaaactgatttggattttatttgatgtggactattctaggacagtctatatgtgtctgtaaatgtgctaaaatgaagatgcttgtgaaaagcttctgcttaaagatttctgtatgtacaaaatagtaataaagctaagggtgcagatttcagattttggaatagccaaattaagccccaatcttgggccactactactactaagcttttgtatctcagttgtctatagagggtattcaaataggctctgtgacacaaacttttcaggatgagacaagttgtttgtggagattgcaggagagatgcacatctctaaactgcttcctcttgttaggaattcccagcccttagagagcaaggaaggaacaaagtttccaattgcatcctggcctgcagcccagctggcctggcccctcctccttggctcctccttctagggaagggctgaaaaagaaggggtgggagtagtgaccgggtagcattggcaggggatagggagggggactgcccctgggacaggtccagactcatggaacccccctggaggagcagcaggtaggaacctgggccacttagcctgatccccgtcttcctgctcagacctagactcactgcccgggctgctgattcagctgccttctagcttcctggtttctggctccctttctgtactcttgaaggcctttggtttaggagagggaccaacttgagtgggtgaattcctgggcatctgaaagctagctctataagaacctaggagcctaaaagcagcatggtccgtggcctgtgaaaggtgaccttcgtgactgccctggcgttatcctagcacacgggcagcctgcatgctccagccactgacattctgatgccagcattccagcaacctgagggtgcctgaggctcagatgcagtgaaacattgaatcagggaccaggagtgactggcgcatagaaggtacttgagaaacagccactctgatgacaagagctatttggagtttcagatatgaattcttgtgttcaaagtttctctgtaaaaaattgggtatcttctgacttgtaatgaatgcattagagagtgggcagctggcctgaactacagccccatttctgacttttgcttggactcttgaatggccaatactgaccatctacctttaggggcttatgcagacaggggctggctgacctggaggttccactttcagctcgtcctggctgtggccacctgcgttggatagggcagggagaaggcctttagccccccctatttactgtccctcctcttccctctttccattttctggactttaatcacatcaagcaggtgccagaggggcctttagaccgtgcactaggggtgggggtggggtgcagcagaggggtggagtgtgggcccagccttgggatgtgtgggggacagtaaaggccttggaagcaaaagattcctccttggaaccaccctgtcctctaccttgcctgcccttccacctctagctctgagtcctatcctgtcaccaagaccactgagatcctgtcagtcttctctgccctgagccccctctgctctgatattctctggctctccctgtcttctctctgtgtcttttgtctggccctttctctgtctccctcttcctctttctccttttctgtctctttcggtttctctctgtcttttcctctgctccctcagtgccccaccccaccgtaacttgccccaggcccctcttccctcctcccctaccttcatatgagaggttttctctaaggggaacccttgcatccacccacacatctttttccttctctttcatacctcttctgcttccttcctaccttcccctgtggtgtctggtgtgaggagggttcctttttcccttccctgctgtggtgtcccagcgtctctcagtgacccaggtccccatggagtcacctggaacacaggaggcccaagcctggctttcgtctctactgccccctgttgtcattgtgttctgtttgtggttgagtgctgtcctctctttcttgactttgtggttttttctttttccttccttccttccttccttccttccttccttccttccttccttccttccttccttccctttctccttccctctcttcttccctcctttccttccccctcctcctctctcctaccatgcctccttcactccttttctccttcccttcctttcctcttcctccctccttccttcctccctctactcttccctctcaccttcctttcctgtcttcccctctcccatcatatcttccttcctttccttcctcccacccctcctccctttcctctcctcttcctctcctgtgagctttccctttccccacccccacccactcttactcctttgtccccaccacccaccctgcctctcccctccttccctgtctctttctctgtctctttttccctgtctcttgctgtctctcaggtccacagcgtctcatactctacaccagtattgctgtcctactcaggtccttgactccatgaagcttaccccctcaggcaggctggcagagagcaggtaagagctagacctatcctcccccggtcctttcccccttccaaaccaatatgcaccatcattgccagacaccccccaacccctgccctgtgtcccctagtcccccgtgtgactgtggagtggttttttgaatgtgtctctggagactaaagaggacctttggaatctatttgtatgttattcttttttttaaagaaatccatcctaagaggcctgcctccatagctgggagtggttacttttggaatatgtggcatctgaaggatgctctgaagtaggaataggagactgccatttgggtagactggaaggatttttaggcagagagaagaatctgcctacattgttttcccgttaatcagaaatcttattctatatttctgattagaattcaacaagaggaagttttaacagtgatatcaaaaaagggaggtccagcagtgtggtgtcttacaccttggtcccagtactcaggaggcagaggcaggcagatctctgtgagttcaaagccagtctggtttgcacagtgagttcaaggctagctggaactacacaatgagatcccacctcaataaatgaacaaaacaaaatatcttgcatttaaaaggaagtaagaatggatagactatttaggataaattaaattatgagaccgttacatttcacagcccatgagctatttccatagaggcctagaagaaaatctgtagtctccagtgctttattttctgtggtgctgggaatggatcttaaggcctcccaagtgctaagcaaatacgcgatagtaatactataatactatagtcccagctgttctggggctgttattagggataagacgcaactagttactccccttaagaagctagaaaaagaacaacaaaaggaaaacagaatacactaattattgtagatgaagccagaaatcagtggaacaaaaaacaaaagttttgatcctctggcagatcagaaaagcaaaaattagtggctggtgagatggctcagtgggtaagagcacccgactgctcttccaaaggtctggagttcaaatcccagcaaccacatggtggctcacaaccatccataacgagatctgactccctcttctggagtgtctgaagacagctacactgtgcttacatataataaagaagtcttttttttttttaaaaagcaaaaattgtaaatgaaatacgattttttaaaagaggaattactatagattttgaagagaatttttaaaagttataagaaatgctgtgtgtatgtgtgtgtgtgtgtatttataccaagaaacacaaaaatgcaatttaattgggtgattttctaggaacacgtaaattactgcaattacctacaaaaggacaaaaaaacttgattaggatggaaaagtaaggaatacattgaaaaaactggtcatcttttctcttgagaaaaaatgccatgtccagttgtttttctggaggtcctgaaagtcctagcaattcttgcaaggttgggtaataggaccatcttcctgtgctgtaaggctaggtaggtaactagctgttcagtgacatacctacagtcccctggcctttcaagtggccgagacaagaatgctgcacttagggtaggtgtttgatgttagcctggggaatggagagagaccctttctcaaaaacaaagcagaacagagctggagatacagttaaatggaagaacacaaagctcttggtttttaatccccctgctctcaaaaacaaaacgaaacacaacaaaaaattatctatcagtgagggattatttgtttgttagtctgtttgttatctatcagaactaggaattcggtgcagagattttgtgcatgttaaactgagctatgtctggcatttcaggcatgtgctcctggtgtaatacatattttaatagaatattaaatagaatccagtagaatattaaaagtatatctttcttggcttggtggcataggtttgtaattccagcacttggaataaaagatagaggctcgaagatgaaggattcaaggttagagttggctacagaagcaagtttgaaccaaatctagactgcctcagacagacagatgaaatatcttaacaaataaaggctccccaggagtgcagggattgtcaacattaagaagcctcgggtctagagagatgacccagtgcttaacaatatttgctcttcctaagaacctgggttagattccccatacctacaaggcaactcacaaacttctataatcccacttccagggggtgccctctgcaggcaccaggcatgcattcggttcatagacatacagcaagcaaaacacccatatacattaaaataataattattataatgataaatgttaggaactctgctattgtaatttattacaatgtttttcttttataggaaagatcattttcatgaatgctagaaaatgttctgatatatttacaatatattctcttgctacaatggaataacttgttatgtagcaaaagatagctaggaattagtgaaattttccttaaatttgtaaaggtttgtttttatcagaaatcagagctcttttagctcccacctttcttactctcctttctagccctccttctctctctcctttcccctccctccacatggccatggccagcctctctctttctcccttctctccttccccctgcctttctacaataaagctctaaaaccataaaaaaaaaaagaaatcagagacaatcaaaagcaacaatgaaaatcacttaatacatttccattaaattcaagaacaaagtaagaatgattgttatcactattatttaataattttttgaaattgtaaactgggattttaaaaataatttttattgaatttgttatatgatgatttcatacatgtatatatttcattgtaattataaacaatggtatctaaaaagaaatgagtagtgtaaatattagaatggatcataattagtattatctgaagataatatgattgtctaatcagagagaataaaatgaaagcttccttcaataactaagaaattccagtgtgataggttcatacagggcaaatatgtactcaaaacattagcatctctgaataccagtagcatccaactaaatgacagaatagaaaaagatacttttgcagggcagtggtggctcacacctttaatcccagcagattcaggcagatctctgtgagtttgaggccaccctgatctacacagctagttccaggacaatcagggctgttacacagagaaatcttgtcttgaaaaaaattaaaataaaaattaaaagatgctatttacagtagtagaaacaatttacaaaatccctagaaatttatatgaaacagaaaatattttttgtaaagggctgtaaatttttactgaagccttgactacatcaggattatcttctatttgaggatgaaaaggttttcagtgtggtaaacaaggatattttccccaaatttgatcaaaatgttcaatgcaattggcatgaaaatttcaatgatattttctatggtattgagtaattgcattttgaagttcctttgaaaaggtatataattaagaaatttttgaaaaagaggaataatgtaggagatttatccattagatggacccaaaccttaccatagaagtgcacattaatggactagaaagatggctcaacagttaagggcactgtttgctctcacagagggcctgggttcaattcccagcacccacatggtgactcacaaccattccataactccacttctaagggatctgatgaccctcctctgaccgccacaggcacaaggcatacatgtgatgtgaaatacacataaaataacaaaataaatacatctaaaaagtaagactacagtaattacaaatattgtatcctaccagaaattgaggaatatataaatggaatggagtgggagtttagatgaaagcccatatgttgaaataggaagttcatatatgtgataaagaagatatttcagactagtgacatgtatgaagacatggttgtagaattacaagaaagaagtctggaatgttttaattatattcagatagtcttgcaatgtgaggctttaagaccctaagtagtatgcataactttagtcccagcactcaggaggcataggcagatggatatctgtcagttcaaaggcagcctagtctacagagtgagtatgtaggacaaccaaagctacatattgagaccctgtcttgaaaagacaccagcaacaacaatgaaaataaaacctattattgggacatgacagcattcccagatactcaggaaggtgaagcagaaggatttcgtgaggtcaggagttcaaggctaacaggggcaacgtagtgagatcccagatctcttcttaaaaacaaaacaaaataggagccataaaatagagtaatatttttctgcattaacatgtaaaacttcttctgtgtggagaaagataatgtatacaagttaagacataaattaacaaggcactagaaagtatccttactacatagacatcaggtaagatgttgctatctctgtctaaatctatatagttagtctcctggaagtcagtaagaaaaagatacccaacccattgaaaatggaaaattagggtgggcatggtagctttcaactataatcctaccattcaggaagctgagacaaaaggaactgtgtgttcaagaccagcctgtgctagagagttccaggactgcctgtactatatacagagtgagatcttgtttcaaataaagtaaaataaaatgttgaaataacatgatttgatgagtcaacaataaaatagataattgcctaataagtatgttaaccttatcgctggttaacaaactgaggtgaaaccataacaaactgtttttaggtacaaaaattttaaaagatcagaaggatagtgaaaaaaaaaaaacagagcctcttagataccttgattggcgtacggattaataaaggtttttatttgtttgtcttatggggacactttgtccgtttccaggagaatttctttccctttttggatttatgggctagtgtctggctgtcagcaccagctggtctgaaactcttgattctcctgcttcagcctcctgagtgatgacatcgcaggcttgtgatagtggctatcatgagcatgggaatcatgagtgtgtgcacattcttccaagatgaaaaccatgtcttggagcaacatttttctgaggatttagtgacagaaagcctagatagccagacagaaacctttcctaaaacatccaattcaaatttcaaacatgagctctattgtgaaactatttattaaatacccttgtagaatatcgccccttttaaaaaactattacttctctctctctcccccaccccctcatctctctctctctctctctccctctctctctctctctctctccctctctctctctctctctctctgtgtgtgtgtgtgtgtatgtgtgtgtgtatgtgtgtgtgtgtgtgtatgggtatatgcacgggagtgcaagtatctttgttattattgttgtttgttttgttttaagacagactctcactacatagctctggctgtcttggaagtcactatgtagaccaagtgtttgcaagtgaatgcccccggagctggagatctaggaggttatgcgcttctggtgtgtgtgctaagggtcgaattttagtcttcagcatgctcttaatacataagccatccctcctgcctcaaatgctactcttgaccaagtcttctaattttttaaaatttatgaactgaatgtatgtgcatgggtgttttatttgcatgtgtgtctgagcaccacttgaatgtttagtgcccactgaggccagaagagggcaccagatgccctggaactagagttagagatgataagggtgctgggactagaactccagtcctctgcaagaacaggcagtgctcttaaccactgaacaatttctccaaccctttgaccacctcttaattaaaaagttatataatgtatgccttaaataaagacaggatttatgactaacctttacctttacttagtctatacacttaaagcaatgaaaataacttttatcttcactttaaataaactatacattcttgggactggagagatgactcagtggttaagtgtgcatgctgctcttttggaatggagtatatctggccctgctttcagggagttctagtctagcaggcaggaaagaggcacagtgtactttggaatgagactgaattatgctaagctggctgccagaataaaggcatgtaactccatctggctcctgggaaaggcttcctataggtgacatttgtaatgagttgaaaaaacataataattctctttcatcctccttcatgatgatgccttgtctttttaactcttccaagcataatgacttcactggggaaaagtagttgagtcagtttattcaagttcagccttttccatttacctttctgtgactcggggcaagtcatttagcttctgggcctctctttccccagtctagtcatgaagctaatgcctacttgcctctcaaggctgtttttaggatcggggatggtatgtgtgaaactgcagggtggctgtcaactaaagactaggaaagactattcaggtcttgttttcctactgacaaagtgtgcaacattataaatgtgtgacaactgttctgaaacgaaggctggccctgaccatagcaggcaggatttggggaaagaggaggatacataaggagagcgtcaggtgcctggccttggcaggacctctgtgggaattagaataagaggtgtcttgaaaaatagaacccacgaccagaactctggtcctagttcttggtgctcttcttttgatgatactcgcttgtaattaattgtacaatccagagcagtagggtacggtataccactatttgctgtggtatccatggcaatctctgtccaaactctgtctcttgaacaacttcacatatctcttaatctattgtcttctttgttgaaaagaacagaatactatgaacaacatcatgaattttagtgactgaggaatagatgacctcattcaaatgagtgcattcagaattcatatcactgagtacctggaacataatgggtactcagagttgtggtcattggtacttatttcagtagacacttgggagtattgcctatggaaggtaatggttgttgtcttccctgaatccacagttagttgagggaagattgtgaaggcctgtgacagaaaagaaaacaagatgtagagggtagggaagctcaaaagaaggaatccatccctgtgtctagggctggcacagataaattcaccctgcattctgggtcttaaaggataagtaagaattagccagatgggttaagtactgaagaatattctagacagaagaaatagcatatgcaaaagaactggatgtttttagatagagcaagagagtagactgtatggctcccagataggcttcatgaggcccacgaacctcctgaaattggatcaaaatgctacacgtctataactatatgcacataattttatggggaagacagcttgtggctttcattgaatgtataaaggaatttgtatcccctcaaaaaggctgagagccaaaattgtttggtaacaaactatcacatgaaagaatctgaaatgagagtataacttgataaaaatttgtgttttagaactgtcctatcatcgtttcttggccttttggctaagatcaagtgtagaactgttctaccaccagtccatataataaatgaattgtggcaaggtggcacacacctgtaatcttagcacttgggaggtggatgcaggaggatcaggaagccatctttgactatatggagagttaaagttcagccagagatacagaaagccttgtctacaaaaagtggattgtgtacacagaggccagtgtgaggtttgactttggattgtcatagaaaacatagcatcaagtagttagtacattgcataactctggtgggcaccattcatttagaggcattttaacttcaaagtttggaatccaattcctttgagagttgttaataagcttcaatccaactgtttggtggtaaaactattatagatagcaaaggtgaggggcaggaggacagaaatgagtagacattaacaggatgacagagagcaggtaatagattagcccaggataaaagtacaagaagcaagaacctccattgatgctcactcacccactatccaaagtccttggtctcatacctaattactaacttccaccgtagtccttgttcttagagaccccaagtaacaccagagacacttattttcctctggattagagaacagggagatggagagagggagatattgcttcttagttgtgagtcacacaaagttttccaaagaaagtaacatctaagctagttacttaagatccataatgatgccaagagctaaagatagcttgttagtggtggtgcacaagtttaattccagcactagggaggcagaggcaggcaaatctctgtgagttctaggccagcctggcttacaaagcgagttccaggacagccagggctacacagagtaaccctgtctcaaaaaagagaggataaagatagaagatggaggatgctctgagagtctacacagagtttggagataagaaagaacaaataaaaatgttagtggagcagagtcagttgtctgggggagtatagggttgttatttttttcaagggggtagacagctggggagatttgatcagttcttgaataggaaagtgtcattatcaaattaacattttagagggaagggagatttgggaagaggctaatgcagtcatccaagaaaagagaaactaagaaagtaacagtgagcatagagaagaggagattgactgagaagtgattggcagaacaaagtaccagagtcagagatttggggagtgaagacagatggaggaggaggtggacatgattgagaatggagttcacagtaagagtcttcaggcttagcaatggattcacttattgaatgaataattactaaagcactattctaggcatgagcaatggagcactgagcaggacagatgcctgccctggtggatatgacaaataacaaatgacaggatgtgtgtggcgaaggggtagaggatgttggtgtaccttttaaggagttaactctttaatgatgcattgttgatcagaggcttgacggaagtcaggcagcaaagctatacacaaatttaagtgatatttcagatggcgtgtgtgtttgaagaacagtagaaagaatgatgtgatttgagaaaggttgaatgaggagcaaaaggactagaagataatgtgccagcagcgaagaacagtagaaagaatgatgtgatttgagaaaggttgaatgaggagcaaaaggactagaagataatgtgccagcagctgatgatatacagaatgttagagctatttcgaaggtaaaatgagcaacttccagtcagtcactctgacttgctaaggaagcaggaagaatcaagcttgtgtgtccaatctccaatgtgtaggccacacttgactagtagtagctatgaatttagtctaacacaaaatgtaaaacttgcctaaaacactgttgagaccttttgcgtttttccccttgtaacatgatcacacaattttgaagtataaactgtggaggtatcgtcatgtcaaaatgtcaaaaggttgggcctgactggcggggtaactccgagatgtattttgggcacaagtgactaggtgtcaagcaatagttttcactaaggtgggagatgcgaaaggcaaggcttacactgataaggttgtgggagaggttcctctagcacctgagggttggacaggatggacaggatggacaggctagcctagacccagaagaaagatctgtgctagatagaaccatacctgaagttacgaaatggaataacatcactaaagggaagcaacatgaaagagaatatgaaggaagaactggggaagaggtaacaacatgaagggtgggcccaaaaagaagtagagggctgggccagagaaatagcaggaaaaccaactgtgatggggctcaccaaggaaggaagtggccttgttaagagtattaaatcttgtggccaggaggagttaagtccagggtagaagtgaatatattgcttcaactatgagaaagtcctgggcaacctttctaaaaaaccattttccatgcagtgatgactgcaagaggcagattgcagtgggttgcagaactcgtaggaggtactgagatggagatggccagtgtagacacatttctcaagaagcttagctgtgaagaagaaagagggacagagggagatgtggaggcaggtagagagttttgattcccagatgggaaagacttgagtttctataaatgaggacaggaagggaagcaacaaagagggaacagttgagaatgtgggagaaagaagagatggttgttgtggctgagagagcagggatgggccccagagcccaggtggaaactggtcttaaatagtatagggcacccctctttctctccaagaggggaagtagtagtggtagtgggcatataggtgcattgagattggtaaaaggaatgcttcaagaagttcaaagaaatcaacaaagagccctgaccaagcacataaatgctagagccaggtagaagcaaagaataacctatgtctgggagtcagggaggatggctcttgggaagcagcatttgatcaggtgcatgaaattcagcatgaatagaaacagcaaaggcatagagcagtgaaaaggctaggcatacagatggaataatgaactcatttgttgacagttcagcatgagtgagtataacaacgtggacaccactggcaatggcagccataataatgttaccatgtgttaaacatcaaactatccatggatttatttagtcctaccataccctatgggatagatagttcttcattttgcagataaggaaaatgagtcccaggctggttaaggaatggatcccaatctactgaggtggtaggtggtggagctggtactggaagtcaggcctgtttgaatcaatttgtccagaaaagccaggtgagaccatatgatgagggagccttcaatggcaacttggagtcttaactttacccatcagacaatgaagagccaagatgagtatgtgagcacaagagataggcacttagagtgaacttttaaggtggcttaaaaagtaaggagaaggaggttgtccaagggagagagagaacgggggcctgcccttggtaataggaaaatgcacagtgagactggactgtcattcttttctcatgacgaccttaagaactatggcattttatcacattgtagagacgaggagtgggaaaccaaggctcagggctttgagacctggcttatgtgattgtgctgatttagtgtgtagaacagtgtgtcagagggatctccaggttggagaagggtgtgtgcatgtgtgtatgtgtattcatgcgtgtgcttgtctgccagatggaccacagtgccttcccctgcttgtcatctttcctcctcatctctttctgatccttttcttttatacttcttacattttcttaactgagtctgggaatgggatgttgccttttccctggttgtccccagaagacccacctttttacttctgaggcatctgatcccctcccagcccatacactccttggtattgtaactccactccagtggctgccaaatgcagtctggcctcttagaaatgagatttagaaacaattaacaaaaccacattgttcttgtttccattctgattgtttgctaggaatttgatgtcctaggcctcacaacagtcctgggcgttagaaccataagtcccattttacagatgagaggggcattacaatgctcaaggccacatatcatggaaacacttatgaagcctgggtctaggtccaaatcttcctctcttttcttttcttccctctcctttcctctccttttcttttttcctttttttttccttttctttctttcttttttttttttgtgggttctaggagtgtaacctagggcctttcatatgctaggctctatattaggctacatccctaacccatgaactcaggtctttttacttctaaagctgtgcacttctcatgctttatttataagcatcttcttgtttttgctgacctcgagtcttaatgaaatacaaatctttgtcccataaggacagagtgaaaggatggagtgtgagacctgaagctctaagaactctggattaaatattttatgcccaacttatctaatgtatctaaagttaagcatcatttctaaaatgatgcttttgcaaagttgttgtaggggttacatgagataatgtatactaagttctagcataaaacaggttgctattatttataggaaaattaaggttgggcaactgtcagagtcagaaattgtgtttctatactgggaaggtgaccctaagattaaggctgggttggggagggctattcctttcttgaagactgaattggatgtggccttggataatgtgtcacaccatttggacccccatcctagttcaacctcccagttctggccctttcatgtatctccccttctctgcaaactaatgtctctgcctctctctgtcacccctgcctgtggcctctaccctgcccttcctggccccagggaagaggaggaggaggaggaaactgaggaagaggaagaggaagacgctcaccagttctgctgtccggcctccgaatgcagtagtccctcctctcggtaactgagaggacaagggccattttctatgcagaagcaaaagccttaaccagcccccacccctgcctctatggatccctcatgggaccctgtcccctgcttcaggaaccagatgggcaagcatcatgctcttacttccccaacctccttcttggaattcctccctacccctgctgtctcccctaggctctagtccctgaattaaagagctagagtcctagattttactaatttgtgggagaagcagagcttggagcttgaagcttgcaacctggaccctcttgcccccgtatacccacttcccaggcaccctggagcttgttactactggagaggtctccaaatgacaccccaaggacctacctctgttctctgtgagcacaaacagagatgcagggtgcctagggctcagaggaccagacgggagcaggaacccagcctgcctagttccccgtcactcattcccttgctgtggccatagctgccatattttgtccactgcttgaaggcctcacctcataccctctccccaacccctatcactcccatagcgctctgtaaacatgattaggaggaaaaggcctttcagcatgtgtgttgctatgtataaagaaatttccatcaataaaagctgatctcttctctctgtctgatgtatgttccaccctaccccatccccctgtctccatccccaccagaactttgccttctttcctatccaaagctggtaaagggctggaagacagagtagggtttgatttgtggcttgtcaatgcctcaaagtcatttaaaaaataaatgtgtgaatgtctcccggcaggagcacacctattaccttctttagtgccctagcctggggcatttttgaactagctaatcttggacatggcccttgacttctgtaatacatagtttactcacctggaaaattggtagagtgctttgaccagggtcaccagaattcttccagcgctgacattcagaatctgagatgctactattttaaaaagctgtaattatgagctttgaagatactatgattctgggacaaatttcatgcagttctgtgagttctctttgtacagtgctatgatacttggattccccaatcctatgattttagatttcataattctaccacttaaaaatctgatgatatgattttaatattctgtgatattaggattccttggttctggtactgtaactttaggatctccaagaggaagccattttcccaacaaaactgcaaacgcttccttgacctggctgaaagctaagactctttaaagcagcggtctctcatcggacatttacatcatgattcataacagttgcaaaattacggttctgaagtagcaacaaaataatcttatggttggggttcaccacaacatgaggagctgtattaaagggtcccagcattagaaaggttgagaaccattgcttttcagggtgctcctgggagagaagacagggcccgttgtgattttgtgctcctccatccatgatgtgtttatgttaggaaatgggaatgtgggtggggagtggtagggtccggggggcttgctggaggaagatggataaaaattgggtctcagatattgggaaagatttgattaggtggcaagaggcaagaagacatttcaagggatagggtccgtagagggaaaaccccactggtgtgcaccagggtcaagttggggaatggcgagtaattactgtgctcaaatgtctctccaggatatgtgagtctaggtgacctgcgaccaggagaacatcctctatactttatttgagtggagatagaaggaagtgggcaggggttaactgaataaaggaagaaggcaagtcaagaacacactgtaagagtgcttgacacctgtgcaggcaactgaattggctggatcagagtgggttatgctgtgggaagggagcagacctatatctgtggtgagaaaaatatgcctccatgtgtctgtgcgtctatgggcacatgcatgtgaggctagacgggtctcacagtagtgaaagactgcatgagttgttgctgtatatctaaggaagtgtgactatgtgagccaaggcttgaggaatcctgagaatatgagatttctgtgtgaagtctggctttctgcacctgaaagcttctatgtgtgtgcccagtgaatttaatcacaaggataggagatggttggcttttaaacatggggctcttagggtagcagttatcagacagatggtgacacacatacagacatgttacctgtagatttaggggacaggttagctgagcaaggtatgctaggccctgacctgtgcatggtagctccataaaagtgaatcacagcaagccactactcttggaaaaccgatggggtgggggtggggtgctggagagatggcagcggttaagagcactgactgctcttccagaggtcctgagttcaattctcagcaaccacatggtggcttacaatcatctgtaatgggatctgatgccctcttctggtatgtctgaagagagttacagtgtactcatacaaataaaataaatcttttttttttttttttgtataaaaggaaaacagatatggggatcaagagtgggcaatgcatatttcaagaaagactggtgataagggccaccatgagacgggtgagcatgagacacagaggagacagtacctgatcctgttgggtgctggtgggctgagagtgagtcagaattctcttggctggaggttctgcctgttcagggtatacaaaatgaagatgagctcatctgggccagttaagtccaagggtaaaaaggagaaaagacattttggacaagaaaattaaagcaagtctttgaatgcaaaaaggtgatggatacgtttgctatatgggaattgcaagtagcctattgttgttccctgtttggaacatattgagcagagcgagagacaataggaagtggtgggcgtggcatgggtatttgtagctcaaagtgcaacttttgtctaggagatagggaagtttttgagagaaagatccttttgatgcctgagctccacttgcgtctatgggattggatggttcttaatacttgtttgcaaagttcactccaactctgtggactgaacaaatccatgaatcattgttcttaaatgcaggagctttttccatctaacttcagctttcctgattcctcacttactgctccacgaatatttacctcagggtctagtccgctgttagtccgttgtgtgccactgtgggaagaaatggagagatggttagtcaaggactccacctcgggaggggacaggaagagcaggaacttttctatgcagactcattgtttcatgtgtgtggaaatggggatcaaaccccaaactggagatgctaggcaaatgctctgccatactaccagccttgtatgctcagatatgttttcttttcagtcttggctcccctactacttagttttgagaccttttgcaactgagttcatctccccacctacgttgtatctctttcagtgagaaaagcgggactttgcccagttgctaggcctggtgaaaagagtaaattaaaactagtatttttttctagggttgcaaatgagcagatccaggattccaacccaggctttgggctcccagaatctgctttcccactgtttacctggttagccctcagttgttagctaatccaggctggatttgggattggactttatgtgacactggattggatagcaaaaggccctgctcctgtcgtcactctctctgtcagctccagttttcttgcctagccttttacttctagaacttaaaacccttggttcccatctacacaccctgacccccttgttttcttgtatcgcacttctagtcccttccctttccaacctaagttgtcatggggatagttttcagcaaccttgctttcctcttgccctcatcttatggtatccatagcaacagtctccattcatttccatggcaactgcattctgattcccattcccaggctgaattcttggctctgggcagtaccaataaaaagaaggagggagaaaagacctacacacacacactaaacaggagtagcatctgggaagggtctatgccccaccctctgtcatgggcagactaacctcaagtgtctagaaggcagcctaacctgcttcccccatcttagagccttggcttacaaggttgctctactctcatctcacctagctcctcctaggcaaagtacagtccatgagcttcctctcccaggaagacttcaagacagcaggagggccagcacaggctttgggtctgaatccctaccctgccagttgctagctctgtgacctttgtcagtcagtttcccccttagagctcttttcttcctctgtaaaacaggaatcctaattttttccttgtgtttgccatgcagattaaataatgtgtggaaaatgcctgacacagggtaggtgcatagtgaagtgccagtttatttttattctgctcagccacccccaagcagaaggaatctctctcctttactcccccatcacttcctgtattccccaccctgataactttccactttgttctgtggttatttgtgtagcatggcttattttccccctctgcaaaggatgctctcatttccccctaaagaatagtcctgcaggcaatgtgtgtttgtatctacatgcattcatgtctacttccatgtgactatggatgtgtatatttgtttctagatttgttggcctttgaatgtgtctgtgatattatacttgtccatatgtgggggagggttccaggtgattggcctgttactaagtgttttacgggctctgacatgaggggttcctgaagtcacagattcttcagtggtatgtatgatagcaaaaccatcccctcaagcaatctccttgtttttggccagtctctcccatgggaggctgtgctgtcaccctacaattcctgtgacttttctctttgcaatcaaaatggggcaagttctcaagagaggaattaccaagaagtagaaagcctagagcagcacagggttgggagagatgctgagatatcattagtgggtagtctgagctttgagtttataatttggctttcttacttaatagctatgtatgaccttgagttacatttacatcaactctacttcacttcactataaagggggctaacagtgcctgttacaaggaattgcaaggggcagagatgactgcagagccctacagtaacatgaaggaggggcatgtatgtaaggcaacatgtgcgaaggaggcaagcagatgtggaaaggcacacctgagctaaatgttgaagtgtgagcagaaggtagttaagtttaggtgtgatatagggttcaggccaggtaaggaagctattgataagttaggctacatccttcttatgttcgtctcaatcagagcaaaagccaaagtctttatgataggctcagcgtcccttgtattagtctgcttttgttgctatgataaaacatggatcacaagcaatttggggaggaaaaggtttatttcgtcatcaggaatgtcaagcaggaactcaggacagaaacctggaggcagaaacagaagccaagaccatgctgcttactgctgtctttccatgctttgctctacccgctttcctgtacaccccaggaccacttgcccaggatggcaccatccacagtgggctaggccctcccacatcagttgacaatcaagaaaatgctcacatacatgcccacaagccaatctgatggagacaaatcctcagtcgacgctccccgtttctaggtgacagtatcttgtgtcaagttgacaaaaattaactagtacgactctcatttcatgtctaatcttatttctcattaccctctcttgttcactgtgttctgtctatattgggtttttttatggattcttaaacacgtagacatgtactgactctactctctagcctcagacagctacacagctcactccctcatttccaccaggattctgcttctgtgtcattcccctcaaccacagttttcctggacatcacatctaaaatagcaaatttggctggatttgtagctcagtggtcaagagcttccttagcctgcataattttctgagtactatccctagtctgtctctgtctctctctgtcctctgtttctctctctctttctctctttctctctctctcacacacacacacacaaatgtgcacacacacaatttaaatggtaccttttaacactgcttttttctatcttaacatttatttgaaattcattctctctctctctctctctctctctctctctctctctctcctgtttcctttactatagcatcaccttcctgaagaaataatttggtggctttgatttttactgtatttttggtgcttagtgctgatacatggaaaggacttggttgttgtttattgagtgagttatgggaaactgtggcagggttagatgagaaagatgggctgatttgtatgttccaacaagctctctagccacaggatagagaagagatttgcaaataagcctgaagtttgtggtatacatttgagtgacagttttattagagcagccaccaagaacattcactaactcgcttataccagagacacctactgtggtctgatctaggccccatgtcctgtgccagccagagagattaccaaattcccttcctatgctggggtactgagagtcatgtactctttgctgaagctaatcattgccagaagaaaaaaaaaaaaggaagccatttgtaaagatagggggtctgaggaagatcagctgtaatttctggctggtggcaagattcagggggcatctcagtaggggtatatatataccttgaatcttaacagaattagcgtgtggagcatttctcaggttgcactagcagaaatgatggggatagcattgggagtaggtcttatatgagcagtttggaaggtaggggcctgaggaacatttgacagaaacagaagctgggctgggtgggtaagattagggggttgcttaatgattgagggcgtgaactctgaagtcactctgcctggagttgaatcctgcttgtattgttggtagctatcctctccgggctttgttttctatataaaatgaagacaaataacaaccttatagcattgttggaaagaacaaccaagttattaagtacaaagtggtaagaacggtacctaaatattaagtattctagaagccttgtctgttgaaccttgagaggtcttcaatgccagagtgattggagatcggactaacttgcagacagtgagagccgtggatgttttggacatagaggagacagttgctcaaagctggatttgcaatgtgtactggtaagggaaatgttggagaggttgctgagcaggattccaccatcctagggaaacaagaggaatgtctttgatgctggactgggctgggtctaacctgtggagggtagcatcaggggcctctgaggtctgagagaaaggaaatttagggtgcacagcagccctctagtctcgttctgactagtacttggtagggtggagaataagcagtgactgagagttcccaccagggcagagcccagctctactgcccctgacctccagcacaaagggcagacagaccacagagagcacaggcacttctgccagtaggtaaccccttccacccacccagcttgcccttgccttgccccctggcctttctcaatagaggtggaggagtggccctttgatccttttactagccaagagcctcccctcagcctatattacttccctgatttaaaaaaaaaatcattcttttagccccagccacacccattctcccacaacctcctccatgcctcagtcttcctggttcaccccacctctgtgcttctcaacatgccctggagctctgctgccacctgggttccctggcagcctggttgccatggcactgtggagcaggtctggcagaacaacagctctaggtaaccccagcaggcaagacctgggacccagctcctgctacctttctgcttgagagccccctgccctcctcccggagcagagcagaggaggacatgaggagaaaaaggaagcttccccgcagggcagctctttacctgtgaggatgctgaatgggaggcacttcccactgtggcccagcctgtgccttcaccctgccctctcaccaccagcagcagcagcagccgcagccgcagcagtaacagcaagagcagcagcagcagcagcctgggaaccctgggaactggccaggcctggactccaggctgctaagggcaggggcagggcacaggggcagggctgggtgggggagggaggacctggatgggcaggaatcaccaaccaggtctgggaggggggcaatatgtcaaggaacctggtctggggttgttctgggaataggactataagggaaatcactgcatggggttatgaagaattagctgggtggagaagagattcagggagggagcaactaggccgtcaggggaaggaagatttgaggctggagctgctagggacaggagtgggaggagactaggagtaaagttgtgactggaccagattgtgaggggtggtgggtaggactgaggacaaaactgagaagacactcttgagggaacagtgtctcagaagagttatggagatggggctctgacgggaagggactgaaagggaataaagaaaaacaagggcacttgagtgaatgaaccgtgtaggcagtgaagagacagattaaaggtctcttaaatgttggagtctctaggtatctgaggaaatgggagaagatggggttgggggcaggatctagtgtactcactcagttgggcctagcaagcctctctcctgttgccacatcctggctcattttatctcctccccacagtgtggagggtgatgccccaggcagtgacctgagcacagcggttgatagtcctgggagccaacccccctaccggctgagccaactaccccccaccagcagccacatggggggcccccctgccggggtgggccttccttgggctcagagggcacgcctgcagccagccagtgtcgccctgaggaagcaggaggaggaggagatcaagcgctccaaggccctgtcagacagctatgaactctccacagacctgcaggacaagaaggtgcagaggagatggctctggttgaaaaatgggagtgggatacgaagagaaggagggaggttggggtgtggctcttgagggtggtattcagggagggacagtaaggctggaactggcgaaaacaggctccagggcctatcattgtacattcactgcatatgcactgagcctcctattcactcggcaaacatcgctgagttccaataatggggtccagactttaacaacatgcactctaagtgggaagcgcacacacagaacttgacagtttcacagtatgatgcaatacactgtctaggggtataatagagagagaagggagggagggggagggagggaggggaggacattacaccagatttaagaaaagtagaacttggaagggcagttatcaacacattagttatggctatgcctagatgtttggactgtaggtgaatcatccctcacccctcccttctttccttccttcctgcttttctctcttactgattctttcttcttccttcagcttcctcctcttcgtttactgtttccttcctccttccttccttcctccctttctttttcttttcttttttctttcttttttttttctaagtgttttctgattttaaatatatttttcccttgtgtacatcttgggattctaagtgagaaaacactgggcacagagcctgtcatgacttccagcagttagttgtgacttgactgggatatggttgaggctctggcaactttctgaacttgttcctctgacaggtggaaatgctggagaggaagtatgggggctccttcctgagccgcagggctgccaggaccatccagacagcctttcgacagtaccgtatgaataagaactttgagcggctgcgcagctcagcttcagagagccgcatgtcccgccgcatcatcttgtccaacatgcggatgcagttctcctttgaggagtacgagaaagcacagaaccctgcatacttcgagggcaagcctgcctcattggatgagggtgccatggctggcgcccggagccaccggcttgaacggggcctcccttatggaggctcctgtggtgggggcatcgatggtggtggaagttcagtcaccacatctggagagttttctaatgacatcacagagctcgaggactccttctccaaacaggtcaggagccctaaaaggggcttttcttctccattcctggcctctggctgcttctactgctttttaaatctattttccaaagtataagaagtttcgctattaagcacttaacagcaacaaatggcagtgatttgaactgagacttggagagtagtgagagagaattattagcacaagaaagagttacagctgagtgtatacttgtaattgaagcactagggagactgaggcaggaggattgggaacacctgtgtcaaacaacaccaaccaaccaataaaaaccccaaagacagggatgtagc

SEQ ID NO: 113 - DNA, 60411 bp, mus musculus; identical to SEQ ID NO: 112

SEQ ID NO: 114 - DNA, 160171 bp, mus musculus
cgttcccctccccgcgcccttttccgcgctccctcctggtccggcccgcgtagcgctttccaagttgcaaagcaagttcagcggtggccggcggctactgtagtggcggcggcggcccagccgcctggaggctcctaggtggtgggccggttcgtgcttcccggagtgcatgggcgtgggcattagcgggtggaagggctgagtgtggaggggctgagcgccccgcgtcatggagggcgccgagccccgtgcacggcccgagcgcctggccgaagctgaggcgccggcgaccgacggcgtccgcctggtggaggtgcagctgagcggcggcgccccttggggcttcaccttgaagggcggccgcgagcatggcgagcctctggtcatcaccaaggtaaggctaccccggggtctgccccgtgacagtcctgagatagtccggacccagaaggctggtcggggtttcagggcgctggatgggacgtccggttcgcggcctcgttttctgggacgcgtctgttgggagtcacctgtgggtgctgggttctgttcagccataggtgtgtggttccggctccatcctagccgccctcgggcggctcccaacattgctggtagtttcaatggctcctgttccgggtctccttcccctccccctctgggaaagggcctggcagtcccctgtaactcctggcctgtccagcggtggacctacacctgcgaggctgccatgaaatgaagggaaaaaaaattcccaggaaccagggagtgggtacagctttcccaacttttgtttgcttgtttagggcccctggttgtcacccttttgatctgtaccggttttcagtctgaaactccctactagaagctgctgccaggcagtttcacgattcccaggagctcatcaatatttgctgactttcggcttcctgtcctacatccacgcgctctggatatctaccaacacttaatgaaactttttcagagtgcttttaaagtagaatttgagttctgatagtaagaaaagagatcttacttggaattaacgcgtgtgagtgtgtgtgtaggttgctttagaattggtattctcttaaaatgcaatctatcctgatacttaccaactaaacatgtataaacttgtataaataaacaacaagccaatctctcaggtgttctggttaaaagaaactagggccctgttctctaagcagagttgagtcttaccagtcctaaggacaaagtctcctttaaaatgcaaatattcctggctccttagaggtgtttgaaggtgtgaaaatgacttacaaatttccttatcttcccacccggattaaaagcgtgaagaattaggtggctccactggtcttgactttgaaaagtggtgtggtgttggcggcattcaaacagcaaaagacctcaaatcgatcaatcacccctcaccctgttacaaaattagccaccatgtaatcttttatatcaaagtggattcttttttgtttgattgtgccattccagggaatccaagccccagggcattccacatgcgaggaaagttctgtaccactgagctttataccaagtccgagtctgatacactcactccccttttttcttttcagtgctaggattgaagtcggccttggcagtactaggcaagtactcttctctcactgagctatctacagcccttatttttatttttatttttatttttatttttatttttgagacaatggctcactaagtttcactagcttgccttaaagttgcagccccccccccccagccacccgagtgctagtattacagggctgtactaccacagagaatctcatctgtggctctaaacaaatacttactggtgtttcttgtgcattgtgttttgcctgcatatatatgtctgtgtgacggtgtcagatcccctggaactggagttgcagacagttctgcactgccgcatggatgagtgctaggaattgaacctgggtcctctagaagagcagccaatgttcctctgtgccttttaataaaggttttcgaggtcatttctgatgtagttaaaaatgtatcaggtacatctctcagttctttcacgcttcactttttttttcagctgttgtttgtgttgtttgtttcttctttttcctcctctgaggcactcttttgatattttatatatatatatatatatacccggctaaaattttaggatttttaaaacagtatgtgtgtatatatatatatatatatatatatatatatatatatatatatatatacatgcatatatgtgtgtgtgtgtgtctcctctgcaacaagtattcttaagcactgagccatctctctaggccctagcatttgggctttcactgtataagaaaggtggaggttagccgggcatggtggcacatgcctttaatcccagcacttgggaggcagaggcaggcggatttctgagttcgaggccagcctggtgtacagagtgacttccaggacagccagggctatacagagaagccctgtctcgaaaaaccaaccaaccaaccaaacaaacaaacaaaacaaaaacgaaagttggaggttattttaaatggaaagatttgctagagggatttttgtgctcttttatatcagatagtcctggctcgctctcagctttttagaaatggaagtaggtgctggtcaaactcagccatgctaagctgaactactgagctatattctcacctatgcataattttcacatttcattataactgaaaatttataggtttgttgcttaggatgaatgggactcagaacaacttggggtttttgtatttccatgtacacatagacattcatgtactgttgctcctgtgtgcacatgcatggacttttaccacatgttctattgtgtagaattaacagtatttcatctacttgtcagttctttactattaagaatattagtacataggcccagcaaggtgactcaactcccttttaaaggcactaagcctgatgacctgagtttggtttctggaagccacatgaacaccatggtacacatacagtaaaagtaaaaacaaaaccattatcagtgctgtttgcttacagcatgaaatctggtaattatttgccatattatttaaaaatgacaaagggctcgggagagagatagctcagtggttaagaacattggtggtttttccagaggactcacatgcaatttcaagcactcacatggtgacttacgacttcggtaactccagtcctagaggatctgacaccttctggcctccacaaacagtggagcagatatacattcagacaaacatttatacatgtgaaattcaatctcaaaaaaggatgaaggaaacatttttgtttacagccaattaaagttagaaatagactgctctgtagttactagtggaaaattgtcacctggaatttaatctaaatttttacttttctagtagctattgaaatgttattgtattgaagcatattaaatatgtttttctgatagtcctttttccatttaaaaaaatctatgcaatagttaatgttggatccttggtataccacaagagctttctgtttttctgttaattagaactatattatttttatatttatattatatattcgttattttaattctgtttattaataattttctgtttagctgatactgatttgggagtagcttgatctaatttaagaggacacattcttttgataataatgtgactatcatttgaagatcttatgagcacatatcttagaactgggaagggctggagatgtgtgtagctatacaagatgcagagtatgatcttcaacatcacaggacaaaacaaaactagaagagatggtaaaaaccaggctgatttagtcctggtttttaactgaagaattcttattggcccattttgtggattgacagctatgaccaagtgagggtaaaatggtggactctgaggtcacagacatggcaagttctgcataggaccttgaaagtcagactctgattgtgaggatctgtcttgcttcctgtccagcagatactatctgcttgtgactgaactcccttgctgtgttatttatactgagtaactcgatgccatctgtagggtgacagtttttccatcttggcaccattgatattctgttgtggggtcttttctatgcactgtagtccatttagctgcttctttggcttctacctactgaaggccattggcacatgtctccaggtatgacagtctgaatgtttccagacattgccacatgcccccaatctacagttataaatcatttattaggctcctagtgtgtcactttttcttttaaagactggatttttattttttattttttaaaatagtggccttttggtggtgtgtttgaaggcacttggcgtttccagtgttttcatgtaggtctgtttttctttttgagatgagctcttggctttgagaaaaggctttatttacacagtaaaatgcaaacaaggacttgcttcatctgcatttttgtagttggagaaaggaaacagagcagagactccccagaactgtgtgcttcatgggcaatcaaaatagatgttggagaaggtctgagttttctcaggagccggtttgaagttaaaggatgttaactttccctgaaaaaaaagtaagagcctttgtagaatttcagatacaggcctgaaactcaacaagacctctgctgaaggatagcgttaggagtcataacttctgagtatatttataacattgcagcttgaattttttctaccattagcaaacaaacaagcaaaacgtgtgtgtgtgtatgtgtctccttcactaaaaaaaaaaaatgaaaacacattaaacttcattttttcattctgatattgtaggaaaaacaggaacaacttgcagtttctaaggtgtcatgacttggtaatactctttgagagtattcatgtgttcagaaattctcagggcactggaatatcacacagttaattttctatttagttggtggtgatttgtaagtgaggtgagccattgggttgttgttgttccccctgcccccacccccacccctgcctttttctcccctaaattatggaaacagggctttgcaagtgctctaccactgagtgacattcctaggcaagtcttgctggtgttacttgtttcctctttcaatttagccactgagaatttcagtgggggagaagagcaagctcatttctatgatgtcacctactggagagttgcatctgccagctgggtatcaggaggccccctgcaacctcaggaatgtttatcacggaagaaggaatgaagcactggctattcatcttttattaaagccctccttccccccttaagaatgccagaaattgctaagaacacattcatcagggcctgggctagcttgaccttcctggcaagctcctttgaaaacctagttttcaaattgtctttgggaaatacaacattcttgatgtgcgtgtttgtgtatgtgcactacagtggtataggatacttggaagtgttttatggaccaggacaagcagttggtgatgggtatgtgtgtgaggtctactgtgtaacaataataccttagcgattgagaaaggagtttagaggctgtgtggagttaaggtcatggtggcctgagaccagagacgttaaaacagtagcccaatggttgtcccttgtacccttttgtgttgttgatttttttttgtttgtttgttttgtttgtttttttgagacagggtttctttgtatagctctgactgttctggaactcactttgtagaccaggatggcctcgaactcagaaatccgcctgcctctgcctcccaagtgctgggatcaaaggagtgcgccaccacacccggctttgcaggttctttttttaagttttatttttattttatttacataagtgttttgcctgcatgtaagtgcacagaatacagtgtccacagaggccagaagatagattggatcgagaattacagaaggttgtgagctaccatgtgggtactgggaactgaacctgaattctctgcaagagcagctggggctcacttgagtcatctttccagacctcattattgagaggctccatagagcccaggtgggcctcaaacttggtatacagagaaggatgacttaaacttcttgtcctcttggctccagctaaatcttttacagttctatgcctccacagctatggggtacggtgctagggattttgagagacaatgaggtactctaccatatgagtcccatccctaccccctacatttgattttgatttgatcaccaagctggcctggaaatctgtgtcaaattacttgagtctgagtgctgagattatgagtgtgctactatgcttaaggggtttttgttttttgtttttgtttgttttttgttttggtggtgctggtggcggtggggttgctggctgtagatccagagctttttaaaggcatgaagttctagttgaagttttgaaagtgggactcattgaatttagcagtggaaagataaatgtgaacttctgtctggatcttggttcacttctgtgtgccacacagttcacagcaggccaaactactactctgttagtgtttgagagagcttgggtcacctccccacccccacctcctcacactagggtgctaaggttctataagtcctcagaatggtaaaaccctgtctctatgcagtggcagtcacagcaggatttgcagttattaggatgagtgtaattctaaagatatatttgtcgtgaaaattcagagtctggttaaaaacactaggtaagttttctttcctgtgctgaaaggccttttcacttgggagacttgccttgccaactggctttcaaatatatctttattaccccttccagcttgcaaattaacttggccttgtggaattctaatccttgttccttcagagatgttttaggcacagggggtggggagccaggcacaatgtctaaagatgtagtccaaggtcttatagctggaggctttcagcttcaaatcacggaggattctctctatgggaggcactagagtatgtgactcacacctataaatccagaggcttccaccattacaaaaaactataaacctgagctatgccccacacttctgtattgtgctgaattcggtcttcctggctgaggtaggagtattgcttaacatgtcctaacatttatctcttgggaaaataataaaggtagaaagctagtttgcctaagagctacatgttgaataataaatagtagttttcacttggacataatgagatagtcttttgttttttctgttttttttttacttgtgtatttcatagttctttacttaggaggactttttaaaatgcattttggaattatttccttgcagaagttgttttgtgtcagcatgcaaataggcttggatttatggcccagctcttagaagcaaaggaggaaaagtcctggggtctgttttctttgcatgccaggcaaggaggaaacattcaacaagataatttcagggtataaaggctgaatgggctttttattcaggccatcttttactttcagacactagaaaggtgtggggccaaggccttataggagaaattgtacagtatttggaagattaggctcttttgatatatgtgtgctgagaattttaacccacaggaggattctgaaagagttctattaggactttaaaacatacagctggatgaggagtgaggggaattggtggtccctgaagataagactcagctttctttttttggtttggttttttgagacagggtttctctgtgtagccctggctgtcctggaagtcactctgtagactaggctggtctcgaactcagaaatccacctgtctctgcctcccaagtgctgggatcaaaggcgtgcaccaccacgcccggcagctttctttttatactgaaaaatatttttcatatagtatattttgattatgtttccccccccccaatctccaactcctcccagttccttcccacccctctacccacccacctttatgttttctctcttaaacaaacaaaaataaaacataaaaccagacatacaaaccaaaacacaaccagaaatcaaaataaacaagcaaaatacaaataaggcaaataagattcccatcccagatttgtttttatgtttatggaaatagctctttggtattaaagtttatttttttcattttttttgtttgttttttatttttggtttttcgagacagggtttctctgtgtagccctggctgtcctggaactcactctgtagaccaggctggcctggtactcagaaatccacctgcctctgcctcctcccaagtgctggaattaaaggcgtgcacatgtgccacaactgcctggctcagatggttgttcttatgtactctgaattacccaggtgctgaaggtaggccttttgtatactaggcaagggctttagtataggttttccatgaccaccagtgaggtacagtaccaactcttgaaactctttcatttatttcttatccttaaacagtccatttatagatgtcactctagtttttgttgcttttcctttgcactatagactaggatttagtcttgcctctgcaaagactcctctgctaatctttcatctcccaactccttgggcatatttattgtcttttcttccattcccagtgagtccataattttggctacaagaatattttttcaacatggacattattgatatttggggctaaattattctttatcatgagatcatttgtgcaaggtaggatgtcatcttaggctaatcccccctcagtgacagctggtgacagccaaacagacccccagatattggtagatgttttttgtgtgctggctagttttttgtcaacttgacacaaattagggtcatctgggaagaggtgacccgtgttgtgaaaatgcttatatccgaatgacatagaggcaagcctgtggtatattattctgattggttggttatttgtgggggagggcctagcccactgtaggtaatgccaccccagggcaggtaatcccagggcttgtgtgagaaagtgggctgagccagcagtgggaagcaagccagcactcctccatggcctctgccttaattcatacaagctccaggttcctgccctgacccctcttcctacagcactaatacctataagatgaaataagtcctttcctccccaagtctcctttgctcattttgtttatcaataacagaaaccaaactagaacaccctgaggactaggttaacaattttcagtgcttatattattttatttatttatttatttatttattttttactttgtggtggtagaaatagaacccagagcctcatatattctaggttaacatctctctcactgagctatatcttcaattgcaaagatttttaaagcttgctttctatatttacttttagtattttgtgtgattgatgatcaacttagtgctgtatcctatgcaagtgttcccccactgagttacaccctagtcctataatttggatggcaaatgatgtcactgtttggcctatgggaaggagactacaggcacattgtgattatttttcatctataagattgcacttgggctggtagtggtggtgcactctggtaggatttgctgaaggaggcagaggtaggaagatcagaagtttgaggccagcccaggctacacattttacaaaaaaaaaaaaaaaaaaaaaaaaagccgggcattggcgcacacctttaatcctagcacttgggaggcagaggcaggcggatttctgagttcgaggccagcctggtctacaaagtgagttccaggatagccagagttacacagagaaaccctgtcttgaaaaaccaaaaaaaaaaaaaaaattgcacttgggaggcagaggcaggtggatctttgagtttgaagccagcctggtctacagagggagttccaggacagccagggctgttacacagagacactctgtctcagagagaagtggggtagggaggggcagagagagacagagagagagacagagagagagacagagagagagacagagttttatttcattgcttaatttcttctgcagttgttacttactgtaaattctcagtggtggcacatctcttcttatatttttatacacaccaaagtagcttttcttcactttgcaatattggggttatcttgccactctggtggtcacagttctccgttttctgcagtgcaatattatagaaataaggtcagacatttctggtttatgatctgttagactttctctattttttctctcttatttttcatttacttgtgattttgatcttgggagattttgtttaaccttatcttccaatcttctttttttttctccaaattccaaattttgtttcagagttgttctttttgttgacaccatatggattttttttcatttcttttctttcttttttttttttttgattaattcttttgtctaataatactgaggcggttttcaaaactatcaactttccataaggattttgtttctggagtcggcttttattagttgtctggttttctctcttccctgacagaagtttctggtggtctttggacatctcctggcattaaagaacagattgtttgaattacatatactgtgcatatgcatgagtaacccagtgagactgttttttttctgggaaatcttggaagtccaaacctcaggttgtttcttttgagagtggtcatatccttatcatatagtaacttttgcacatatttttgtgtagagtggactgcaaggtggaaggctaacaatagaagagacccttcccttgctcagctgagtgaacaagacagaagagtagtcgtgtcctgtactctagccatagtggttccagcttgaaggaagccaagccatccactagtaataagttgtcaatgcctgctggtgttcacagctagttctttcacttggtccttagcctttttaactctctatcccacagtttgttaaacttagaatcatttctgctttattgtattactgtaggggattaaatgaatcagcatgtaaagcgagttctagaattcattctcttcctcctctcccctcaatccagattcattataaaactgagaaattattttgtttttgtgtgtgtgtgtgtggtctgtctttttgttttttaatgtatatgagtacactgtagctgtcttcagacacatcagtagagggcattggatcccattacagatggttgtgaaccaccatgtggttgctgggaattgaactcaggatctttggaagagcagtcagtgctcttaagcactgagccatttctccagcccctgagaatttattttttaaaaaactgtttatgtatacttcttagttaggggttccattgctgtgaagagataccatgaccaaggcaactcttttttttttattttgtttttcatttattattttctttatataaatttcaaatgctatcccaaaagttccctatacccacccgcccctgccctgctcccctacccacccactcccacttcttggccctggtgttcccctgtactggggcatataaagtttgcaagaccaatgggcctctcttttcagtgatggccgactaggccatcttctgctactcttataaaggcaactcttataaaggacaaaatttaattggggctggcttacaggttctttttgaggttcagttcattatcattgcaggaagtacatcagcctccacacatggttgctggaggagctgagagttctatatcttcatccaaaggaagccaggagcagactctcttcaggcagctaggaggagggtctcaaagcccaaccgcagagacacacttcttccaacaaggccacacctcctaatagtgccactccctgggccaaccatatttataccaccacagtatcaaagtacttttttattatagacagaatttgagctggattttgcatagtatagaaatttaatatgtaccaaggtgattttttaaaaatttatttattattatacataagtgcactgtagctgtcttcagacccatcacaatagtatgtcagagctcattatgggtggttgctaggatttgaattcaggacctttggaagaacagtcagtgctcttacccactgagccatctcgccagcccccaaagtgatttttatactacttattagtataggtttcatagataatgcatttaagttaaagatagatctaatttgaggatgttcctcagtggttgagtgcttacctggtgtggccctgggtttgatacaaagctgcaaattatagatacatgactaaatgaaagtaaaagctacatccaatattagtttcagtctgttgttttcattttatgtagccccagaaatgaatattttcttctatctctccaaaacttacaattttaaagtaatacttattgtaatacaaatgaataataacacattttgctaattttataataacataaatgttctttcagatcaacaggagttgtcacaggtgattttttttttaaggtgagtgaaactagtgagaaggataaacactaaacatgcttgtgacatcaggctacatcttacttcactcctttattgatttgtaatagaaaatcattcaaggagttgaattcacaggtgtggtgtgagtgtgctttgtggaaaactccatgtagctgcttcccatgcatgcatgtatggctgtgtgaccatcctacctcagtgaagtccaaagagaagtaatgtctgccatttttttttttttaaagatttatttattgattatatgtaagtacactgtagctgtcttcagacactctagaagagggagtcagatcttgttggggatggttgtgagccaccatgtggttgctgggattttgaactctggaccttcggaagagcagtcgggtgctcttacccactgagccatctcgccagccccctgtgtctgccattttataaccaacccccaaagtcccgctctgcctggttgggataaagataaagtttcagaacagggctttatcaacataggtccttgaatgactaatgaggttgtttcccaggatctgtcattcacagagtattactactgtatgagcagcatgatcattcactttatctatactgccattacatgaaacaaacctgcattgcgatttggttcctggattgcttattaagtcagactgttctaacaaatgaaatcctggcactaatcaaaagtttttctttaaacaaatatgctcaagggacaaaatatataatgcttgaaacctgtgtaggaggacatattttactttgttggaacaatcacagtggctgtccagttagcacacggcttattccttacatactcattatgtaatgtgagacttccacacctgtggcttcttcaactctatcctttccttttagtcagtaatttaaattttacctagtcttgcctttcctccatgtctgtagatgcttacttgggaattctgtagaggaagagcagaaagctgtgcgaatgcttagtgtagataattagccctcaggtaggactgggtgatgtaatgatgttggagtttgtaccttggcagtgctgtccttttcttaaccacatggctttaagtgcagaacttgttgcagggaaggctacttgttaagtggtcatgaatggagctgccttcatcagattagctaattataatcctgaatggcagactttttcttcccttgaggaataaaagcagcacatagacacatatgagttggatcagcagtgtgatacctggggaagatgtgaggaaatgctaggtaagtagcagaaagtccttcctgcatttgtgaagtaggtaaaggtagttctttgtctacagatccaaattcctgtatctggtgaaattttatctgtatgtgaattgtgtatatgtttgtaaatttgcgaacaacttgatatttatcagtgttagttttacatatgtttgtaaagttgtgtgcatggtggcatgatggtactttaatattgtctggggttgtagttcattgatagagcacttgcttcatatgagccaagtcttgggtttgatccataacacacacagacacagaaaatacattgattagtagcttaaacataatatgatccttgtagaagtataattatatttattaatttttctctactcaggaattctgtgctgaaaacagtgtaagacttaatgattaaatgcttgaagataattatcttaagaatcacattgtcaaactgggtgtggtagcacagaaatcataactttcagcccttagaaagtggaggcaggaggatcaggaattcaaggttaacttctgccattatataattagtttcagggtatataaaggcatacctcaaaaaggaaaacaagcacacacaaaaaataattatactgccaaatctttggaatcagaagacagatcaaaagaagtttaatttgttcacgttgaactgttaagaaatgacttttgggcttagagagatggcttagtttttttcagagcactgagtttggttctgagccaaatgggaatcatttatcttttctagtctcctggatttctaatcttggctataggtttattactaaatctagaaatcatctttgataattctctcattaaacttctataaccagttgatcgtgaacatatacttgtcacataatcttcctggtgagatgttaaatatctatttatttactcaggtggaagggcatagacacaaaacagaaaggattccatctaagtgcctcctgatgaaccagtgagtttgttggtattttcctgctttagctgtttctgaagtcaccatctggtgggtgtgggtgtgattggaaagaggtgtggtccaggataaggaagatcatggagcagcaggacccaacaaatataaagctagagaggctgattatgaggtacacttgagcacagagaactaaggttttgtcctggataaagaggagcattgttgtatttaaacagtttccacttctttctgaccttgtagctttgaaagcattctgatcttgagttgtaggaatttctcttaatatagtggttctcagccttcctaatgctgtgaccctttaatacagttcttcatgtttggtgacccccagccatacatttttcttgttgttgttgttgctgcttcataactgtaattttgctcctgctgatgaatcataatataaatgactgatatgtgaccccaaagaggttgtgacacttgtatgcctgatgtccatggaggccagaagagggcttggagccatgtaggtgctgggaatcaaacccaggtcttctgaagagcagccagtgattcttaacccctgagctatctctagactgaccccttttaattttgtttttttttttctaacatggtaaattagttacttttaagattgctactgcaacctgacacaaacaacataaggaaggaattattttggtttagatcaaggattcagtccatcatggcagcaaggttacggtatagaagcatgatgtagctggtcacattatacctgtagtcaaaaagcagagagcaatgaatctttgtgtttcgggtactttctcctgtagatttagtccaggatccaagcacatgctacccatgtttgagtggatgttcccacctcagttaacctaatctagataactctttacaggcatgctcagaggcttgtgtcctaggttaatttgaatcctgtgagtttgacaatcaacaataatcataacagatgggaatatgctatatttgtttcccaggctggctttaaattcctaggttcaagaaatcttcctgcattagacttcctagtacttgggactataggtgtcagctactgtgttcagctaaaattcttccttttaacgtgtaggcttaagagtttgtttttttttttaatttactaaacctcatagttatcactttaatgccagaacatttttatcaaccccaaagaaatcttgcacctccattagcagttcctttctatcctctcactacatctatagcatctactaagtgtttttatttctctaactctgttagggtttgtctagtttaggtatttcataaaaacagaaccatgctatgtagtcctctgtgcctagtttcttttacaaagcataatgtttatgaggctcattcatatgtagtatgatgtagtatgtatcagttatgatccaatactattccattttataatggaccataatttttattcatttgctgatgggtatttgggttctttccactttgggagtgttatgaatgctgctgctttgaacatttatttactaactttgcctaggcattttcatttggggaatttttttttcttgtgtttcaggcttgttaacatcctctaggcatggtgtctgtgaggccctgtgtatagggaggaaccctgtgcttcataaaggaatacaattggtcactggctctgaggctgcttacccagaatttaaactagcaatttataaaatgatggggtgaaatgggtcagcaggttaaaggtacttgctgctcaagctttgcaacctaagttcaaatccctggaatcctagcaaagatggatggagagaacaactctacacctacaatattgcatgcccctcccatattacaatttttcaaaagctatagagttgtatgggcctttgcttatccaaacatgaatcgtatctcatgatagctctcagggtcctcccaaatagatatatttcagttaccagaatatatttgtactttggattgccatgatagtttctttataatcctatgaagtaaataggacgattttctactttactaaggatgacaaatttgttgtgaggggagactgtattctctcatagtgtcaccttcagatggggacaggaagtagttcacatgtctactgttcagaggacaagaatgtagactttaccttcttacaaggtggccatctttctttcgcaagggtgtgtgtcaatatccattcttcagttggcctagtaggagaatgtccttttcaccactacgaactgatcctggaatcctattgggaaattagtagtcgtcttcttttttttttttttaaagatgtatttatttatttattatatgtaagtacactgtagctgtcttcagaaaccccagaagagggcctcagatctcgttacggatggttgtgagccaccatgtggttgctgggatttgaactcgggaccttcgaagagcagtcggcgttcttgaccactgagacatctcgccagaccccagtagtcttcttttatccctcctcactctttcctctttagaataaccaacaactctgctgcaaaagaaaatgcaaaccatgttttttgatagtttctagttatgttttcattccacagtagaagggaactaccccaataaatttgttattatagaattaggggtcattgagtgtattgtagggtttatagtttttctgtgaatatttcacttatgtgtttgtttttttgctttctgtgtgctgggatttcagttgtgtgccccaccaagcctatcttaattatttttccttttttttttttttttttttttcctgagacagggtttctctgtgtagccctggctgtcctgaaactcactctgtagaccaggctggcctcgaattcagccaccactgctcggcttgaatatatttcttaatgattcatttttaatattttatactcttttactatgcttaattcccaaagaatattttgtatgttttgaaacaacttggtattcaacattatatataggatcttcagttaatgttcattaatgatatttttagggtatgaaaggatatgactttaaaagttgaatgagccgggcggtggtggtgcacgcctttaatcccagcacttgggaggcagaggcaggcagatttctgagttcgaggccagcctggtctacaaagtgagttccaggacagccagggctatacagagagaccctgtctcaaaaaaccaaaaaaaaaaaaaaaaaaaaaaaaaagaaagaaaaaaaagttgaatgaattttttatggattatttgattctcaaaatactcaatattattaatatgcttgatgtataaaatgcatttaaataataagaaaatttaagaagaaaaaaatttaaaaaaatattttgaccatttctttaaaaaaaaaaaaagccacctctgtccaagtggcattcttttactggtaatgttttactctctggatgtttcttcagacagcaaccaaattacaatttatgtacagtaaaccgcctctctagaaggtgtacaagctggtgtactttgactatcttcatctgggacactggaacatcacaactaagccactgagcatgcgctccttagaccccgctccttcatgaggttcctgatttgctttttgtcacaaaaataaatgagtttgtactttagaaaattctgcataaatataattacaaagtatgttctttatatctggattccttcactcaaatgaacaatcatttgagattcgtgtaatctattacaggaatcgattgtttgttcatttgaatactgagtcgcatcccactgtgtacacatgccacaatttattgttcaggttgtttccagtttggactgttacagtaaaagttgctaaaaccaaaaaaagaagaaaaaaaaaggctatgcacaactacctggcttccttcacccattcttagctccataagaagtaccagaagtctcaagctaacaatacatgtgcttgggatggttctaatagccagataactgtctgtaaattaagaaccaacaatcattttatttaaaggtccacagagtaaatattttgagggttgtgtgtctatgtagccagaaatagctatagacaatataaaaatgaaaggaccatgtaccaattaaactttattcacaaaagttggcagttgagggtggagctgtagcgatctcagtagttaagagcacttgctgcacttggagaggactctgtttcagcaaccaggtagcagctcacaactgtttgtagctctagcttcactgggatatctggacccttcttctgggcttcatgggcatgtatgtggtacacatataggtaggcaatattcttacccaaaaaaggcaatgggaaggatttggtatgctgattgatattaagcagtgcattttcagtgtggtttcagcagcatcagtatccactgagaatttgttaggataaaaacttttggacgctgctctggaattaatgaactcaatattgcaaggctgttgaggataagccagcttattctactactgactattttgaggactattgccttaaggaggcaaggtcattttgcatgggaatcatcaccatcaccatttgcatttttaaaatatttttattagcatatattgtacatacttgatttcttttttttgggggggggcagttcccgagacaggatttctctgtgtagccctggctgtcctggagctcactctgtagaccaggttggcctcgaactcagaaatacgcctgcctctgcctctcaagtgctgggattaaaggcgtgcgccaccaccacccggctcacaatatttttatatatgcacttagtgtattttgattatatttatctctccgcaaaatgctcccttgtttctgttcccctgattctcttctcttgccaactagtcctcttcctcccttttcatgccttgagaaaaaacatcttttgatggcccattgaatttaattaaggttgcttacacaagcctggatactttaccagtagctataccacttgggggaaaagtctcatctttacctgcaaccattaactggccatagatccttaggtatgagtgtgtccttcctcttgtataggtaatcatagctgctttgagctcaagagaggaccatccatatcatgtgtcaacattctactctctggctcttttcacctcatttttcaatgttccctgagagttggagggggtgatatagatgtcctatttatggctaagcattcaagagtcacttattttcagcacattggtcacttaaaagtctgcagttagtacttcccgttgaacaaacaaacaaaataaataaataaataaataagaacttatcttaccaaagctgatagtatcagtaatgtaaggagataatatagttgttttatttttttaaaactctgtgtgtgtgtgtgtgtgtgtgtgtgtgtgtgtgtgtgtgtgtgtgtaggggtagacatgtgagtacaggttccataggaggcctgtggcattggattcccttgaagctggacttaaggatggttttaagccacctagcactggtgctgggatctgaacatgggtcctcttcaagaatagtaatttgcttttaactgctgaaccatttctctaaccctgaacataattattcagaatatcatttcatgagtacgacttgtccatttcatcgttagattttttttttaaagtctggatctctctgtgtagccagatatttatacgtctgagattaccagtgtgggccaccaagtccaaatgagacaattattgacatgtgcaagaaaaacaaaacaaaacaaaaaacatgttttctggaccccagaaaggtaaattttagcaactggtccagatggtctgatgcacaccagaatcagaactgatttctggagagatggctatgaaggaagtactgactgtcttctagaggacccaagtttgcttcccagctctcatgtggtggctcacaaactacaactctagtcccttcgtaggcactgcacaaaagtaatgcacagacatacatatagataaaacatccataaatatttttaaaataattaatttagaagcaaacaggaggcattagggaaccttttctaactacagccttcacttcagttgaggtggtttgcaaggaaaattgtgaatgtggaaaactggagatgtgtgttgtgtggttttcttttgtctcatgaactttacccagagtaactgttccagtatctgcattcacatgcctatacacatggctttacttatcctggtacctcaatgtattctgaagtgctggagaggctgggattttgatgtgtgaaatgaagatgggttgaggaatgctgttcaacacgatgacttggatagggagtgcctggaacagattattgactgcaagagaaaatagaggcagtaggatcatgagtttgaagtcaaactagactacttggtgagtgtcaggctagcctgggctatatatgagacactgtctcaaagaaagggggatgcccccatacacagattcaagtgctggccagcatatggaaggaaggtcctgggttcagtcttcacagtggaacaaaaggcctcatatattttactttggattacaaaaccctgagctcttggaaggcctttagggatcacatgcattgtcagttattaggatggcccagcatgcatttcatagtagtcattgctaaatgctttgtgcatgtctgtgttggtttggccctggatctgacccatgactggacagtccttgggagagagataggtgctctttaagaggcctcatcatcccatgctgactgaagggatctggagaagagagtcatagcaggcaataggtgaggtaggaggagcaacatcctttttgaaaggcagtgagagccatggaaagattttttcttttgttttgttattattttctgttggtgatcaaatctagtatactagtcatatactctactcacatgctctgccactaactcccagtaccgtggacatttttaagcaaggatgtggaagccagggccactggtaccaggtgtgtgaacagatgcaggggtgtgcagagagtatcaggaaactttgagctgctggggagaagtgtccagggattcaagtgttatccctgaggcactgttaggaacacctgacccttggatggaggatgctctgtggctttaagagtctgctcccttcttttaatttcctctgtaacccatgcctggaggaggccacggctgagtatggttggtcactggaggcttggctactagatctgctgcaccatgcactagacaggtagcagctcctgaaagctctgggtgttttgctagatgctgtacaggtcatacctttttctatttcttggtgcacacctggaacaggtgtgcttaggtgcctcagctgggggctgagccaccctagggcattgtccctccttagagattcaatcaaacaagtggtgtgaatttctgtgctcagttccaacagctaccaagagggatggaaattgaggtcctccagacccgggagtgttgaagcgaccaggtgtgtgccaataggccttttgaaaaaataaggattattataaaatagctttctaggcgacacatttggctcactttgatataaaatttcattttactttctcacatttttacttatttaccttattttaacttatttatttttgaggcagtcttgctatgtagcttgttctggctagaacttgaggtactcttgtttccccctcccacatgctaggattaaatttcctctgtttaaagaaacactgtaagtcataaataaaaatctagcaaacatgggagttacctgttaggatagagatcagagtcttttttttttaataagtttttttttaaagatttatttattattttatgtaagtacactgtagctgtcttcacacacaccagagggcatcagatgtcattatggattgttgtaagccaccatgtggttgctgggatttgaactcagggccttcagaagagcagtcagtgctcttaaccactgagccatctctccagccccgagatcagagtcttatctgcttttctttttgaaaataacatgcagacagctagctacaacatggagactgaataccaccataattacgattttagtaacacaaaaagtgacaagatggataggcaagctgcctgtccctaacaattaagaaatgtatcagccagaactagccagttgaggcaggggcaagcagatattgccagtctgggctggcccagaattggaacatagtgagttctaggctagccaaggctacaaagtataactttttttttcttttgtttttttcttgtgctgaggatggaagccaggcccttgtatatgataagcatacttgctatcactgagctatatatgtagctatatgtagccctgacaaatgttttatctggaaatgtgtgtgctgtcttaagggattatagaagaacatgggcagaataaacctgtgtgtttagcagagagaaaagtaattcagtgagtctgcttgagggaaaccttggctattaaagccactgcattcaactgtcagtgctctgaggacccaattctactactaatgctttaagctaatttgttatggtaatttacacagctcagtgtgaatattaatcaccatggaacagtcattcatccgatgaaccacctaattttgcaaagatcagtaactactttattatatatggccattgccaaattacttgcactttggaatgaaagctcattattttatgaccaaataagttttctcgatgttttgttcttaggaatttcctttttactttttcattttgagacagggtctcatttagctcaagttagcctcaaacttacttgcttatgtaactgaggatgaactgatcctcctgctttcatgtcccagttcttagaattatgtgccaccatacctagtttacgtgatactgaagattaagcccatgccaggcaagtaccctaccaactgagctacctctatatccctaaaaggaagcatttgaaattccatcacaagaaataaagttcttacatgtgttgtttgttttactttctagtagtgtaaacttgagccatgaaaacttagtttgtagcagttacttttcatagggtcaggctagctctatattgtgattttataattatatttcagatataagtggagaaataacgtaaggttttatattttattttttcagttttaggatggaactagggtattgtacttgctatccaaagaactctaccattgatcctcatcacttgctccaacattaaggtttttttttttatttttttattttttgaaagagtcccatgctggctttgaaaaactcactatcctcctgcctagtgctggaactaagaggtcagtcttgatgccatctgcaatatttagctttttagaggaatggaatttgcatacgttctaagttttctctcatcttttaagtttaaacaacaatataaaaaagtaaaattgcagcaagaacagagcctgtataaacctagatagaaatcctccataaattctcctctttccttttctatcttattctttattgccctttctttcccttccccttcttttaaccctcaccctccattccaagaaatcatttatgtggataaaggtaatttcaggaaacctcttagctagttcctagatcttcccttaaggaacatggaggaaggcaggaaagcagtctgggtattggaatttggttgcatggaccagcagttcggctgtgcttctatgatcctagcacataagaatctaccattttgaactgtgcagggtcttggttgggctgggctgggctgggctgagcctggcagtgtgttttctcctatcaggggtgttcagttactgctcaatacatggaaaatagtgagaaaagctccaagataaatgttcttcaaagtctcctatggagtggtacttagccatctgcctctaggaccccagtctttcctatagtctcaggactgagtaagtgagtaaatgaatgaatgagtgtgcttgtgcggggtgtctctagggaaggaggagggcagtttgacctttttgaatgaagtatctcattttcacatacaaataatgtaaaagaagcaaaggtttttcctaagtgaaagttcactctgcttgtaataaatttggataagtctccctaagaaaatcatactacagaggttgtagggtaatctgtgcttggaatggcttttaaggtatccatctagaaaatctaaaagaggagccagggagatggctctactggaaaagcacaagaatgagtgtgatccacggtaggagagaagtaactccgcctgcagaatgtcctaagacttctacccaggtaacacttagactctgcatgacatacacacacaaatagatgtaatgaccccaccttttgtgatgtcatatttaaatgagtgactttgaaataaaataaaaagactcatgaaggggtgtattgtttctggggctggagtcctagctgtatagctaggcaagctttctactgttgctcgtgacggtatttaatatcagcttccttgcctgggtttccttactgttctgtgactcttagcagaggcttctgttcattgtgttatattacttctgccttgaaagagatggggtggaaggggggagggaggcatgctaatcatcctatgacaaggtgaaattttaattgtagcaaaaactgttttagttctcatagtgttgtgaaaatcttgtgagattttgtcttcataagctctactggggatgagaaaattaatgagtgggagtttggagactacattgtaacttctatcctgcttcctgtgtttacctccaacactgataagaaggcaaccctgtatagtttatctgtcaggaacttgagtgtcaaagacaatgtgccttaggaaaagggcatttcctagcttttttttttttttttgacattctttgttcaagttgtatttctggtaccatgagagggatgtgtgagcatgtttcagcaaggcagatcagttcagaatggcttccctttcagtcagcactcattcaccattcaccagagtcttgaatgttttagtcacttcgatcattttttttttttgtttgtgtgttgtgtttgctcacatacacactctaggtagggactgtggaagtcaaaaggcaacatcaaatcctggttcctgccttctattttgtttgaggcaaggtttcttgttcagcacagcatatgcacagcaagctggttggccgtgaatttctgggtagtaagcacactgtgattctgcttttggctttacataggctctagggatctgaactccagtcttcctggttgcatgtagctatataagttatcattagcctttcttggtctcaagcctctagtatgatttggaggtggtaggacccttaagaagtggggcttcatttgaaagaagggtagatcatcagggacatattcttgaaggggatagtgggacgccaatcacttgtttgtctttgcttcctaacagccttgctaaggagcttgctttggcatgggcactgttaccatgtgggtacttggaaccaaacgtggatcctctgaaagaactctatactactgagccatctctccagctctgagtagccttaattcttgatcgaggttaacagcaaaacactaagcattccttgcaaaataataataataataaatttatgtccacttggctattggcccattgggggggggcagaatatgttttctatgacaagagaccatgttctctttgtgcctggcatagtggtggagtgaaactttgtctggattctagtgactgagaggtgataggaaaggaaaagaacactctctgctgtgactgaaactagtgggtcttaaagcataaagagtttcaaagaaacaggacaaaggagagaacaggtctggaaagtgaaaggtgttgctaggctgagaggcaaaggaccatgagtctgcattccactaaatgccttgcagtattgaggcaggctctaggagaacatccagagacatgctgagtctcaggccccaacaaagatttccctagtctcaaactaggggttaaagacttagcttgcattctgttgaattctaggttagactttaggaatgtcaactataatgagttctgtttcttatatctagctgatgttggaaacttacatgccccgattctctaaagtttatagcattttccaaaatagcaccaacagttaagaaccaagggtttaatatatgaacctacaggaaatagttcatattcaaagcttgacaacatttactccctatgagtgtgtatacaagcatatgtatatatgtgtattaaagacaaagtcttactgtgttgcctaagggctcaaatgaccctgatgcctcagcctttcaaaaagctaggactacagacacaggctgccttgcctggcttctccttttatattttagcatcactggtacttggtgatttaaacagtcttatttcagcctgtcagccaatcatctatcaattcacctacacataaggttttagaaatgacagtgcgatggccatttccattttgaacaaacaaaaataaaaccatagcaaggtacatcataaagatgaccatagaattaaatgtgaggtagaaatcaacacaacaacctttcatgttgattaaccttacaaatctttctgcatagtagaaagtcttcctgtctctatgtttatatccagtgcaatgaagaacattctcttttacttttgactccatctcttttcttggtactagacaaatcattgttgcctctcctgttggcttgttttcctgtaatttccttgtatagtgtgctcatactttgcctcactggggtagctgcctccagagtgctacatgctttacttgagtcacaggtgatggctagactagctctaaaatctgttgtattcttttctctttgcacctagggttgtccatgaggcaggtggcagcacccaccttcaggggaatagaggtggagaactgcaggttttccttttgtagagagccatgtttggagatgctggattagaggttacccagagaggaataagagaaaggacaaggaagagatgagggaagagaaaacaggagccatccaggaggatggaagaggataggcagacgagggaccaagtgaagaggagaatagaatgagtagtatagctctccaatgccaagacataaaaattactggattcccttctaagggaaggttaggaccctagtgtcccagctctcttgtgaccagctcccttgtgcccatttctacaaatgctctgatgttgcagccagtttactttgagcctttggggggagttcgagaagggatggggcaagggctgtgagattttttgagatggagactaagcagaaagacttccaaatgcctgaaagccatcagtgcctgaaatccatcagcacacagtttgagcattaaatttcttagaagtatgcaaagcgcgtcctgggactttccttgttagagagctgttctggggaaagggagaggagctgttatcaagcagccctgtctctgcctggtgctgtctgattcccttagcactgactggatttgttctgaaactccacccagcacctgctatcagcagcttcctccattgggaggtgggtgggtgctggtgtttctagctcagtcaaggtcatgccttaatccccacagaggtcagcagatttttcagaggatgaatatgtccttatggagagaaggttttattatattaacttgacagactgctcagtgaagggaaaaatgcagctgacagtgtttactgtaaatacagcgttgtattttcatttcttaactgagtgtcaggaaattgggcacacagttctgtgctttgtgattgcttctaaagactagaagtctggaggagaaagggtatgtggtacattgctagtcatgggttcgtgtttcccttcttccagcagtcataatgttctaaggcaacttcattcactttgtcccctgagactatattaggaatgcagagtataattgagaaaaagcatgtggcttactaaattttagcaaattgttgttaataatcttgagttggtatagtcccaaagactatgcctggtagaaggtttctgtcttttagcataggcatatactagcgttttgattttagaaatcaggtctctggaaggtccccagacatgcccaaggcactgggtgaacaagcccacattgttccccaccaccatcaccaccactctgatgggtgctttctgtttggaggaaaaacaatattcaccaagtttagctggtctggtaggaactggagatctccattggctcaggtatgaggatagctttgttatggagcccagtctggaagccttgttgcaggggtggggatgggtgaacattcgccataactagtgcaacttatgaaggaatttgtccttgacctgctgcaggctattgatctggagggactggaaagggcagcctatagcacaaatgatgccagaagccccttaccatccccttcaagactcgaggtccaaagcagcatgcttggtggcatagttcctgagtttattcatccaagtacctgttttccaaggtgactgtaagttaaacaggaaccatatttcagcaggtctcatctttaaaccagggatgaaacttcttctgcagcactgtttccatggtccagtggttctcaagcttcctaatgctgcagccctctaatacacttatgctgtaatgacctccaaccataactgaagttttgctactattgtaaatcataatgattttttatttttgagacataatgaaacagttttggagatagaagtttgccaaatggaccatgagccgcaggttaagaattactgccatatttgtgccttttttggaatctgtcttccctctgtagtctcaggtggcatttcattcttcctctaacccttgaaatagggtctcccttcagtctgtctcaacctggatcccagatactttgttaagtgccttttcttttttccagagttttatgggggcttataatttttacaataataacctcatctgttctttgtttgtgtgcatgtactactagtacttgaacccaacctaggccctaagatagatccttagtcctctttttgatttttgacacagaatgtcactgaagttgcctaggctggctctagactcactttgtagatcaggcccacaagtttactagttttaagtttagtgacttagtaaattcagagtttgtgcatccatcacaacacaatttcaggtcattttcattccgctccccaaaatgatgctttatacatgtaaagcacccaatttttctcctgccttagcaccagacggctgagagtctgctcttcaactctgagcctgctatggacatttcctgtaagtagaatcatataacattgactttttgtgtccagcttttatgtagcactgcacagtcaaggttcatgcatattgcagaaggcctggcagttcatttccgcctggtcctgagtatgtatctctggtgtggatagaccaccacttgggtggtctccttcatcagctgatgaacattttctttgcttcactgaactctgaattatctgctcctgttagtagttttccaggccccatgggtacacacgcctgggagatggcccaggctctctgagagtgagtaagctctgtagcttgtgggagtcaggtcatgaaagtcttttgaatataaactttatcccttgtgatcagggatggctttcttctttatatatgtattctaggatggttggtaaaatttaataaaccaaatatttaaaaaatgtgtttcatgttgcctctctctgacctcaggaagtagctctcaatttttgtcatatggagaaaaatctgtaacatcattaatctgacaactggctggatagataaagccttctgcatattctctgagttgtttcttgggagataaaacacattgtacgaatatcctgcctcttttgccctcctgatgctgtagaaagcggcgtagacagaaagacctaacttcaacagcagcagcagttttgctgtagtgtagtagaggcctgtgctctgaagctaaccttcgttttgtatagttctctttgatagaagaagtagagaagccaataggtagttaggcacatgttagacctggtcacgtgccctgtgctttatctgttttctccagtaggctgctgtctgctgtccttgtacacaagctcctctcagctgcctgaacacctcattattttgtctcaaccctgagctcagtgtctgaataatgaacagcagctctcccaagacatttcatgaaccagtcaggacaccttcaatgggacattgcaattgcttcttccagccttagatagtgaatgcccttgtcactgcccttgtattgggccttttctcatagcagggctcagttaaatgagcagagaagctggaattgattgatctcaagcattactgtagggaattggagtattgactatactcagggtttaaatatgggcagctggttggagttggattagtgctggcatacaggaaagctgcaaatggcatataaaaggcttgttgtatgtatagctactagcatgttttaatcgcagtgagccttggggtgcacgaacctttgatacatagataaatcataacaactaagggtggacttgaggtagtctgcaggaaagaatctatgtagggaacaactgtacttagcatttgttttccttgaggaatgttttgggtgtgggagtggctcaatatggcaaccaggcttttgagtttgatcctttcaagcttgggttagagtgaactactagtatacataccactgttctccaagcttccataggaagtccagtacaggcctgtgtactccagcaaggtgaatgaaaaaaaaagacaaatgttttaaaaatattttttcaagacagggtttctctgagtcacagccctgactgtcctggaattctttgtagaccaggctggctttgatctcacagagatctgtctgcctctgcctcctgcctgctgggattaaaggtgtatgcccccatgtctggcaaaagacagaaattttaaagaagaaaaatttaaaatcactgctccatttttcctcaaccatgttagaaaaacatattttctagttcaagaaggctacctggttctttgtaacagcatcacgaagtcataagtaagaaatcacccactaaaatacagtttctagctacactggtgatatatacttgttatcccatcactctggaggtagaataaggaccatcatgaattcaaggccagcctgggtgacatagtgattccaagtctctgtgggttacaaagtgagaccctgtctcaacacacacagagagaggcagacagacagacagacagacagacaaacacacacacacacacacacacacacacacacacacacacacacacacgactcaccttatagcttatgatctgctaagacttcacttttagtctaatgagaagaaatcagaaaccaaatgaaaaccagatgcatgaaaagagtctcatctttttcctgactgaaatttcaccaggagccttttggtgtagagatacgcatcacagatcaatcttgagttacactgagtattaattatttctgtcatttactaattagtgtctaagagagcaacagctgatgtgtgtgtcctgtaagcacatctgaatgggtgatgcagtggcttgaagggatgggaacagtttcccatgtgttcctttcatgggtttgggtggagtgcatgctaggaattggtcattttcttgtcattcacatttcctaaccagatgtggaatctaaccagaaagaaaatcttgtttgttcatctggcttgtctgaggggcacagagcttattcccccattcccaagagaccactggaattgtgtcccttctgcttgatcattcatccccaacacaaatgtgtgtcctgccatgataagttagtgtacatttcccagaaagtataaaatatgttttgttttgttgttttgtcttagagacagagtctcactaaacaaggtggcttcaaacttactatgtagttcaggctgccattgaactctctatcctactgcctcagcctgtgctaggattacagaccttctgtaccaccacattctacttgagttttatgcaaatgtaatcctatagcagatcttcttttcttgctggctcctttcactcagttattacttagacacttgcccttgtttaatgtgtgatagtacattgtcaggtgggcaagctggatgttggtaatgtccttttttaaacattagattttttaaagatttatgttcattattttaaattaaacaaattgtgtgggtatatgtttctgtctgtctgtctgtctgtctgtctgtctgtctgtgggtatgtgaatatgagtgcaggtgcccaagaggctggaggcattctatcccctggatctggagttagaggagtttgtgagctgcctgatgttggtgaactagggccccctggaggatcagaaagtgctattaaccactgggctatctcttcagcccctagaagttaattttaaagagacagttgaaaggaaatctaagaggatgatcaaagaaaactccctaggtttatacagattattcctttcttgttgaggcaaacatgatgcttctttttctttctttctttctttttttttaattttagatgctaaagattaaacctacagccctatgcaggttaggcaagtaatgtgtcactgagttatgatcccagctatttatcactctagttggtgacatgaacctgggacagtggcacctaaatgtaatagccaactttattcagagcagcagataatttgtactctgagggttaagaacagagtcacctgagtaaaggatacaatcacaaggacaagctgcatgtggcaaaacatatgactaacaacagctgaagtaacctcactcctatccactacacctgggaggggcacaaaaacacattccaagaacaattccatgtttttgaagaaacagaagtcacaggattcttgtcttgtttttttggacctttctcacaagcactcagaattcccctcacatgactccattgttgaacctagtttcaacactcagccttgtttttcccagcctctcttttattttctttgactcctgcattcatttgaaatgtcatggaacactgactgcaactttgacttcattttccaaggtcacataagatttctattctctctggttggagacaaggtcttctgcagtttagcacccacaggacaagagaattttggagccattaaatggtgcaaagttaggatatatatctcagtggtagagtgcttgtctattataacaaaagtcctgggttccatcccaacactaccaaagggaaaaagatactttaaaagagaggtgtaacttagagaatacagggctgcacacttcttttcaatagacatcctttcttccattaaggtattaaccagaccagaccctgtttagcttcttagattgggttctgtcagagtggtggcctagacaataatgaatcatttgtaaggaaggcccttttttatattactgttttttaaaagttgaaagaatatttttatatatgctaagagcaaggcacttcattgtaagatcattaaactaaaaaaatagagtggattctttttttttttgggggggtggtggtggttttgagacagggtttcttctctgtggagccctggctgtcctggaagtcactttgtagaccaagctggcctcgaactcagaaatccgcctgcctctgcctcccaagtgctgggactaaaggcgtgcgccaccacgcgcggctttagagtggatttttgtttcaaattcctatgaaggtatgacagaaaatacaacttttacctcaaaattcagatcccttgctgctgctttcactgttgctaagtgaaaatagacttaggactggagaattggatcagcacttaagagcatttagctgctcttgcagaggttccaggtttgattcctggtacccgcatggtgactcacaattatcctcagctacagttacagggtgactcttctgacctccttgtgcaccaggcatgactatggtattcatacatgtatggtattcatacatacatgtaggcaaaacactcagtacacataaaataaatctaaaaaaataaacaataaacaatccaggagtttagagttctatgaaatcttcaatatgttgttgtaaggagcttatggtagaacagttgcttgcagttgcgtgtaaaaaactacatgtactacgggaaggagaaggaagaattgagatagtattctaaaattgccaaatgttggttttaaggttgttgaacatgggtgctgtccttgccctttagcactcttctgtagccaatatttaattttaagaaacagataaatgtaccaacttgatttgcaaaacaattttctcctggagtgaaaaactaaaagctgcctattcctcccttcttcccccccatcctactccttcacatagtcttgttccttcatggcggggtcttgtcatataactcaggctgttctggaactcaatgtgcagcctgggttagtttttaacttagaatttttctgcttcaagcctcctgagccctagaggattacaggtatgtgcttccattctggacttatatttattttttccccctctcctttaaaaaaaattttttttttctgtgcgtcattaagatggctcagctgtaaaaggcactcgcttgctgcccagtctgacaaattgagttcagtcccctggacccacatgatggacagagctgacttcctgaattttgtcttctgatattcacatctatgctatggcatgcatgtatgttccctccttaaataaatataattttatttttaaataaattttaaataattaaaaataaattgtatcctccatgacaatgacaaataataagtatggattttcataatgtataaaatgtatgttattatatatctccttcctttgttgtggcattgttgcacagaacgagagagtgtgcatgctagacccataagttacaccctaatctatttcctttgctatggtttatttaccttgtccatttgggtcatgttatgatttgctgctgctgtggtttgtttgctttttttttttaaagtcagagttttactatatagcttaggctggcctgtaactcaaggtcttcctgcctcagcttcttgagtactgaattataagtacttgagtactggaattataaacattaactgccatgcctggctctactgtactttgatgttcaagcgtcacattgtaatttgacaatttatatagtaaacatagttaattaatgactttttcaattatgacttgtttctttttttcgtttttattacatttattgtgtgtatgtgtttgtgagagagagagagagaaacagaggcagggagcgagggaggggaacaaaaatgaacacacatctttaaggagctggttctgccctttcactttgtgggtactgaggcttgtactcaggttgtcaggcttggaggcaaatgccataacctgctgaaccatctcacgagcccacattttaatctctaaaatatgataaattgccgggcagtggtggtgcaagcctttaataccagcacttgggaggcagagacaggcggattccaggccagcctggtctacagagtgaattccagaacagccagggctacacagagaaaccctgtcatgaaaagccaaaaaaaattcataagtttacagattgtataatttttctttagcttattgtcctgctttgtgattaatgtgaattaattatttttcctgtgctggggaaggaacttaggacctttgtacatggcagactagaagctatggtccattaagccacacataaagcccatatgtgtgtttatttgaagggattcctgaaaactcatgggattcatggactttctttaaaatgcagttgcattttctctgcgtcaccctcagcagtctcagttctgcctattgtcctggccttgaggtagtttctgctgcagagaacacagtgggccatttctaaggctaagtctaaaacatggtaccctgccacacactccaagaagccctgaaccttctcttccttgttcttgagtctgtagccaccagtacctttgagaatgagtaaatgtctgtaactttcaaaaggattcccactcttcctctaccaaaaggaaaggttgagagccagggaggttttaagtagtaattagttacttggtttccacaagaaagctagcaagcagggcttaagaatgctctgttgcattccataaagggggtgaggcaggagtgggatgctctggactgtttccagctctgactaccctttctttcttgctgtttccagatctgcctgcccagtaggcagggtgacctatcctagaaggggaaagagcaggaaaaaagaagaaactgtaatttgcttttaaaaccctccggggtctcttctatatcctttcctaaaaaggctccacccatcagggaagtaggttgtagctgctagccctggacaggagcacaccattgctggccctctggggctgggttttccatggctgaggcaaacataatacagagttgagttctaagtccccaccgatttccactattgttactatattactattgtatgtgtatgtagcagtcaaccaacacattgtttgccatgagtagaatcccatgatttaatttactttccttattgctcttattttcttgtttttttttaaaggacattttaatgaaacttttatttatgtgtatgtgtctgtgcatgtgagtatgaatacttggagactatgtattggatcccttggagctggagttataggcagttgtaccaaggatatatgggtgcttctagccaaatgcagattctcttcgagaatatacgcttaactgataaattctctgtagccttctaattttttttttttttgagatggcatcttgctttgcagttcaggttgatcccgaacttttgaacttgttgctcttgcaggtaatctgtgttggttcccagcatccacatcgcagcttacaaccactccagacttcagtcccaggagatccaacagcctcttttaacaaacagcctcttttgatgtcctggacaggacatggacatgatgcacatacatacatacatatatacatacatacatacatacataaatgcaaaactttcatagatataaatacaaaagaaaagagataggtccttttgaattaatggaaaaatgttactcctgacaaactttcttctatatcttaaagaatgaacaaagctatgtaacttactacccagattcaggactcatgcagaaagctcagggttccatccacagcattgattcctctacccacccacccaaaccaaaccaaaccaaaccaaaaaaaaaaaccaaaaacaaacaaaacaaaacaaaacaaatataaagaagaagaaaagaaagagaacatctgtattaatgttctagaagggtctagagccctttacagatgatctttagcttcatttccccaatgatgtaactatcttgaattttcatatggctagctcaaaaaacagtttgaatttatgtatctcttgtagatgtttatgttactgaagttatattagatattttttgagaaactcgttgtatgtgtcttaagtatttaagtgctaaatatgtttcaggatatacaaatcttgtggggctgtggatgtagctcagtggtagagtgtttgcctggttcaattcccaacacagctcaaacaaaacacacacacacacacacacacagagagagagagagagagagagagagagagagagagagagagagagagagagagagagaaaaaggtattaatttaaaatcttagaattactgcaaagaaaggggtgatacttatgttctgtgcaacttttcttgattgctttcatttttcattagtccccccccccccccattttctaacctattgggtgactgataacaaatgaagccacacatactactagaactttgacatagtcattgtttgtttgtttctatgtgtgtatacagtacgttgtatgcttggtgaccgtataggtcagaagaaggtgtcagattccccgaactggagttacaaatgtttttgaagaaccatataaggttctgggaaccaaatccaggtcctctgcaaaatcgacaagcacctaggtcctgacacagttataattcaaggtttttaaaaagggatttgtttgttggtttgttttgagacaggatctctatgtagctcagactggtctgtaactcattatgtagtccaggctaacctcaaactcaccatcctcctgtctttgccaggattatagtgatgtgctaccatgtctactatttctctaatcttgaaaagggaactagatttgttttataaactagttgtgaagtaagttggtagcctgtttctgtgaaaggttctacaaggatccattatctcctttaaacttggcaataggattgggggtgtggctcagtgtttgagagtttgcttgcttaacaagcaaaaaagttccaagattccacccccagtaccacagcaaaagaagtgtgtagggtatgggagttgaggaaggctggtggggtagctaggttagatcatcagcaccaaatgaacctggtgcattactgtaatcctaacacattgaaggtaccaggcaagaggcttaaaagttaaaggttatccttagattattagtttaaagctagtctgggctacatgagactctgtctcaaaagaaagggctaggccaagagtaggccagtgttcattgacatttggcttatctatctcccttctccatagtaacccattttcttttgaaagagatgtttcagtggtgagtcttggcatagccacagggttaacctacctccctttgcatcttccagtttagacttctttcttccttccttccctccattgtatttttgtcaattcaagacagatgtattatttttaacatagtgttttttaaaaaccaccaataataaaaacttaaatgtgatattctctaggataaataaaattatactataggtcctagtaggtttcatatatagggataaaacttatattatttagaataagaatttatatttaagaattccaattgtttttggttataatttcaaaaaatattttcttaagatacttttttctatcttctcaaacctgtatgcataaaatgacaaatttaattgttgaagaataaagacaacagaacatcatgatggttttattttttaattttaaaaaacattttaaattatttaaaacaacttttaagtttaaatatagttttgatcatattcttaacctccctcaagtttgtccaggtcttttatgcctccctacccacccaactttaagttctttctcaaaaatcaactcaaaaaagtccatataacaacaaaacactgcaaatctagaaaaacacgaccgaccccatacccccaagttcattatttcttggtcaactatttctgaacatgagatctgctctggaatggttgatatacccagtatcattccattagagaaaactgatttcacctctcccattagatataagtgatagttctgttgttaacctttacaccagtggcttggttttcattcattcattattaaaaatatacaaaacataagataaaaaaatctgtcacatcaaaattggataagacaaagtaacagaaggagaccgtgtataaatgaagaggccctagggcacacctatccaggccctgtgcttgctgcatcagtctgggagttcatgtgcaccttgatcatattgtttcagagggccttgttttcttggtgtcttccatcccgtcttgctcttacactctgtctcctttgtaaggtttccttgagctctgagggggatggattggatggagacaaggtctctccctttctgtgtaatgtctggctgtgggtctctatatttgtttctatctgctgcaggaggaaagtttgtctgatgatggtttaaaaaggcactgatctctgagtatagcagaatatcattacgagaaaaaagattcctttctttctttctttctttcctttctttcctttctttcctttctttttcctttctttcctttctttcctttctttcctttctttcctttctttcctttctttcctttctttcctttctttcctttctttcctttctttcctttctttcctttctttcctttctttcctttctttcctttctttcctttctttcctttctttcctttctttcctttctttcctttctttctttctttctttctttctttctttctttctttctttctttctttctttcaccagtactaatttggttttaccctaggtccctaggttatctagtctcaggttgtttgttggtcaccctagcattatcaggtatggattctatcttatgcactgagctttatgtcaactagatattggttggttacccccacaatctgtgtgaccattggtctagcagatcttacagacagcacacgattgtacataaaggttttgtggttggcttagtgtttatgtttctcttttggtagcttgcagagtaccttctagtactagatgctagcacatagaggcaaagatcctgtgtaggcatcagctcaaattctccatgtttaatgagttgtgaaggtggtgttgtcagcaatggacccttgctgtcagtttgtggacagcctatagtcttggcaacagtctgggttgtttggagtttcccataggaactctttgaccaacaactcaattttagaagtaacccaaacctggaactggaaactttagtgacaagagatacagagccatttgggaccatctcctccattacttggtgatttcatttagattgctttcatatatgtatatattgtaggagatttctactatatttgtttgccatattacccctcaaatgacccttaattttacctgtctctccccatacttcatcccactaccccttctttccttcctattcccacttgattgtcccagtgcaaacccctcacctatccatagatagtggattctatttcctattctatttctctttcctagtgagatctatctgttccctctagtcctttactctgtacctgtggttctgtggagtgtcacatgattatcattgacttaacagcaaatagccacttataagtgagtacttaccatgcatgtctttctggattacctcactcagatgatctatctatctatctttccttctctctttctctctcttttcttttcttttcttttcttttcttttcttttcgtttcgtttcgtttcgtttcgtttcgtttttcgagacagggtttctctgtatagccctggctgttctggaactcactttgtagaccaggctggccttgaactcagaaatccgcctgcctctgcctcccaagtgctcggattaaaggtgtgagccaccatgcccggccagatgatgttttctagttccatcaatttgcctgcaaatttcatggtgtcagtttttaaaaaacagctgagtagtacttccatgtgtaaatgtatcatattttctttatccattcttttattgagggatatctaggtttccaatttctggcaattatgagtagagcagcaatgaacatgtttgaacaagtgtgtctgtggtatcatgaagcattcattgggtatttgcccaagagtagtgtagctagctcttgaggtagttgaattgctatcttattgaggaactgccacacttatttccataatggatgtatgagtttgcactcacgccaccaatatagtaatgttccacttactagatagacatcctcacccctttttctgtcacttgttttgttgattttagccattttgacatatgtaacatgaatcttaaagtagttttaattttctttttttgattctttttattagatatattctttatttacatttcaaatgctataggtggaacaacaatatgaactaaccagtacccctagagctcttgtctctagctgcatatgtagcagaagatggcctagtcggccatcactggaaagagaggccccttggtattgcaaagttttaatttcatttccctgatgactaaggatgttgaaaatttctttaagagtttcttagccatttgagtgtcctctgttgagaattatcagtttagatctgttcccatttttaaattgactttttgtttcttgatacctagtttcatgagttatttatatgatttggatactatgtatcaaatatggagttgataaatcttttcctggtctataggctgttgctttgaatggtggtgtcttttgccttgtagaagcttctcagtttcaagagtctccatttattaagtgttgatcttagtgcttgtgctaacagtgttctgtgccaatgagttcaaggctgtacctgctagtccggcatggctgcataagggaaagtgtgacacagctcttgccctggagcattgccaggctgttgatcccatgatctcccacactgatggttgctgttgccccgaagttgatcagctgtcttactactctactttcaatatttctttcaggggaatctactttcctcccattactcagagctaatcacaccatagtaattgaaacagatgcactttttaggaatgaggaatagagatggtcatgaggctgtggaggatgaagaacaggccctctacttggcctttagggctatgggaaaggatctagacaacataaccacaagggccataaaaacctacatggatggtcctttgtagaaatagttcattgccagacttggccttgaatgtggaaacatgaggagatacatatatcctccggtccaatgactgctgcactaagtagccagggtgaacttggggacatcaagaatagagagttaaagtggtgtcaagaagaaaaggtatggatagaaaaagtaggaaattatataagatgtaggagtaaatagtatcagaggaagagtgcatgaggctatggaattgctaggataaggaaatgaagattagagaattaacagatgatgtagaagcatataaaaagtcagtactctgtttttctagctgagtgaagaattggggatagtaatgcctggaaagatattagagagagctgttttaccattttacttacataaattcaaaactttgtaaggaatcattttaactttagtagtctatcatttttctgctctgaaaatagttactgaacactgctgtctgctgtactaggaaaccgtgggagctgtgcccagctacccatgaagaacaggctgtgaaaacctataaggaaatgtgctcttgctttgtatttagttctgctctgaggaaacagaggttgggactattgatccaggactcatagagtttatgtaaacctaatctaagaattttttgataattattaacaacgattaaagccttgatcatgtagctctggtaaataagagtgggttcaggctctctctggttattaagctgaagaacatttaagctgaagaataatgaatactgagaatcatcagggaatagagagagtacctgaactaggagcttccatctactactgacttcaagttattattgaatcagcactgttcccatttccccctttctcaggaccctcctcacattgaggcaagacataggcatatacctctgtgccagtgagttcaaggctataccgctctttctcttctgtcaggttcactatatctggttttatgttgaggactgtggtacatttggaattgatttttgtgaaaagttgataaaaagttgatttggattcttctacatgcagacatctagttagaccagcaccgttgttgaagatgttgaagtgtatgtgtctggcctctgtcaaaaatatagtgtccataggtgtgtggacttatgtctagttcttcacttctattctattaatcagtgtgtctatgagccagtatcatcttattttcattattatagctttagagtacagcttgaagttggggatggtgacacctctagcagttcatttatttttcaggattgcttgagctatcccagggtgtttttgttgttgttgtttgtttctacatgaagtttaaaattgtccttttaatatctgaagaattgctttggaattttgatggagattgcattgaatctgtagattgcttttggcaggatgttcggttttactgtgctgatcctactgatccatgagtgtgggaaatctttccttcttcaaagacttgattttgtttttaaaaatcatacacacctttcacttgcttgggaagaaataccccaaggtattttactaggtattttatatttgaggctgttgtgaaacacgttgcttccctgatttcttgctcagactgtcatttgcatatagggggcactgatttttttgagttactcttgtattcagctactttgctgaatgtgtttatcaggtgtaggagttctctggtggaatttttagggtcagttacatatactatcatatcatctgcaaataaaggtactttgactcttcctttccaatttgtatccccttgatctccttacattattttattgttctatctaagacttcaagtaacatattaaataggtaaggaaagagtggacaaccttgtcttgttctgatttcagtggaattgatttgagtttctcttcatttaagttgatgttgtctatgggcttgttgtaaacggcttttattatgtacaggcatactaaaatatattttgtatgtcctttgttaattagcctttttattgttttatttgtatgccatttgtatccctaatctcttatgaaggagtgatggttttgtaaaaggccttttctgcatataatgagatgatcatttcttttttttttctttttctttttgtctttcagtttgtttatatggtggagttcatttattcctttatgaatgttgaatcatccctgcatctttgggatgaagcctacttgattaaggtggatgatcttttttgatttgtttgtgggttccagtttgcaagcatttttgcatgttcatacatgaaattggtctgtaattctctttgttgtgtctttatgcggttttgttatcagggtaacttgtaaaatgaattgggcaatgttccttctgtttctgttttatagaataaattgaggtatatgggcattagcttttctttgaaagtgtggtagaattctttacaaacatctggccctgggctatttatttattttggctgggagactttaatgactacttctatttcactagtggatatataggcctgttcaaattgcttatgtgatataaatttaactctggttagtggtgtatatcaagaaaattatttatttttagattgtccaatttgatagagtacaggtttttaaagtgtgtccttacgattttctggatttccttggtctctcttgttatgcacccccccccaatttgtttctaatttcattagtctcactcaaccttttaatttgtcaatcttactgattttctcaaagaatcaactctgtttccctgatttttttgtattgctcttgtttgtttctattttattgatttttagccctgaatttgatgatttcatgccatctactccttttgagtatggttactctttctgttttagagtttttaagtgttctaagttgctagtatgagatctctccattttttattgatatatatatatatatatatatatatatatatatatatatttatttatttttgtccttggccccctcttggtcagccatcccacagttcctcattgcattcttctaccatctccaagaggatgtccccacccaccaggcctctcaactccttggggcctcatgtatctcaagggttaagtgtatcttctcccactgaggccagaccaggcagtcttctgtatatgtgtccagggcctcagaccagctcacggttactgcctggttggtggctcagtacctgggagatctcaggggtccaggttagttgagattgctggtcttcctttggggtcgctctcctcctcagctccttccagcctttccattggttggatgtaagtgttttgtctatcttagtcagctgcttgttgttgggtctctgaggacagctatgctatgctaggctcctgtgtgtaaacacaacatagcatcagtgatagtgtcaggccttggggcctccccctgagctggatctcaatttaggctagtcagtggacctcctttctctcagtctcttttccatttttgtccctgcaggatgttgtttccctattttctttctcaacctgtttatcctttgtatagaggaaggcttttgatttgagttaattttatatccagccactttgctgaagttgtttatcagctgtagaagttccctggtagaagttttggggttgattattgtcttagtcagggtttctattcctgcacaaacatcatgaccaagaagcagttggggaggaaagggtttattcagcttacacttccatactgctgtttatcaccaaggaagtcaggactggaactcaaggaggtcagagagcgggagctgatgcagaagccatggagggatgttctttactggcttgcttcccctggcttgcttcacctgctctcttatagaaccaagactaccagcccagggatggtcccacccacaaggggcctttcccccttgatcactaattgagaaaattcttacagctggatctcatggaggcatttccccaactgaagttcctttctctgtgataactccagctgtgtcaagttgacacaaaactagccagtacaattatgtatattatcatcaacaaatagtgatgccttgacttcttctttgctaatttgtatccccttgatctcttagagtaggcagccttgtcttaaccctgatgttagtgagatcgcttcaaatatttctccatttaatttgatattggctgctggcttgctgtatattgcttttactgtgtttaggtatgggccttgagttcctgatctttctaatactttttttttggcggggggcttttttggggaacttttaaaaaattggatatttactttatttgcatttcaaatgttctcccctttcccccttcctcccagaaacaccctattacatcctccctcccccttcttctatgagggtgttcctccatccacccacacactcctacttccccactctagattcccctacactgtagcatctatctagtcttcataggaccaaggatctcttctcctattgatgcctgacaaggccatcctctgttacatatgcagatggagccatgtgtactccttggttggtggcttagtccctgggagctctgggggatctggttggttgatattgttgttctttctatggggttgcaaaccccttcaactccttcagtcctttctctaactcctcttttggggacaaaatgctcagtgcaatggttggctgtgaacatcagaatctgtaaggctctggcagggcctctcaggagacagctatatcaggttccttttggcaagctattcttagcatccacaatagtgtcagaatttggtgactgtatctgggttgaatccccaggtgggccagtctctggatggcctttccttcagtctctgctctacactttgtctccatatttgctcccgtgagtccctttctaagaaggactgaaacacccacactttggtcttccatcttcttgagcttcatgtggtttgtgaattgtatcttgggtcttcctagcttttgggctaatatccacttatcagtgagtgcataccatgtgtgttcttttgtggttgaattacctcacccaggatattttctaggtccaactatttgcctaagaatttcataaattcattgtttttaatagctgagtagtactccattgtgcaaatgtaccatattttcggtatccattcttctgttgaaggacatctgggttctttccagctcctgactattataaataaggttgctatgaacatagtggagcatgtgtccttattacaagttggagcatcttctgggtatatgcccaggagtggtatagctgggtcctcaggtagtactatgtccaattttctgagaaatcgccagactgatttccagagtggttgtacaagcttgcaatcccaccagcaatggaggagtgttcctctttctctatatcctcaccagcatctgctgtcacctgaatttttgatcttagccattctgactagtatgaggtggaatctcagggttgatttgatttgcatttccctgatgactaaggatgttgaacatttctttaggtgcttctcaggcatttggtattcctcagttgaaaattctttgtttagctctgtaccccatttttaatagggttatttggttctctggagtcttaacttcttgagttctttgtatatattggatattagccccctatcagatgtaggattggtaaagatcttttctcagtctgttggttgtcgttttgtcctaataagagtgtcctttgccttaccgaaactttgcaattttatgaggttccatttgttgattctcgatcttagcgcataagccattgctgttcttctgttcaggaacttttcccttgtgtccgtgtgtttgagactgtcctcaccttctcttctattcgtttcagtgtttctggttttatgtggaggtccatagagaaaccagaaggctcctgtcccaggttgctccttggttcctgtgtcctgtgatctgaggtttcaagggaggtccctctgagcagtagtggtggttttacctgcacttacaggcttgttggccctcctgggatgctacctctctcccagtgctatttgggtatggagccctgttgcagaggatcagtttacctactctttttttttcttttttaaagatttattatttattatatgtaagtacactgtagctgtcttcagacactccagaagagggagtcagatctcgttacagatggttgtgaggcaccatgtggttgctgggatttgaactccggaccttcggaagagcagtcgggtgctcttacccactgagccatctcaccagccccagtttacctactcttgacttaactttggtgaatggtatctgctagaaaagcatccattttatctagattttctagttttatagtatataggcttttgtattaggatctgatgtttctgtgaatttcctcagtttcttttgttatgtctcccttttcatttctgattttattaatttgaatactgtctctgtgccccttagtttggctaggggtttatatatcttgttgattttcacaaagaaccagcttttggttttgttgattctttgtataattctctttgtatttgtttgattttggccctgagtttgactatttctactgtctactcctcttgggtgtgtttgcttctttttgttccagggctttcaggtgtgctgctaagttgttagtgtaggatttctccaatttctttatgagggcacttagtgctatgagttttcctcttaacactgctttcattgtatcccataaatttgggtattctgtttcataatattcattgaataccaggatgtctttaatttctttctttatttctttcctgaccaagttatcattgaaaagagaattgtttagtttccatgggtatgtgggcattctgtttttagtttttttgttttttgttttttgtttttttgaattgaagtctagcctttagtccatggtgatctgatatgatgcatgggattatttcagtcttcttgtatctgttgaggcttgatttgtgactgtttatatggtcaatttcggagaaggtaccatgagatgcagagaggaaggtatatttgatgaaatattctgtatatatctgtttagtccatttggttcatagcctcaattagtttctctgtgtctctgtttagtttctgtttcaatgacctgttacttggtaagagtggagtattgaagtctcctagtattattgtgtgtttcaatgtatgttttgagctttaataaagtttgttttatgaatgttggtgcccttccatttggggcatagatgtttagaattgagactttttcttggtagatttttccttttgtgaatatgaagtgtccttccccatctttttttcataacttttagttgaaagtctattttattgactattagagtagaattccagcttgtgtctcgggactatttgcctggaagactttttcccagccttttactctgcagtactgtctgttattgtcattgaggtgtgttgcttatatgcagcaaaatgcctgatcctggttgtatatctagtctgtaggtcttcttattgggcagatgatattgatagatattaaagacaaatgattcttagtttctgttatgtttgatgtttcaagtggtggcattatgtatatgtgattctgttcttttggttttcttgtaagatgattaatttcttgttttttctttggtgtagataccctccttgtgttggagttttccttctagaatcctttgtagggctagtttggtagatattgtttaggtttggttttgtcctggaatattttggtttctccatcgatgatgatctagagtttttcagagtatagtagcctaggctgacatttgtgttttcttagggcctgcatggcatctgcccaggctcttctggatttttgggtctctgttgagaagtctggtataattctgataggtctgcatttgtatgttatttggctttttttttccttctaagacagtgctgttaaactctgatattagtagagtctgactttttttgaaaagtgaattttttggggggaggggggatgttctcagttggcacttacagtatcaagtagatgaaaccctgaaaggctagtttggataatgggaagctggtatttagacagagactagtcagggctggctcctgggatgattcgttcctcagccattcttacagttacttttcacctggaatgtatctgtgtggcaacagtgctttgtcaggagaacatacaggcacctagcaagttaacactgcatactctaaaaatgctgcagtttcccctataagattccattgtgttcttttcacttctgcctactgacagacaccacttctagcttcaatttgaacagataaaaagttcaaaacatttttaggtcataaaattgttaatcaattatcaagcattcaggtacatttaactgctgaggattttccgtgagtgattgaagtctgttttactccttcagcttctagttttcagttgacaagtttgccatatttgaaagaaggcttctgttcttttaatgagttacagcctgagggctggggtgtagctcagtagtagcatgcatacttcacatgtgtgagggccttggttctattgcccagcatcatcacttcctcaaaaaatagtattgtccagaagaaagggcttgctcattaaaagcaacctcttgtgaagctgactgagatatattggaatgcaaagcatggctagtatctggctgagcaattaaaaaactttggagcaggttagtgcccatgaaaaggtttatgaaggttgtcagaaaaaaacaaaaacaaaaacagaaccttcaggtaacctcccagcaggacatcagctaatgctataaatggaactaattttttccctatgctttgctttaagaacatacattccaagactgggatatagtgcagtggccttccttgtcagtcctggtgtggctggcctagaatgtgcttattggctgtcttagcatgtgcttacttctggagttgaatctagtccctgcagttgattctcagcactacagcaaaatgaatgaatctatcaatgaaaaagactcatctattcttctttgtagtttgattgaatagtaggtacaatgtattgctttctgattcccagtcacctatgggaagtttctgtttgggtactgcctagctccttgccaattctgtgtagcacgtgaggcttcattcattcttattgccatcattttgaaggcttgccttaagatgggtgtgcagctttttctcttgttatgtatcatcctcctcatcacctgccacattttatatctgtgaagacaatcccatgaattccagttttaagggtggttgaatttgatccacagtaaagacaacagttgtagttctaaacccttaaaagtcaaaggaggtctttatagcactagtgaaagcttcctacatggaaggcaagtagtctacactgagcctcatccctgcacaattgagtctagttgtttcacaatatataatatactgttgaaattctggaagccagacaccctaaatcaaggatgttagcaggccacaccctttttggatgctccagccaaggtcctttctgcctctttcagcttcttgtagccctaggcatcctttagtttgtggctgttttactctaatctttacctccgtcatgcatctaccatgcatttatgtctgagtttacctcttatagcaatttaagatgagttcatcctaactaattacatctgtaatgatgtgtctaaataaggccaccatcacatgttctgggggagagactttgatgtacttccatcccgttctctttttcttctacagcatacctctttcagtgacatataaacttacatggcagaaataatacattttaatttttcttgagaaaatgcttgcaacatgaacatagatgtcaatgagtttttatagaatggaatctctgtaatcacctatatcaagtaatagaagacttggtctcttaaccctttgccctatcctacctacacctttcaaggaagccctgttggaatattctgtctcaatgttcttctagtacggctggggtattttagattttaatctgatactttgctgacatgtaagcacagggatgtgttggttcctctttatgccttgctctgcaaacctgtgcctatcataaattaaactgagtcttaattcatttacaggctggctgataaataactcaggctttaactaattaggaggaagtaggatgtaagttaggccatgtacactaacattcaatgataagggtgtcgtgctgtgaaccagaatcagcactttgactttgtaacctgcatggcttcctgggaactctattttttgttaagcatattgttacagaacaaattgcattttgagtatgaataattagattgaagctagaaattctgtcatatgttctttttttatcaaatgaatctacagtaaggccatttatattctcaatgtgaaaaggtcactctatctgtcattgtcaccttggattctgatagacctttgcttatgcttctgttgtggctgtgtgggtggcaggagaggactgcagctcttagccagccccatctccatgtcacacagtttgagacttgagtttagatgggaaagtctctggcctactggtaggagttttattcttctgcattttcttctgtttaaaagccacaaattcttttctgttcttgtgaaagtcccatacacatggtaactatgacagtaagtcacttatctttatgatccttattttattttcctgtagaattgagagaaaaattcttgcccggctatcatctttcagggtgtgtgagtgtgtgttgttttgtttctgaaacagttgtcttactgtgtagcccatgctggccttgaatttataatcttcttgcctcagcctcctgagtagcaccgactactgtgctgatatgagctaacacactgggctgaaaaaaaatctgtagtctataatgaaaaaaatctgtattcctttttgaagatggacaaattcctcaaatgtttccatattaactttagcagatgaatgtattgctttatgtaataatttgtccctgaaagggctgaatgagaacagaacaggacacaaaataagtcagattacaaaagaaaatgaaaatgaaccagaaatggctttgaggcttcagttttgttatgtcaagaattttaagcccagctagaacaaatgatggctccattcttaggtgtgtgttggggggggcactcacagagcccagaaagagaggatattgggtcctcaggagctgaagttacaggtaattgtgagccacttgcagtaggtactgggaatcaaactcagggcttctgcaagatcaataagcactgttaactgcccagccatctctctagccccagttttccttttatatccactcgaactgtggatgaacttagaaggaataaacatatcattaaggaattaagattttcccgtaggagagttgactgctgagcaagtcagcatagggtgtctcatttttgtttagtcttgtcttggttagtgtggcataaattttaagcaccttgctgtgttttaagtgacagaagagttacaacttagataataggatatttttgtttgattgtagtaccatttctgcctggataaataatactaatgagatgagaactatgttggttttcttgaaacagacagacaaacaatatcaaaaattgccttcatgtatttacattgctctttttaaaaaaatttatttatttatttatttatttatttatttatttattatatgtaagtacactgtagctgtcttcaaacactccagaagagggggtcagatctcgttacggatggttgtgagccaccatgtggttgctgggatttgaactccggaccttcggaggagcagtcgggtgctcttacccactgagccatctcaccagctacattgctcttaaagaaattgaattccatacacattaatccttatatatttttttaagttcattgactccatgttctactagatgtaaccaccataagtcacaaaaaatttagagaaaaaaaattgtgttaaacatatagacttttccttcttgttattagtccttaaatatcatagtgtaacaactatgtacatggcacttgcattgtattggatattattgatgatccagagatgggttaaagtatatgataggccatgaatagattgtatgtgtgcactgttccatagtatataagggacatgataatcctcagaccttggtatccacaggggatactagaaacactaccccctccatcagataacaaagacaactgtacatttctttgttatcaggaaattcagacattagacaaaaatagaaatgtaataatgccattataggaggtagatgtagggtaaatttaatctattcttactcttattatttatttatttattggtggtgctgaggagaccctacagcctcatccatgtttagcacacttaacccaatatgtcttactctgaaaccagcaagggttttctttgcttttttttcctcagcaacaataataaattttactatttcatagttctaattataaaagtaagcaatgtttttaaccacataaaactattctcataggtgttgtgttttgaaaggaaaaagaaaagccaaaaatttaacccaggctcagtgattcatgccttaaatctcagctcgtaggtggattcaagagaatcagaagttcaaagacaacctcagctacatagtgagttccaggtcgacttggactgattagacccccatctccaataaataaaaataaaataaacaagtatataagctgggcatgttgcacgttttttttaattttatttatttattatatgtaagtacactgtagctgtcttcagacactccagaagagggagtcagatcttgttacagatggttgtgagccaccatgtggttgctgggatttgaactccggaccttcggaagagcagtcgggtgctcttacccactgagccatctcaccagccccgcacatttttaatatcagtatttcagaggcaaaggtgagaggattgggagtttgaggcctgcctgggctacagagtggtagtgtgtcccccaacaaacaaacaaacaaacaatatatcaataagtaaatagagctagaaaccatctgaaacatcagacttttctaggaagagttattctaactacctcattttaggctctttaggtagatagctgggatcctggaccagaaaattttctggagtctcagagtcctgaagttttgtctatacccatagccataccacacctcggcctatagccctcaagttttccttgttgccaagtagcttctgcatccacaggtatcctgtcttagttcaaggacagagcaaagagatggccccagatatctctgcccttatattgctctgcagcttccagcagttttcttctcttctctctgcatagtgcacattcttccctctgcagaggattcagacactggaaagcatggggctgggaattatcacagagagttcagtattactgatgagggagggagagggacgacttccaaaagacacaatcaaggatcacagggaaggaacttggacatgagtcaagctacagggaaaggtcaactatggagagtcctgaacctttgaatggtaaatccaggacaaagaaaacaaggaaagtgaaatttgcctttcaaataacaaaccatttattagggacttgaacaccttgaggtactgggtatgtgcatggatgattaaaaaccccatgggtatttatatctgagaataagttttgaattaaatgagccagccatggacatgaatttatggttctttaatattttttaaatcctgtattactgggatttaaaaataacacaaggcttctagcagtgaacagtaaccctagctatcaaccccttttaaaatagcgcctcccaatgtactctgtactgctctcaaattcatgatctttccttagcctcccaagtacagaatggcagatgtctatcatcatacccagcaacataattctatttttgcagggtgagatggaatagaggaatcaattcttttgaaaagcaatgtaaacatttgaaacagtctaccctgtaaaatcaagattgatagctggagacacctgctcttccctaaagttatttctctgtggccctggatcgtgtctgtggcttctgaacataggatcatgccattgctccgaggttgttttgtacttccagcgctgccccccccctcctgtgttcaccctttcaaccctataaacacttgcatgtcaaagacagagcttttttttaaaaatgtttgcttttgaaaaggatcaccaaaatgttttcccaataaaagatagtctttgtgaatagcaagagcatcatattgtgttcaagagaaaggaagactgggggtggtggtgcctgagttcacttcaagggaagtcactgtagctcagttccccctccctctttccttcttacgtgcacagccacagtgcattcaattgtttaagagcaatacatcctttgaactagccctaggatgggaatgcccattaaaaataaacagctatgtgtcctgagcatctggaactctatgttctaacactcagcagttccgtttcctgtctcttgattgtgtatctgttcttccagattgcttttgtgctttgaaaactgcagatttcagtagtcctagtaatctctatggaagcaagcatttaaatgacctgactcctctgtacccagatatctgtgagaactgcttagtaacacataagcattgttgctagatgggtggaaagcctgtttggaaagctaaatatttggaaaccttcttgcacagccaccgtggtatggtgtgtttggtagtggtggtggtggtgggtgtctatcctaccccttccccccctcgcattgttataagatgaatagtagggtatagtcaggaactttctttatctttgctgagtcttttcctctttttcatcctttccagaaatgatgtctgttgtgtggtcaggacatctgtacaagaaaggagaaagaaatatatattaaatttggtctttgtccttagaaaaatgctagttgtattagagctcttttgtcactgtaacagaccatctgataaacataactcagtggagtaaatacttattctggctcctagtttcagaggttacagtagatggtcatctggctcctcggttgcttctgtatctctggtaaggctgaacattatggcgaaagggtgtggtggaacagaactattcatctcacaatagccaggaagcagagaatggggcataggatcagggacatgatatatcccatctaggtcataacctactttctccaactacacctcacttcccagtaatgataatcttatgaactcactaatggcttattttatgattaggtcagagccctcacaacctagttacttctcaattgctccaccaggaacaaccaggcctccagtacataaggtctggagttttctaggctgaatgtgaatgggccagagtaatgtacatttcagtaatgagtgtgaccgcaagacgaatgatgaatagaatatcaaagctttatttgcatggaagtggtagaacaatgttaaatatgatggcctacctggcctctccaagctcttaggcattctgctacagaccagaaggaggctgatttgtgtgacgcaggttgctccctgcttcctgcaatggtacataggaagtgacttggctttggttttctgttcaacatgagccattctagatatctccaatatatcatttaacatagtggttctccactgggagggatggtgtctctcaggaggcatgtgacaatgtctggagagatgatagcagtagctagcaggtgaaagttgagaagcatagtacatccattctgcccaaagcaaagaatgacctggcatcaaatgttatcagtgctgctgagaagtttgctttaggtaagggattctgtttggctatccaatttttttttcaccccgaatttttactaaccagatatttgagtaaaatagccactgttgagttcttacactcaatattggtgtaagcattcttctgagcgtctttgataaatataatggtatgattcggatcttaaaggccccctgatgtccctgtatttaaagttgctgatgtgtggtactgttaggagatgttaaaacctctaggaagtggtacctagtaattagaagatgggccattgagaacacaccctttaaggaaatgttgataccccaggctctgcctcattcatgtcttgactgctttgaggtgaacagatgtgttttatttaccaggtgctcctgctgcccggtttactgctttgtcagcagcctttcaagtgattctcctaggcatttgtcatagttttgaaaagctgattatcacacatctatatacatagctccagttatctgctattcacttgtgcattatgcatcaggcctttgagctgcatatgtaaaaatggttgcatgtgcttttgttcctgtagatatcatgatcctagtacgattctgaagttgggcgtttccccacgttgctgtcggtgcacaactgaggacctgaggacaggaacctttttctttcttagtcagggagcagaagcaccaagggttctgtggcaagggtattttaaaagcattagaaacttctgagagagggagaagggtcacaggcaaatagagggccttatactggttatcccttaactaagttgaactgctgatggttagcacagcccttgcttgtcaaggtgaagaagatgtagagcagcggagtgtgaaaagaggttggagcccccttctgggcccttctgcgtctatcatctcgtgtgactgtgacatgacctcttccatctgttgcaccacctctgccttggcagcttcctcttttgacctgatgaatagagatccttgaaaaccgttttcctgacccatgcacagtctcttccttcagagggccagctggtgagatgtgttttctgttacccacttgattgtaagtacaggatatttagaccatgatattttaaagagagatttgtattagcctaacaagttacctacccccctccccctctatcgtctttctatatagggcttcagacttgctatgtagtttgtatctcagctggcctctaactctccatcctcctgcctcaaacattttgagtgttgggattacacgtgatttctgacatatacaacaaaatcagtggctatgtgtcatatgtgcatagaaggttctttagttttcttacatcactaagtatggaactcaggtccttgtgagggctaaataagtgatccaccatttagccatccccagccccagccccagctcccagctccagctattaggtagcctttaattcacaggggaactgtgacttggtttctacataattcacttaggctaaaattttaaaagtcaccccacttagaaattcggtaatgttataccagctgtatagaaaacttattgtttagacaatacaaatgtacaggataagaaacctttctaaataggaagcattctacctaactttggagaggtctccctttccactaagcttctgatgttcttatgttattaccaggatctgtagaagttgccactgaacctgagagtgggattgtttgtacttcatttcagtcccccccacccccttttctttttcttcttcctccctcttcagaccactctttttggttattgagataaggtctcatatagcccaagatgacctgaaactcacaagctgaggattattttgaactgcttgccattctccttcctccatctcccaagtgttgggttgcaggcatactctacaaagcccagctcccagtcccaatccaccataaatagattataataataatagtaatttgtgaataaatttgtataatacttggagtttgtagcatgtttcaaacatctcagttatatcctatagttgacctagggtgttttcatcttttggaggcagggtcttgtatcccatacttatataggatgaccttgaactgattcttctgccttcatctcctaaatgcttggattttacaggcacttgccaccacaccagactttaatctcattctgacatgaacagagtgtaacaacagtgctctgtgagtatacttagtattatgagtttgcaacatatctccatttttatcttaccttttatcttcctgcttgtctttcctggttgtactgagtgttttctttttgtccattctcctttctcttccttctctctcttttcctttccccttttcttctcatttcccaattcccttaactttcttctccttttctgtcctttcttctcccttttacttatttgaggtacgatctgtgtagctcaagttagtcttgaatagaataatatagttgagggtgaccttggactctggatccttttgcctcttacctctccagttctggggttgtgggtatttgccactatgccttgttgtcctggtagttttttttttttttttttttgcttgcttttattgttttttttttttattaatatttggtctcactgaagcccagactggcttggaagcccagactggcttggagctcccagttctccttaataagcctcccaagtagctgagattacagcagtgcatcggcaaacccagtttaagataatcaggttttggaaaaccaaagtgagattaaagaaaaatgagtgacttttttttaccaaatcctgtacaaacaagtcttaagtcccatttcctgcctcaatgttttgtaaaccctctttgacacaaacctttttctaccttgccacctggttttctcttcctctgtgccatcagggctgtgtatctggtaatgcatttacctcagaacttttatcaattaggtttgggtaacaaaccatacagaaattagaataaagattgcttagtacaaatcagaatttggtgaattggctgtgttatattctgtcttgtctctttataaaaacaaattagagcagttgccatagaaaccagaggtcttgcaaagcaagactgattttttttttttttttggtttttcaagacaaggtttctctgtgtagctctggctgtcctgggactcactcggtagaccaggctggccttgaactcagaaatccgcctgcctcagcaagactgatttactctatgcctgtggctcttgatttaaaaaaaaaaaaattctcctgctcatgcacctatagtcacagtttctcaggatgctgaggcaagagattgcttgaatgtggtagtttggtgctagttttgacactataatgtggactcatcacttaaatactgtatagaatcattaactagcattaggctattgtttttgtttttctttcttttttttttcttttttggacctggcattaagaaggcagaatctccagggtatgtacaaaaagagaaatctgtcttcccttcctcagcaccccaaaagcttggtggtggtggtggtagagaaagaggggggtggaatgagaatgagactgtgtgtatgtttgacgcctgactgtcttctctagatagggaagacagtcagggccacaggcccagaggcaatcagtaaaatgtcgtcctgtgctgttcttgaagctcactaggaaactggctaggatgccctgaaactcactagaaagccatttgaaagttgttgctaaaactcactgggaaactgctgaaggggtgctaatgaaaccaagaaagacacttttgaaactattgtcactaggtgtaccacaggactgccatgtcccacagggctggcagagaggaaagcacgtgagataaggaagggaaaccagtcttctcttggtgtccctccagtgccctctgctgactgtactgaaaaggtgctagttgtgactttagagatgttcccggtgtagggtattgtttccgagcttgtgttttactgtcattgagatgtgagtcttggctttggagagtcaaatcagggtggttctaggttcttcctttttctgacactgcttaggccctatagataagcttttttcccccttttgttttaggtttaaagttgtgagttaggacattggattgctaactggtggtgctttgcagtactgaaaatatgctgttttaaaatcctttgtttttatagaaatagaactttctctagaaattttttctgagtttattttttctgtccctgggtgtcttttaggaagactgtatctggcactatttagagtacagtcttgtcctgatagagatttgacattgtcctgatagagatttgccaggcttttacctcatctggggaagaggtcacccatcatcatgaaaactgtgagtccttgctgtagaatgtaaatggctctctggttcccagtctatcctacctggctgctgagcctgcctctctgtcttgcaaaactttgaaccaatgcctggttctcacagtcaggagagcagtcagctcctttttgttcactaatatctatctgctcagcctctggatctcttgggagactgaggccccataggtacttctgttttccattttcgtgtctacatgaccctgcccttgcatcagaacttgtcaccaattcattaccttcctttaaaacatttcatttacctgtctttgtcaccccatccaggccacatttgcctctctgtgtcttagggccaagtataacctgagcctcatttcagggatgaatggaaggattattagacctctatattatttttccctgaagtcccaccttagtggcctttcccaacctgttaaataccccacccccggcctgagtcaagcttcctttctgaaggaactgagagcaaacagaatgagtaatggatttaagaagatggggaggttattatcctcctgtgtaacaaaaggcatggcctgctcatgcactttaggctattcattggaagggaaaatattctggaaataattacagctgataacctgcaggtgtgactcacattttgacgtgtgatcttagactcataaaacagcaaagttgctcttccctatttcattctgatgactggacatgtgggtatattccacttctccaagctcagaatttgacttcaacgtgaatggtgagctaggtcttcttccttctatcaccagagtcctgcttaccttagttgtctttacactataaaaataacttctgtcaagagcactgaaaaggcttcagggtgggtattcatcacggctgcagtggtccccaaacttgtaattctcctacttcagcctcacgccccccccccccccccgcaatgccaggatttcaggtgcctaccaccatgtctggcttttgctgttctattctttttgttgaagacatttatttttattttcactacaaggttaatatcctgaagtagttgttttcatcataagtttacacttgacttctctgccctcccttacccacctccactacctgaagaacagtgcccacgttctgcttcaaggtcaagttctcagtcttctcaccttctgccaggatcctcccacactcctgtgtattctttacactgtttcccctgactcatccctctggcatgcctccatttcctgcctgcatgtttcttcatgtcaagacctccatggaatgtcctccctaatgctgctgtattcctttcaagccctacacattttgtttgtggagcttttacatcagcactttgaacctgaagtgaatatggcccttcatatttccattataccaaattacaatgtttcatccacagtgcacctggttacctatagaatttatattcttttgtcttcgcaaggcttcattttttaattacagtaaaaaatctatagttttgcattggtagttaaatacacactctggcctttccttacaaacacaggactacagtataaaaagtatcatgtggcaattctgttttctatttttatttgtttgcttgtagctcgggctggccacagactcataatcttttctcttaaactcttgagttctgggatcacagatgtgtaccacccatgcctgagtcactctttttttaaatgttttatttatttttattggatatttaatttatttacatttcaaatgttatctcctttcctgtttttttccttctaaaaaccactatcccatcctccctctccctgcttctatgagggtgctcccccacccaaccacccattcccgcatccctgccatgacattcctctacactgtggcatcgagccttcccaggaccaagaacctctcctcccattgatgtctgacaaggccatcctctgctgcatatgtggctggagccatggggtccctccatgtaatctttggttgtggtttagttcctgggagctctgggtttatgccagagcctgacaaatacagaggtggttgcttatagccaaccattggactggctcattattccttgaaaattggtgccaaatttaagttggttgtctagtacaagcatgaataattaagtccaacttgagatagcatatgggtttagtatagaatggaaattcataaaacattttcttttaaaaaattatatatcattttcttatactggtctggaaaaagatgtcattctgttttgtacaaagtgagtagcagtattcacatagcagggccaagcaactgaacctgatttatgaggcatgatgaaatactgtgtgttagatgttgtcaaggatcatttcactgctacaaaacaaagcagaaaatacacaacaggatggactcctggtcctttgaggccaaggaatttatccaaatttggtggagggaatggttgatttgtctgttgagcacatacatgtaggactatttcagctaccaatagaaaaccttagaaggggttttgtatatcattaaatatagcacataagcttgattcaggattgattccagccttctagaaccagatcctttagggccagggagggaattgttttttttttttaatcactatgcagggcacatttatctttcacatgaacgaccactcttccagttacccaactgaagtacaacatagtgaatgaaaaatggggacatgatggctccaaggtatggtggagaaggtttattgtctaaagaactgccagaggaatatggaagagtccagactgaacattgccagcagactaaacaggactatgagaggagagaggaagagaagagaagagagaggaggaggccaagagaggatttcctctcttggacccaagaaagtctgtgggaagcaagaggattcatagctgaaatggttaggctttataggaaaagagaaactggggacaagaaagtgaaagctcagggcttggggaggtttagagtagtgggcagggtttgccagccagggcaactttgtaactggtgcttgtaaagttgagagattctgggataatccagtggccagtatccactttgatatgttaaatagacagctcagttagccatttgttcaaggtttctttgagacctaacgcataagacaggttccagggacaaaaataggctctagttgctcactgggtattccctatcatggttcttttgtcgtcttcccaagtgggtccttagtaaacaatgcgctaagacaaacttgactctcctggataaaaggagcagcatttcctgggtttggactatggacttgtaccctacaggtggtattctgactagattctgtgaagggttagaagacaaaatactgaaatgaaaatgggagccacataactccatttgaaactaccaattaagatcctgaagatataatcagagtgacaggtgttggagacgtgagatacagaagacctgcacgagaagggaacattttttttttttttggagtagtgcacttgcttgcctttatttcttggccttgccctaaggagccacaattttcacagcttcacatttgggtttcttcatccccaaggaattgcatgagcttgatgggcttaagctattgtctaagtttccttctttaaagagatctcccagatcaaagaggggagacgttgtaaggttaaggtccaccatgatgacctcttaaagaagaccctctagatacttgatgacaccctaaaggctgttatcatgagctataataaagacagtctcttgtgagagtctaaaggactctattgtcttatctgatttgtgatccttactgatgttgtagaagggatgtttaggcaccatcggtggtggtggaacatcataggagcaccttcagatctttacctgtgcccctcaatgcttggcagcagtttctatttaggccagtcagacccccatactcattgagtgctagggcttctctattggcagctgttcagaggatcagattgcttttttttttttttctgcactgaggtgaaacagatgtcaaattcatagtcagcttttcccaatgcttgcccacacagttggtactgaagctgttctctaggtcctaggcacaatcaccatcctggaacagtatcagattgtaggctacagtggcagcaggctagagctacagcaccaggtttttgttttttgattacattcctccttcatatataaatatctcttgtcaagggagcaatagaaaggaaaataccatgctgtctcccaaatgcaaacatgttttccctggaaaatatagatggggcatacttgaaaaaggaaaatgggtgttctgttagtaaataaacacctttgtagacaagaaatgataggtggcaggcatcagccttccttgagaaggtagaagggttcagatgagatcactttgatagaatgtcccagaacttatcaaataagcatttgtgggaacaggacaaaaaactgactcttgaaacccaatcaccatagctgactcagacacacataatacatcattttgaggaaatactccaccaaaaactgtcttggccaggcatagtggcatacttaataattctgacttctagggtagtgtgggatactttatgagacccagtctcagaaaaactgggactggagatatttaggatctattatgaagtgcttgttttatatgcataaagccttgggctcaagtcctagcacaataaccctgttaccacagctttcctatttttaaaattatttttatttttttacagtctagtcattacctacttcccagtccaccctcccacagttcctcatccccttcctcctcttccctgtcttcaagaggatgccccccaccaggcctcccctaaatattttcttaatgttagtacaattaaaagtttgggggtcaaggatgtattttaaagtttcgtccctatcagttttatactggaccaaagtcattttcttcctttcatatattggagagtatacaacattttattgtgtgaaaatatatctaatataaaattgagcatttttaagcatgttgagatgtagattcagtggcactaggtaaattttccattgttgtacagccatcaccagtgtccatgtgttgacagcattccatcctgtcatactgaaactttggccccattaagtgctaactatccatttctccttccattttccagccccttgggaccaccattctgtttctgtctctatagttttgggtacttaggtacctcatataaatggagttatatattttttaatctagtgtatgtcatacagcataatgtcaaaattcatccttattgtaacataagacaaagcatcctttttggccccatgaggatagtgagatggaacctcagatcttatgcatgccctgaaggtaccctaacactgagctacatctcaaagggctggataatattcctttgtacatgtatacattttacttatgtatttaacaatggccatgtgggttgttcctagaaagcataattatttaatagtaaggcccaaattagtttctgtttctcagcccaccaaccagggacccagactcctaccaaacttaaggatatggttgagattctaccagctggcttcaggggagtaataccatctacagtgttgtatttttgcgatttgagttgtcttttcttctaccactattagcagtccgggtcgttctaatttgatcttggtgttcattcttcctccttttcctccatggtctgtattatatctaagttgactccattggtaccctccaagctcacctccaagctttacatatttcctgcttctgttcactccacatgtaggatgcctttcctcgactcctaccctcagacagctacctgtctacatgctcttcacctgggtgctcctgggtcttttacatgagacttgtcaaaacctcatttttttccagatgtctcgtgctatatgtgcagtcttgagacaattataaattatgtctgttatgatattgggatgaaattgtctagacttgttgggtgcattggcaaatatctttatctcaaactcttgagaggcagaggcaggtggtggatttctgtgagtgtgaggccaggcttgtctatacagcaagttccaggccagtcagggctacacagtgagatcctgtctcagaaaatattgtcttgagttttgaagtgagttattattagatggactacttcctgtttttgctaggagtggttccttgaacccagggcctcatacatgaagacaagtgctttcccacagaattatatccccagcccaaatttttatttgttaattcattaattaatttattcagacacccccccccccccgtgtgtctctctgtgtctgtgtgtgtgacacatctgtggaactctggagagctttcaagagtcaattctccccttcccatgaatgaatgttggttctctctttttaccatgtggggtctggagagcaaaatctgttcatcaggcttaccagcaagcaccttatctgctgaactatcttgttgctcccaactccttttgttgctgttgttgttctttgttagttggtttttgtttgcttgtttgtttgtttgggagcacgggctgataagttactgcctaagcctcctgagtagttgagactcaggcttgtaccttcatgataagctaggagtaaaattttaatttttatgtgcaatactgacctacagtgactaaattgccttttttagcataaaacttcagttctcctagggacttggtagagattttttaaaaaaatatgtagctgtgtttatttgtatgtgaaacagggtctcactttgtagctcaggatggcctaaaacttatagcaatctcttgtcttagtctcttgagtgctgttataaaaggtgtgtaccaccacagaatatgagacaaaggcatcctgagtttgagaccaacctgggatatatggtgagaccttgtctcaaaacaaacaagtcagctaacagattgcatattgagcaatatttgattgccactggggttctttgctgcttgtttatttgcaggggttttggggaagcaggggtataatacgcaaagtagaaaatatatttgtctttgtggacctaagagtcaatggtgctttgtggcattatctaaatgtgtggttgtgttctgataaatttttattaaaaactaaggacactaaagacccctggctggattttgtttggccaacaactatttgttagcctaccagttatgcagaagttaagtgtatgtatggatttgtgattaattgctggcctaacaagggtttagtctctattaagtggtataagtaatagatcagataaattggctaaggaagggttcagtgatcactgttttgtttttaaggtaggagatgtagaagataatatcaagctttgtgtatgtgtgccttttttccaatgctgaggatggaacatttccttatatgtttacacagcctgttctttatgggtacctgagcacagctcttccagttttctggtacagcagatagcagtctttagtaactgcttccatataagaataaaaaaatgacaaactactaaaattaaaataattccttacaaagttttgaatttctgtaagtagaacagctctttctaatacctttccaggcattgttatcttcaattcttcagttagaaaaacagagtactaacttttaatatgcttctacatcatctgttaattctctaatcttcatttccttatcctagcaattccatagccccatgcattctccttctaatactatttattcttaaatcatatataatttcctacatttaaaaaaattccaattttttattaggtattttcttcatttatatttcaaatgctatcccgaaagtccctataccctccccctaccctactttttctatccataccttttcttcctgagactactctaactctctatccttggtgtctccaagttcacccttgctaatcaatgcatcagtcattaaaccagatgtgtatatggttcctcatgattccaaaatcaaggccaagtctggcaacgaaccatttccaaaaaggaccatataggcttttatggctcctgtggttatattgtctagaccctaaaggccaagtggacatctattcctcatcttctacagcctccattcctcattcctgaaaacggcatctgtttcaattactatggcattattagctctgagtaatgggggaaagtagattcccagaaagaaagattgaaagtagagtagtaaagacagtagatcaacctcggggcaacagcaaccatcaatgtggagatcatgggatcaactgcctggcaatgctccaggggcaggaactgtgttacaccttcccttatgcagccatgccggacccagtactagagaatttattagaaagctggatgttgtggtggcagtgcagacctgaaatcccagctactccggaagctgactcaggaggatcataggttcaaggctaccacctgggctatataatgagaccgttctcagtgaatgaatgactgatgaatgaatagtcctggggacatagctcagtagggctgggttcattttcccatattagaaggaagaaaggaagaaaagcaaagaagatcattaggaatactagtatcagactgcttaatgtgcatgagatttctcttgggatcaaggtaatgctctgaaatttgatggtgactatggaatgctgaatgaactgaaagttgtacagatgtatgacttttatgagtggttatgtgaaatttgaattatatcacaagtgctactaaaacaaggtgcaggattaatgtatgaaaataattaccaaacagtaaaaatgatccagaattattgtttggatgtaggaattccagaatatgaatctggttttggttatatgaatttctgagtctttccattcatttttcagtgaacttgtgtggggactgacagggatgagggatgctatataagcggcattgtattagtgtaaccctggtcattcagtgggaataaactcagcttgtttgccccaaactttctggatcattttactgctgggttatcctaaagctgtgacctgctttaagcctgcacatactaaattccaatctgcattagaggatcttgctatggctcaggaatgttcacagaacccccttctctgttacagattgaagaaggaagcaaagctgcagcagtggacaagctacttgctggagatgagatagtggccattaatgatgtgagtctctcagggttcagacaagaagcaatttgcctggtgaaaggctcccacaagaccctgaagcttgtggtcaaaaggtaagatgtgtgtcgcttctttattaaccaagacaaacagagagacatagaatgaagcctatgtggcttgtttatatgttagagatttttatatgtgtgtgagcttaaaattacactttttcctcgttagtttctgaagactgttctaagattccccttttgaatatcagaacctgcacatgtttaagacctttctagaaaatgccattgtgtttgtttataatctaggccacatcctcttacatgctttaaataatctctaaacttttaagttgccatgacaaaagtacttgacagtaacaacctcaaggagaaaagattacttttgggctcatgatttcaagagatttctgcccatcacagtagagaaggactgggtttaatagtggtagaagtattttgcagactccttgtcttagtcacggtttctattcctggacaaaacatcatgaccaagaagcaagttggggaggaaagggtttattcagcttacacttccatgctgctgttcatcaccaagggaagtcaggactggaactcaagcaggtcaggaagcaggagctgatgcagaggccatggagggatgttctttactgtcttgcttcccctggcttgctcagcctgctctcttatagaaccaagactaccagcccagagatggcaccacccacaaggggacacactaattgagaaaatgccttgcagctggatctcgtggaggcatttcctcaactgaagctcctttctctgtgataactccagctgtgtcaagttgacacaaaactagccagtacactccttcttcgcagttttgctgaccaagaagcagaagagatgaactggaactagagttgagctcaaactgtcaagggcttgccctcagtaaccttcttccagtagccagaccccacctccctaaggctctactgtcttcaaaacacaagctgttgggggcagtctgctcccaataagggaatatattgttgcctattgttcatagaaggtgaagggcaggtagttttgattacttttgtttgtttgttcatttgttttttaagaaaaagtttctttgtgtagccctgactgtcctggaactcactctgtagaccaggctagtgtcgaactcacagaagtccccaatgcctctgctccccaggtgtggggactaaagacgggtgccatcactgcccccaccccccagcctgtttaactcttaagcatgaaagacaagagtgggtgtgtcacaaatgcaagtaacagatactaggttcatagtattgtgcctcagtttgggggacaaactgcatgttcctataaagattgggggttggcacttagatggtgctaagaaaatgaaattagggacttaatacttttttttttttttttccgagatagggtttctctgtatagccttggctgttctggaactcactctgtagaccaggctggcctcgaactcagaaatccacctgcctctgcctcccaagtgctgggatcaaaggcgtgcgcaaccacgcccggcgggacttgatacttttatgtacaggataaaaacagtaccccttggtaccatgagaaaacttttattttattgttttcagagatttcaggcatgtgcctctgagacttgttgcatgtctgtttttatagaatcagtggagttgttgatttaattaaaaagttaaattgatattgatgcatccagtatatgtgaagcagaagcaggtggatcactgtgagtttgaacatataaaaggctttgaacttataaatatgtatacatgtgcttgtctcaaaagttaagtaaacatttacttcagattttatcacacactgaaaaacatacttctacagagcaacagttctccctttccctccccgcaaccccccttgttttttagctacaagcagaatccagggtagaggctcagagacgagtaaggaggggctggggaggtagttcagtgggtaaaacacacaggtgtgaggactggcgttcaaatccccagcacttgaaaagcagagacaggagccttggagcaagcggcctattagattagccaaatcagtgaactctgtgttcaaccagaggaacatttctctccctcaggatataaagtaaatagggatctagtaagatacaagataacaaattacaagataaaaaatttaatttttacatactatgtgtgcagtccaatgcatgggagcccttgtacaaggcaataaataaataaataaataaggaaagaaaagtgttatcaacccttatttctaagtgggatatgcttatgtcatgagatgcaattagtcttttgaatgccttttgtttatgttttggcagtgctagagatcagacccaggtactgttatgtgctaagcaggtgctctaccattgaactacagcacttccagtcctaaacacccctttaatcagaccttgtagctcagaagatatcatttcagaaggtggaatatgaggtatcattagtgtataattccttggttacctcatgacccctcagaaggaagttgtcttatttaggaatgctattgctatgttgatacaccatgaccgaagcaacttgaggaggacagggtttatttgccttaaacttccatattactgttcatcattgaaggaagtcagaccaagacaggagccaatgcagaggccatggaggaatgcagcttactagcttgctctttcttcctataagaaagctcagcctgctttttaaatagaagccaggaccaccagcccaggagtggcaccacccaaaatgggttgggctctcccctgtaagtcactaattaagaaaatgccttatagctgggtcttaggcatttttacagttgaggtcccctcattacagataactctagtttgtggcaggttgacataaaactatccagtacagaagtcctttgttgtcatgagatgcaattagtcttagtcaagtgatggtcatgggaggatgctaatcctagaggtaagactaggagtgacacattgcctctgggaattgttactgcctcttaaacctcattctttggttgtgaggggctagaactcccactctttgactaacttgacttttgaatagggaagatacaaatttcaaatcccttcaactgggcatatgaattcttagcataggattttgttttcttttgaaacagagtctcactgtatagtcttggctagccttgaacttgtagaccctcaaaaagatcacctacctctacctttaacatgctggaattgaaggtaccaccacaccaaatgtagcagtggaaaatttttttccatcagaaggtagtatgtacagaaacatggaacaggtttcataagttcacttctttttagtgtcaaatctggtgttataagagtgtgtgtgtgtgtccatgggtttagtgggagaaaaatagttttattgtttactttgcatttctataattataaggtaaagtgggcattgctacatatatttctttttcttttttgtttgtttgtttgtttgtttgttttttgagacagggtttctctgtatagctctggctgtcctggaactcactttgtagaccaggttggcctcaaactcagaaattcgcctgcctctgcctcccaagtgctgggcttaaaggctgctacatatatttcttaatgtgcttgatataattgttttgagtcttgaattatatatctaaaaaggatatcaatagataaactaaagcctatttaaaatatgtcagtgccacctaggaagcaaagagaggagaccatagagcttttactggctggtatagccaaaaagatgtgtaaacatttcaggaagaagaattaaactttgctcctgaaggcttgatggaagccattatggagaactccttttttgtattctacatgctgtttcctttaaatacggagtatagacaattatgtgctttaagtaaataaaagtgaatagtttaagtaggaagattttaaaaacaaagcagtttattcaaatttatctgaaacattttaacaatatacttagtgttttaaatttttgtaaatatttttgtatgaattgtaagtaataagggtaggtattattcaaatttgacatggttctgtttagagatgtgaagacatttcccaagctggtaaattagttaatattaggacttttgtgtgtttcttagtgcatggtgaataattattgttaatcttaaagataaacatagtaaagccatgcaacactccagaataacaggcttcatttcaaataaaccagttgttttaaaaaattcagcatgtattcattcacttttttctccatgctcctgacaaccactcaatctgctttctgtaccgtgtattagttagcatttactagtattttgtattttatattgagttccaaggtggaacagtccttctcagaaaaacttcaagacctggggtggccccatagtaaacatgtgctcagcacctaaggcccaggttgattctgagcacacaaagaagagtctagctcacaaaaaatcactctgaaagtgactcatagcttgtagctgttaacatttgaattgttgtccctgcatagactccgctccccttaatgacagctgctccctgcttttatttcctgtgtttcttttatcttagtttgtgaggtaaccaggggaacagccaactggaatgagatttcaatagggcagtttgacaaagcagtggtatcttgtttcacaaggccccagcaatcttgtcctctttgagaagcagtgtcctgactttaatgcctgaagggacatggtgatatctgtattcccagtgaagattcttccacagacaaaagagagtggttacttttcgcagggttagctggggaagaaaaaaacttcaactatcatctccagaaagagcacatgttcttcatgatgtccaggtggcattcggggctcttgagcagtagggtgggggactctataagagccagatctgtggggctgtgacaagttgagtcagcatgcctaccttgttctttggtttccaaggtgtttgatgtttcagtgtgtccctttgcagtgctatgtagtttttagtatatatttgtttgtctctatagagttgtcacctgctttgtcctcctcagtgcacagttctgcacctggtgatttcatggataagggctggcatggatctgggctctaaggttttcacggaaggctacagactttttgttggggaccagtgttgcggtaaatcttcaacccaaatatgccccaacaatgaaaacacgactcagttattatgaatccatgctgtgtgcctagattgggcagctctactactacattatctttcacatcaatgagaccccttagaacttgcagtttctccaggccatgtgtttctgctctgcttttcttcttcctcctcctctgcgtcctctccctcttccattttctcctccttctctctcttcaccttctgctccaccttccctttatctgcccaatcatcagctctcgtttattatacaaattaaggatgggaagcaggtttacaggaaatcacctgagtgctgactctttccttgtttgcaacccctccccgaagaacggaattaacattaaacataattagccccagggcaacccacaatttagcagtgttggtttggccactcagttggattaaaaacagaaggaggcagagacacaaggacttagagagttcagcctggtctagaatgagtttaacgacactttgggtagtttttgagatgctgtctcaaaataataaccataaagaaagtctgggggatacagctcagtaattggaatacttaactagcatatgtaccaaaacacatcaaaatgtacacatgaaccctagggaaaatttcttttaaatattatgccataaattatttttataaggctgatctattttcaatcttttttttctttacgatgaagtataactgccttattttaaatcttactctggtagttccttgtaatcctgtcctagattacgtgccattttgttggggacaagccagggtagggttgattcatgttacttgtgtctttgctggtagccataaaccgtcttgtgaatctaattatatctcctaagctttcactcagtagcagcttaacaacaaagaggaggcttttctttcctggaagctgcaagggttaggcagcctgcatcagatggttacacatttttcagaaagcagacttcaaaagctggggagtagacttgcttgctgggagcaagtttcttgcagcaaatatcattctctaatgttgcagagtttcattgccatcaacttcagactagtactttattgtgctctcctctgccctggcctctgccatggctttgagagcgtagctggagttcctcggtgctaattattagcacagacgttcctgtgagtagcaactttcagtgagtggtatggcaggagtgatcgttttgagacagcaacagatcctttgtctccttctatttcctctcctctcctcttttctcctttccagtgagcctttccttggtggaattctcccagaatagggactcttggggtgtggggtttctatgggtatcaagtgaaagccatactttacagtagcttgctcttctttgctaatggcttagggtattatttctattctgtgagcttttgggggcatgctactgtgcttctttacttgtggaagcagagatgttgaactttatagcctgattggtttgcccttctttcagtattttctttatgaaagtcaagaaaagaaataaaaccacatagttcataagagttttatcttgaatttggacatagatgtagcttaagaaatttaatcagatgagtctctgaaacatttcattttctaggtcaaagttaagacttttgtttttccttctttcttcattgtgaaaaataaagaactagatctttatgaaggttgtatgcatactgtaactaagacatgcaaatgatgtttataaagttcaatttggcagaagtattgtctaatgagtcctaatgagtaaaagagacaatactttgaaaccattgatggcttttagttttcattagttatacaatttttgttaattttttggtaatacattttccttgtatattattatcactatactttgccttttgttttcctctggtgctgaggactgaacccagggcctcgctgatgctaggtaagcattttattattgagttccattccaatcacattgatggtttttaatatattaagagacacatatttactatatcaaaagagacattaagagaaactgttatttttgtttatttcaagtttctaaaggaacttggttttgtttgtttgttttttttgttttgttttttgtttttttgttttttgtttttttttttgagacagggtttctttgtgtagccctggctgtcctggaactcactttgtagaccaggctggccttgaactcagaaatccgcctgcctctgcctcccaagtgctgggattgaaggtgtgcgccaccaacacacggtaggaacttgtttctttttgtttagtttttgagacaaagtttcactaggcccaggttggcctcaaacatgagatctttctacttcaggtttcaaaatctgggattacagtgtgtgccatggcactcatctcagaggaactataaattgtataattagctttatatgttacagattatctcattttgagatctaaggaattaagttgtaaattgtagcattaacaatgcagcttatatttgtggttctataccatagattcatattctatacctatattctgctctcaatttatattctttttaaaattattattagatattttctttctatacatttcaaatttcaaatgctatcccaaaagttccctataccctccccccgccctgctcccctacccacccactcccgctttttggccctggcattcccctatactggggcatataaactatgcaatatgaaggggcctctcttcctagtgatggccaactaggccatcttctgctacatatgcagctacagacacgagctctgggggtactggttagttcatattgttgttgacctatagggttgcagacccttcagctccttgggtgcattcgctagcttctccattgggggccctgtgttccatcctatagctgactgtgagcatccacttctgtatttgccaggcactggcatagcctcataagagacagctataccagggtcccttcagcaaaatctttatggcatatgcaatagtgtctgggtttggtggctgattatgggatagatccccgggtgggatagtctctggatggtccatcctttcgtcttagcttcaaactttgtctctgtaactcctttcatgggtattttgttccctattctaaggaggaatgaagtatccacccattagtcttctctcttcttgattttcttgtgttttacatattttatgttcggtgttctatgtttctgggctaatatccacttatcagtgagtgcatatctaatgacttcttttgtgattggattacctccctcacgatgatgccctccaggtccatccatttggctaggaatttcataaattcattgtttttaatagctgagtagtactccattgtgtaaatgtaccacattttttttatccattcctctgttgaggggcatctaggttctttccagcttctggctattataaataaggctgctatgaacatagtggagcatgtacccttcttaccagttggggcatcttctggatatatgcccaggagaggtattgcgggatcctccggtagtactatgtccaattttctgaggaaccgccagacggatttccagagtggttgtacaagcctgcaatcccaccaacaatggaggagtgttcctctttttccacatccttgccagcatctgctatcacctgaatttttgatcttagccattttggctggtgtgaggtggaatctcagggttgttttgatttgcatttccctgatgattaaggatgttgaacattttttcaggtgcttctctgccattcggtattcctcagatgagaattctttgttcagctctgagccccattttttaatggggttatttgattttctggagtccaccttcttgagttctttatatatgttggatattagtcccctatctgatttaggataggtaaagatcctttcccaatctgttggtggcctttttgtcttattgacggtgtcctttgccttgcagaagctcggtttctgttagtaagatcctttcctttgcctttccccatctggtaatctctggagttagttgttatagttgtctctggttggatcttgttcctcctgtgattctgttagcttctatcagccgacctgggagtctctctctctcctgagtctcagtggtcagggaactctctgaaggtaagctctcctcttgcagggaaggtgcacagatatctggcattcagacctccctcctggctgaagaaaaaggcctgaaacagggcctgtcccagaagatgtgttgtctctgcagtctgcatgcttacgtgcacagactggtctccgagggactcaggatacaagatggctctctcagctgctctggtggccagagccctccagggcagacacctctcctctgctgaggaaggtgcccggatgtctggagcctgaaacggggtctgtcctagaagctgtgtcgcttttacctgtcccagaagctgtgtagcttctacagtccacttgttcatccttcgcagtctgtgacctgacctgtgcagactggtctctgagggatccgggacccatgatggctccctgacctgctctgaaagagtcctcctggatggacacctctcttctggtggggaaggtgcccggatgtctggagcttgaaatggggtctctcctagaagctgtgtcgcttctgtagtccgcactgtcacctctgcagactagtttctcaacttatattctttttaaaatgattactagtgatgagatctacctaacataagatactttactttaggaagaaagatttccctatatacagttgaattgtaaagagaagtatgctcatgagattagggagtattctcccttgatatatgggagaagtgccaggacctgcagcccagcaggcaccagggattctggtaagttctcaatggttttgcctgggcaggaggcccatgttctggttatgtccatcatgttgctcacctttgttattacttgtagaagacctgtgactctcagaggtgtctgtcctacccttggctatgttttgaggatgccctgtttatcagggctgactacttgacctaggaaaatatacttttggtttctcaccaaagggcagggagaggttatatcggtagaactatagatggctgcccagtagatcacagagagtgaataaatgtcattttttcttacacttgtctcatcaagtttgctagtactaatctcttgattgtcttttgggaaggaaacaaacacacttcttaccatataaaacctctgttttctaaaaaaaagtttcactttgcattttgtttgttttgcatcatctgcttcatttatgcaaggaaagtgttcatgttatgagaactgcctagtgtgtctccctcctactctcttgatatttgctcttcccccagtgcttaaatattttcctgtctttgccactcaagatacttgtataacccaacccttacaaaaaactctttagaatagattccagtgaagtgaattttatatagccttttcattgtagttaaattcaaaactttttaatttaatgaagttgtattgttaatgcttttattagtgtgattatgaaatgtctgactaactcagttgtggcacatgcctgtaattccagttctcagaggcaagaagagcaagagttccaggctagcatagagtgcataaggtgacactttgaaaaatacaaactaactaaactaactaaataaataacttaggcccttttgcctatgagacttctagtattctttcaggtagaatagttgttatcatggtttggataaagggatggcaagtatctggcctccattatggaaaatggctgtattactttgttggtatatatttgcttgtctgtagctgtagtgaaatgacagaaacacaatgacaacaaaatccataaaaacaaagtatacagttgtttcttgagcatcttctctagcttcagtttctaagcacaatcaaatataaatgttcatctattgtcattattactattttcagtttctagaactgagtggaattgggggcttcctgaatactaggcaagcactctactcctgagccacatctcaggtcttcaggtttataaaagttaaggataggggctggagagatagctcagtggttaagagcactgactgctcttccagaggtcctgagttcaattccctgcaaccacatggtggctcacaaccatccgtaatgagatctggcgccctcttctggagtgtctgaaggcagctacagtgtacttacatataataataataataataataataataataataataataataataataatagctaaggatagagagggtgtttttgtagtttggtgcttttccaaagaaaaggaccatccatcctcattgatctgatgtataataaaacaggtggcaatttccccacagctacttagcacttatggatgtagagtgaccaaatatgtgagatattatttaatagttctccaactatggaaaacattggaaagagtgtaaatcaacagatttactttgaaaatgccatctaattaattttttttcattttaagacagggtctcaggtgtcccacattggctataaagtcagtatgtacagcctaaggatgaccttgtactcctagtcctcctgcctctatttaagtgttgcgattgcacatttgtgccaccagaacttgttgacaagtgttatttaatcagaatagcatttgactattcacattcatcctgcagcagttggctgtttcctccacctccagacagagtcttgttttattgtccaggctgcccgtaaccatgctgtcctcctgccttaacctctcaggtgcatcaattataggtgtataccaccataaacagtatgcctactattctttgtagtcaacagacttagtgatagatttcatgaaagtcatttatttttattttataatagagttcttatcccaaggccaaggttcaattcaacatttttttgctacatgatgatgctaatatcagtctcttaggttgcctttctatgtgttatgtatcttttgtatatatcatatctatttcttggtccttttttagaaccttctgaattctcaacgttttatctgtggatactgaacattaccagaagctctaaaaaggagatttctgttttgagacagaatggatgaacgtgctcttattttttattttatttttattttttggatattttctttatttacattttaaatgttttcccctttccaggtctcttcttcagaagccccctatatcatcccccctcccgcttcctctatgagggtactcccccccaccccactgcagtcttccagccctggcattacagtacactggggcatcaaacaacctcaggcccaagggcctctcctcccactgatgtccaacaaggtcatcctctgccacatatgcagccagagccatgagtctctccatgtgtattctttggttggtggtccagtccccaggagctcctgggggtcgcgcctattgacacggttgctccatccatggggctgcaaaccccctcagctccttcagtaccttctccaacccctccattggggaccccgagctctggtagggaacacccaccactgtatttgtcgtgctctggcagagcccctcaggagacagccatatcaggcttctgtcagcaagcactttctggcatccacagtagtatccaggtttggttactgtatatgggatggatccccaggtggggcattatctggatggccttcccttcagtctctgccccacactttgtctctgtatatcctctcatgggtattttgttcacccttctatgaagcactcaatgaagcattcacattttggtcttccttcttgggcttcatgtggtctgtgaattgaatcttgggtattttgaactttggggctaatatccacttatcagtgagtgtataccatgtgtgttcttttgtgactgagttacctcactcaggatgatattttcaagttccatccatttgcctaagaatttcatgaagtcattgtttttaatagctgagtagtactccattgtgtaaatgtaccacattttctgtatccattcctctgttgaggaacatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccatcaacaatggaggagtgttcctctttctccacatcctcgccagcatctgctgtaccctgaatttttgatcttagccattctgactggtgtgagatggaatctcagggttgttttgatttgcatttctctgatgattaaggatgctgagcatttctttagatgcttctcagtcattcaagtttcttcagttgagaattctgttttgctctgtaccccattttttaaaagggttatttggttctctggagtctaaattcttgagttctatatatatatatatattggatattagtcctctttcatatgtgagattggtaaagatcttttcccaatctgttggttgctgttttgtcttattgacagtgtcctttgctttatagaagctttgcgattttacgaggttccatttgttgattcttgatcttacagcacaagccattggtgttctgttcaggaacttttcccctgtgcccatgtgtttgagacatgtccccactttctcttctattagattcagtgcatctggttttatgtggaggtccttgatccacttggacttgagctttgtacaaggagataagaatggatcaattttcattcttctaaatgttgaacgccagttgaatcagcaccatttgttgaaaatgctgtcttttttctactggatggttttagctcctttgtcaaagatcaagtgaccataggtgtgtgggttcatttctgggtcttcaattctattccattgatctacctgcctgtctctgtaccaataccatgcagtttttatcactattgctctgtaatacggcttgatgtcagggatggtgattcttccagaagttcttttattgttgagaatagttttccctaccctgggttttttgtttttcccaatgaatttgagaattgttctttccaactctatgaggaattgagttggaattttgatggggattgcattgaatctgtagattgctttcagcaggatagccattttcactatattaatcctgccaatccatgagcatgggagatctttccatcttctgagatcttcaatttctttcttcagaaacttgaagttcttgtcatacagatccttgacttatattgtttgtgattgttgtgaaggatgtcatttccctaatttttttgtttttgtttttggtttttgtttttgtttttggagacagggtttctctgtatagccctggctgtcctggaactcactctgtagaccaggctggcctggaactcagaaatccacctgcctctgtctccctagtgctgggatcgaaggtgtgcgccaccactgcccagcttcctaatttctttctcagcctgtttatcctttgtgtagaggaaggctactgatttgtttgcgctaaatttatattcggccactttgctgaagttgtttatcagatgtaggagttctctggtgaagtataggatcatatcatctgcaaatagtgatattttgacttcttcctttccaatttgtatccctttgacctccttttgttctctaatttctctagctataacttcaagtactatgttgaatagatatggagagagggtgctttctattgtttgtgaagaattaggagtatgtgcaattgcaaaaggccagctcaattctactcttctcctaccttgggctttccagaagcatcctgctcagttgtgctgtaagacttgtccctttgggatctttttacagccacccccagccctggccccctgaccagaaggtttcccactggctcgtctctagtcactgagactaccacggtattttcagtgcattttccttttgccctttgcagggattttccaacctctacctccttttctctttgctgacaggaactaggtaagattccttttgtaaaggtcctggattggggtgggggtgggggtggggcaccgtttccctaagactccttccctctaaccttggaggacccatcatacatccatcctcatgggtttcttgggaaatgatctccataatcagctgtagctcagacatgctgattctgtggctactttttttttttttttgaagaaaggggtcttgctctgtagaaaaggctcacctcaaacttgtgggaatccttctgccttcactacctcaggactaggatcatagatgtgaatcactataccttattttgtgtctttgttcttatatataagactcattcgccctgctgttactccttagggctatttatagtagttacattaatggctgcacatttgaatgtcttttgtttcttagccaacattatctgttcattgaagtgaggccagggagttgtactggagtccttttaaatgctgcttgatgtgttaggcagctgaaatatcatgtgttattgatcgcaagtggtttgggtatggagtggagaggataaagagctagcctttcttttctttccagtactagtaaaaggttgtgacaaaagataagaaaaatgatagtttatttgggtctgcttcaaaagtgggtatggtgtgagtttattctgtgacattctttcagcagtgggaagagtgacactagaagcagcttccttgctctggccagggctgagataagagactgtactggctgggaaaagagcaactgtgaagctttcatcctttgactgcatctgttattgctgaagattggcctttgatggcttctatcattttcatctgctgagtgtatcaagacatttgtatctttcctgaattcttctaatgtataaaagcaggggctctcactctggtcccaaaggaccagatcttatcaggcaccatgctctcattcacagcatgacatctctgcagcactgcctaggaaagaatgtactgttctgttaacttcccacagtgccgttaaacagtcaacatttctttcttttcctttcttctatttattgttttgtatagcttgtagctgcctttgtctcacctatgttcccataagtagccccagtaaactcactggtgcactaagctggacttgggtagaattatttttggtttgtcatcagtgtcctggggtgaatagatatttgctcatgtattcccagaaaccgtcaatcacaaacacgctttctcttgcttttccactgccactctaggattcacagctgtgttccatctcaggtgcacttggtatgactgacttaggttggtattttcatctaacagctggctcagcaattgaagtacagctccacggctttgtcttcaggacagacagcattttccctcttgaagttaccactcactaattagagcatctgtggcccatgttttatgagcccattcagttgagagcatcccggaaagcagaacttactggaatgatgttaaccacttggctggtgtgttgcttgcaagttaagtgaccatatattataaaagatatgttagagcatttttgatgataacattgttgaatctactaaaaagtagttaggtctgagagtacaggcatgtaaccccaccactcaggaaaatctagaatttgtagccagcctgggatacatggcaagttccaagacccagtctgggatacacagtatggccctttctcaaaaaaatagaaaaataaaaagataaggcgttgctcctaagaacctttctaaacagattcactttccccttatcctttcttttctactacctctggagggtggtgggctaaaagggaggttaaagtgtttaagaaccaccattaacaataggttttgaaaaaattaagttacaaggtagaaactgactcagagagagagagagagagagagagttattttagaggcttaataagaaaaggaaggaagtgcacaggtgagagccagtgtccactctgcatgaaggtacttcttaacttgtttgaaaaactggaagtgtgggtaaattgccaggatccagctaaattccatctcccttaccctggaccttctgaaagcatcctgccttctgtgagtcttgccaggggtgggatgtgttggctttgtatatctctccaaaggctgtgggctctcccactgctgcttttgaagtcactgaggcccaagtatttctagcacatttctacgttgcccatttaatgaagtaaggcctttgtaaactttgcgtcttatgtcatagatgctctaaaacaccaagcatccttcttccttcactctcaatatgtggaaacagcctcctaacctccttggtcactttcaaggtaagggaatgttctgagctatttcctcaggcatccaggaatttgaacagccacttactccttaccacttgcagaactaattggggcaggaccaccagacacagcttgtatttggggaggaggtacagcctcactatcttctaaatagttacaaaaataacccaattcacatatgattgtttattttttgaggagagtgaaggattctgtatttcctgtgaataaagaaaaattcattaaaatactcatgctaataattaaaagaatataacagaagctgggaattctggtgttcaatcacaattttgattgtaggttgcacagcaaattccagtttatcccaggctatgagagactgtcctcctccccctcctcatttttttttatcactctatgccagtttttgtactggtaagataaaacccattctttcaaaagaaatgtatccagtattgggctggggacttggtttagtgtgtaatacacttgccatacaagcatgaacacctgtgtttggttctccaggatctatgtaaacccagatgcaatagcacatccttataatacaagtgctcctacagcaaaatggtaggttgagactggagaattcctagaagctcacgggccagctagcatatcatatggggagacaattaaaagaccctgtctcaaacaagaaggcaagtaagctctgatatccaaggttgtctctgaactatacacatatattgactgcagcatgtgtgcctgcatgtatatacacaaacctgtactcacatgccaacacataggtgcatgcacacacacaaagaccgtttccaagttggacatgaatttttttttaatgaagtaaaatcagtttgttttgtacatttaaggcagttgatttcaggaaaagttactagagtatcaacagtaatatctttcttgttctttgcatgacctagactctgggaacaaactcgttactattaggcacttcaggctgtttgtttcttctgctgtggcatacactgggttatatctgtgtcctatacccatattactagagacgactggttttaagtccatgcatgggggggaaacaggagagcctaatttctaagtggatttcaaacgttcttatcacctgagaatgggtagaactagtgggggccagtaggtggcatcagagaacacaccatctcttcagaattgtgaatgacaagccaactagcctctagatgctatctgtttcttattaatacaaccccagctgtttctcagcatctgaaatgctaacaagcctgatgtccttgattctaaaatgtggtcatggtgtactagtaaatttagaggatatggaagcaatcactcgcactttaggaaatgttactgtccctggtaggcattggaaccttcagtgattgcatataggagtataactcttttctctatatcttcgtttgtttattttttaaaaacagccccagtaaacataggaaccttaagtctccttgacacgcccactattctagtaatcttcagttacccttcttactctttgtcttcattggtttatttaagagtcccagtaagatctcagctgccgactatatatcgaaatcgatgcatctatctgtgcattggcttttaaatatcaatagtgtattatcagtgtgtgtgtgtttgcatgtatgatgtgtatgtgaactgtgtagttgtggaggccgaaggaaaaccttgagacatcagtgttcttccatcttaatgtggcttctggggatggaactcagggtctcaggcttgtgtggcaagtgcctttttccagttgagccacattgctagccctgtgtattttctttttaagaaccttcagaggctgacgagatggctcagtggttaagagcactgactgttcttccaaaggttctgagttcaaatcccagcaaccacatggtgtctcacaaccacccataatgaaatctgatgtccttgtctagtgtgtctgaagacagatacagtgtacctatttataataataaataaatcttttaaaaaaagaaagaaaaataataacctttgggatttttcatggcctcacagaacatagtgcattatttgtacacacttttcaaagatatatttctgtcttacttttcttagtctagtccatctgccttggagaacttctagctaccttgcacacaaacatcctcctagatgtggtggagagccctcttccatagtatcaggctctggtccttttatgctaactaatggctcttactaggctttcttcagaggaaacattctaaaacagccaggaagaagttacaggcttcccacaaccatgctcaaattccctagaatgttatttcttcccattctgctacctttattaaatcaaaaagtggggtctaatacagtgaactcaggcttgctgagaacttactatgtagcccacgctaggttcctacttataccagtcctcctgcctcagcttcctgagcgctggtttgtaggcaagagttcatacacctgactccattttgttgcttgctggttaccctaatcaggctcacactaaaggggaaggagcacaactaatgggaaggtagcagagatggtacagccactttaaatctattacacattttgtttaaaaaaagctactattttagaatttgcttactaatagtagttgtcctagacattgctttcccatggcctcagctagtatctcaaggcattctagtatggaggtgcaaatagtgttatcatagttgaggcattttctttccttagccatatttttccttccctctgccctcatgttctgtcaatctagttcctttttcttaccagttaactgaaaagagagatgaaaaaaagctacagatactataccataggaaaaccctgcagaataaagtgtacgtggttagagccttacttctgaaggttttgagaaattctatgaggtacattcctgattttgtaattctttacatctgaggtgtgatagttattatcttctttctctagtacctgtaaaatgaacatgaagtcaacattttttggcgctttgcatacttattaagactattggtcttgcaaactctatatgcctcagtacaggggaatgccagggccaagaagtggggtttgggggacttttggggtagcatcggaaatgtaaatgaagaaaatacctaattttaaaaaataataaaattaaaaaaaaagactatacaagtcattagaaggtttgtgttatagtgatttttggttttatcttagaaagtattctttattatataacactcttcaatatttttgcctgtgggaaaaaatgtctagtctgttatttacctaaagctgttctgtgtgatcttttgacacccttgactggctcaaaaactgtctttaattggagctttgagaggtaagggtagcttcatgcagtgactttggagttgaagggacttgggttggatctccatgtttgtgatattctgctgcaggtatttttgttgttcttttgggggtactggggatcagtcccaaggcctcatacataatctgtctttaaaaaacacagagaacagtaacaacaaaacaaaataagagctggagatgcagctcagttggtagaatgtttgcctagtatatagaaaagtcttgagttctatcaccaacactgcataaaactgggcgtagaggtgctcctgagaattcaggggggagaggcaggaggatcagaagttcaaggctagccctgggtatattagacattgtttcaaaaatgcttataacatttctaactgacaacaaccttatccatttatggaggaataaattaaaaagactaagggtggttttagagcctatgattcccactctgtatcatggcagtttggtcattagcagccatctgaagtaatgtgcatgcccatatatagtagaaagcagctgtaagccatgtgttttgggtggcagcagataccattagttccctttgttgggtcctgctgttgtcctggacaggaagaagtgtgtgaagtccctttctttgtattcttttccaggaaaagtgatccaagttggaggccccactcctggcacgctaccaagtactttgatgtccaccctgagccagcagcctcactgtttctgaacaccagcggttccccttcctggaagagccagcaccaggctaggtaggtactctttcccggagaccaaacaccatgtaagtatgacattctgtgagtactcagaaattcccttaagttttgggatttgacttcagaacagtcaaggctactgatcctcaattagggtttgaactgaatatttcactgagcacagaaacatctgataatagaaaacaaacaaacaaataaataaataaataaataaataaagtggtaagacaaagaacgaacaagcttttctctctctcttgtgtttcttgaggaagcttcagtttttattcttgtggaatcctttgagactgtcaagtgtgatatcacggagttggattctgaatctagcaggtggggttcccgttataactctgtcttctcagccatcatcttctttcaaagatattttgatggattggcaagcaggtgatgtttatggggagggtttactatgtctacatctagtcttcagtactctacaaatgttattgattagatgtctcacgtattctgatggaaggatgacagtaatgatggctggtatggttttggcatgtgtttattgtgcatgagtatatcatcatggctgtatgaattgtttttcccctgtatgcatttgtgcctgtgtatggctgtgtgtgtgtggctaaatgtatttgtgcacgtatgcatctgtgttatgtatgtatgtatatatgtatatatgcacatgcagtccagtatgcatatataatatacaagtatgagtgtacaagtataatttatatatatgtttatatacacatgtggatatctatgtgtgtttggaaataatattagtttcttatacatttctattacattttgttatatattagttttacttttttaaaaaaaactttagttttaatctttttttttaaagatttattttatttatatgagcacaccgtagctgtttccaggcacaccagaagagggcatcagatcagatggttgtgagccaccatgtggttggtgggatttgaactcaggacctttggaagaacagtcagtgctcttaaccactgaaccatctctccagccctgcaccccccctttaaagatttatttatttatttatttatttatttatttatttattatatctgagaacactgtagctgtcttcagacaccccagaagagggcatcagatttcattatggatgattgtaagccaccatgtggttgctgggatttgaatgcaggaccttcagaagagcagtcagtgctcttaactgctgagccatctttccagtcctagttttactttttgaggcagggtctcatacggatcagactggacacaaactatgcagtttagactagccttggacttgatcttcctgtctctttaactcccaagtactaggattataggcatgagctatcacattgtttccaaattttctcttaatttttaaaaattatttatttacttttagaaaacattttatttttatcactttctaacaatgtgtctctgtgtgtgagagtgtgattttggtatataagtgtggtacctgcagaagcttgaaggttttagaaccttggaggtaaagatacagacatttgtaaaagttcctctgtaagagtagtaagtgtcttaagtgccaacccacttctctagccagccctctgattatattttctagcatacaaaataatagtatgctttatggcattttagtacacatatagttttgtactttgctcatattgagttttagttactacccattttttccatcccagtagccctttctccgccccacccctacactttcattctgcataggagaaaacatgtacctcccactcctcctcatctttctaacttgctcatcctccttatttctgagatgaggtctcactatatatgttctggttagtcttgtaattgctaaatagacttgactgtcgaactacaggccatcttcctgcctaagcctttcaggtactaggatcacaggtgtccaccaccacatctagttcccttctctccatccccaaatagggatggaacccagagctgtttgcatactaggcacatgttctaccaatgttatatcctcagctcagcaactcttcttcttctaaccatctcagatttcattgaggctgttagttaacgcctctctgataacagattgcagagtaagcacttatgtgacgtgaaggaagtacttctcaaatgcataatatttacagcaacaagactggatagtatttattttgaaaaaccacagattctaaactgagcaaaaaaagggtgaaaatgtgtttcatatttcctcattggagtgccttgaacgtaatagaatcttccacttaccagcttaaccagtcaccccattagagaagcatctatgctagccacatctatgtataaactgggctttgtgctatttgtatctggatgaatttatggtaatgaataatctggaacatattctattcattaaggattcagtctgtccttaaagaaaatgctatcaaagccaagtggttatctgtcaccctcaggcgacttagccaggtctgtctcctatctttaccctgcttgccattttctctcttatccttactctcccctaacataatatagccacacttttctttcttgaagcatggaaagtcaagctttaaggaaaacatttagcatcctgtaagtagttttgccagtaagagacttacagtcatatatgcacagtgactgttctgtggaataattacttactcagccaattacttactctgttttagacacagtactgactaagaatgtgtggtttgagtgtgcatgtgcagccaaaatgagactgaaaagtttaaatccttcatctggacagagaagcacatgattctgctgctaaagcctattgcttcttgtctcagtcagaatttacgaatgaactgttgataattaaatatttgagaatggaaatttcctgaaatttctcttgtaattctaaagcatctcatttgatgcttccttaagatgaactgtgtgcactacagcctgtgttataaggagctattttccctggctctgttagtgttcaacttggctattgtaacacaagatgtagaaagaagagcatggctgtgttgctataaaactttatacattgaaatttgaactttatataattatcttatgtaagtcaagagaaatattcctgttttcttttccttcagctattcaaaaatatataaatgggttcatgcatagtccctactttctcctctagcagatttagggtattagggcttattgttgaggttcttggtccatttagaattgagttttatgtagggtaagaaataagactctagtttcattcttctagctatccagcagtactctttggtgaagatacaatcttttctccattagatttgttggccttttttctcactaattaggtggctgttgtagtatgagtagatatgtgggtccttggtcctattccattgataaatgtgtctgcttttatatcagtattgtggtgtgttttggttactatatctctgttccacaagttgaaagctgggatagtgatgacctcaacatttttgttgttcaagattattttaactatcctgggtgtttgtattttcctgtgaaacttaagattgttttttcaatttctgtgaagaattgtgttggaatttgtgtgggggtttgtaaattgctgttggcagactgaccattttcagtattcatcctaccaatccgtgagcataggcagccatcgcatcttctgatgcccttttcaatttcattctgcattgtcttaaagttcttatggtacaagtcttccagttcttagatttattttaagggtttttattttttttaattagatactttctttatttacatttcaaatgttaccccctttcctggtttcccctcagaaaacccactattccctccaacctccccctactcacgaacccacccactctcttttcctggtcctggcattcaactacactgggtcattgagccttcacaggaccaagggtctctcctcccattgatgacctacaaggccatcctctgctacatatgaggctggagccatgggtccctccatgtgtactctttggttggtggcttagtccctggaagctctggggatattggttggttcatattgttgttcctcctatgggactgcaaactccttcagctccttgggtcctttctctagctcctccattggggtcccagtgctcagtccaatggcgggctgagagcacccacccctgtatttgtcaggtactggcagagcttctcaggagatagctatatcaggctcctgtcagcaagcacttgttgacatccacaatagtgtctgggtttggggacagtatatgggatggatctccaggaggtgcagtctctggatgtcctttccttcagtctctgcgccacactttgactccatgcttcctcctgagggtattttgttctccattctaagaagcactgaagcatcctcattttggtcttccttcttcttgagctttgtgtggtctgtgaattgtatcttgggtactccaagcttctaggctaatatctacttatcagtgagtgcataccatgtgtgttattttgtgattgggttaccacactcaggatgatattttctagttccatctatttgcctaagaatttcataaattcattatttttaacagtactccattgtgtaaatgtgccacattttctgtatccattcctctgttgagggacatctgggttctttccagcttctggctattataaataaggctgctatgaacatagtggagcatgtgtccttattacatgatggagcatcttctgtgtatatgcccaggagtggtattgcgggatcctcaggtagtactatgcccaattttttgaggaaccaccaagctggtttccagagtggttgtaccagcttgcaatcctaccagcaatggaggagtgttcctctttttcagacatccttggcagcatcagccattctgactggtgtgaggtcacggcagttttgatttgcatttcactgctgactaaggatgttgaacatttctttaggtgcttctcagccatttgatattcctcagttgagaattctttgtttagctctgtactctatttttaaaagagttatttggttctcttttctatttttaaaagagttatttggttctctgaagtctaaattcttgcatttttttttatattggatattagccgcctatcagatttaggattggtaaagatcttttcccaatctgttggttgctgttttgtcctattgacaatgtcctttgccttatagaagcttagcaattttatgaggtcctattggtcaattcttgatcttacagtacaagccattggtgttctgttcaggaacttttcccctgtgcccatgtgtttgagacattttcccactttctcttctattaggttcagtgcatctggttttatgtggaggtccttgatccaattggacttgaactttgtacaaggagataagaatggatcaatttgcattcttctacaggttgaccaccagttgtgccagcaccatttgttgaaaatgctgtcttttttctactggattgttttagctcccttgtcaaagatcaagtgaccataggtgtgtggattcatttctgggtcttcaattctattccattgatctacctgcctgtcactgtaccagtaccatgcagtttttatcactattgctctgtaatacggcttgatgtcagggatggtgattcttccagaagttcttttattgttgtgaatagtttttcctatcctgggtttttcgttattccaaatgaatctgagaattgctctttctaactctatgaggaattgagttggaattttgacggggattgcattgaatctgtagattgcttttggcaggatagccatttttactatattaatcctgccaatccatgagcatgggagatctttccatctcctgagatcttctctttctttcttcagagacttgaagttcttgtcatacagatctgttacttgcttagagtcacaccaaggaattttatattatttgtgactattgtgaagggtggtgtttccctaattttttttcagcctgtttatcctttgtgtagaggaagaccactgatttgtttgatttaattttatatccagccactttgctgaagttgtttatcacctgtagagttgtctggtgattttggggtcacttaagtaactatcttatcatctgcaaatacttatattttgacttcttcctttccaacttgtatccctttggcctcctcttgttgtctaaatgctttggctaggatttcgagtactacattgaatagttagggagacagtgtgcagccttgtctagtccctgattttagtgggattgcttcaagtttcactccatttagtttgatgttaactccgggtttgctgtagattgcttttactatgtttaggtattggccttgaattcctgatctttctaagacttttatcatgaaggggtgttggattttgtcaaatgctttctcagcatctaacaagatgatcatgtgatttttttccctttgagtttgtttatataatgtattacattgatggatttccgtatattgaatcaaacctgcgtccctgggatgcagcctacttgatcatgatggatgctcattttgatgtgttcttgtgaggattttattgagtatttttgcattggtattcaaagggaaattggtctgaagttctctttctttgttggttcttttgtggtttaggtatcagagaaattgtggcttcatagaatgaattggctagtgttccttctgcctctattttctggaatagtttgaagagtatttgtattaggtcttctttgaaggtctgatagaactctgcacgaaacccatcagatcctgtgcttttattgtttgggagactattaatgagtgtttctatttctttagggtaatgagactgtttagatcattaatctgatcctgatttaactttggtacctggtatttgtctagaaaattgtccatttcatccaggttttccagttttgttgagtataaactttttgtagtacgatctgatgattttttttttatttcctcagtttcttttgttatgtctccattttcatttctgcttttgtgaattagaatactgtctctgtgccttctggttagtctggctaaaggtttatctatcgtgttggttttctcaaagaaccagctcctggtttggttgattctttgtatagttctttttgtttccacttgattgatttcagccctgagtttaattatttcctgctgtctactcctcttgggtgtatttgcttctttttgttctagagctttcagatgtgctgtcaagctgctagtataagctctctccattttcttttgggggcactcagagctataagttttcctcttagcactgctttcattgtgtcccgtaagtttgggcatgttgtatcttcattttcattaaactctaaaaagtctttatttcttccttgaccaggttatcattaggttgagcattgttcagcttccaagtgtatgtatgtattccattgtttttattggtattgaagaccagccttagtccatggtgatctgataggatgcataggattatttcactcgtcttgtatctgttgaagcctgttcgatgactgactatatggccagttttggaaaaggtaccgtgaggtgttgtgaagaaggtacattcttttgttttaggataaaatgttctgtagatatttgttaaatcatttggtttataacttctcttaccttcactgtgtccctgtttagtttctgtttccatgatttgtccaatgatgagagtggggtgttgaagtctcccactattattgtgtgaggtgcaatgtgtgctttgagctttactaaagtttctttaatgaatgtggctgcccttgcatttggagcatgttcagaattgagagttgatcttggtaggtttgacctttgatgtgtataaaaggaggattccttgtcattgaggtccaatgtgtagtttgagctttggtaaaatttcttttatgaatgtgggtgcccttgcattaggagcatagatgtttgaaattgagagttcatcttggtagatttttccttttacagtatgaagtgccccaccttgtcttttttgataactttgcgttggaagttgattttgttcgatattagaatggctactccagcttgtttattggaccatttgcttggagaattgttttccagcattttacaccaaggtagtgtctctttgtcactgaggtgcatttcctgtatgcaacaaaatgctgggtccagtttatgtattcagtgtgttagtctatgtctttttattggggagttgagtccattgatattaagagatattaagggaaagtgattgttgcttcctgatatttttgctgttagaagtaggattatgtttatgtgactatcttctttttggtttgttaaaagaagattattttattctttttctagggtatagtttccgtccttgtgttggagttttctatttattatcctttgtagggctggatttgtggaaagatattgtgtaaatttggttttgtcatggaatattttggtttttccatgtatggtaattgagagttttgttgggtagagtagccttggcggacatttgtgttctcttagagtctgtatgacatctgcccaggatcttctggctttcatagtctctagcgagaagtctgttataattctgataattctaccttcatatgttacttgacctttttccctgactgcttttaatattctttctttgttttgtgtattcggtgttttgattattatgttacaggagaaatttctttactggtccattttatttggtgttctatcggcttcttgtatgttcatgggcatctctttctttaggttagcgaagttttcatgtatagttttgttgacgagagttatgggccttttgagttaggaatcttcactctcttctatacctattatccttaggtttggtcttctccttgtgtcctggatttcctggatggtttgccttaggatctttttgcatttttttttactgttgtgtcaatgttttctatggtatcttctgcacctgagattctctcttctatctcttgtattctgttggtgatgcttgcatctatgactcctgatttctttcctaggttttctatctccagagttatctccctttgtgatttctttattgtttctacttctatttttagattatgaatggttttgttcaattccttcacctgtttggttgtattttcctgtaattctttaagggatttttgtgtttccactttaagggttcctacctgtttacctgtgttcttctgtatttctttaagggagttattcatgtccttcttaaagtcctctatcatcatcatgatagagtatgattttaagtcagaatcttgttttttccggtgtattggtgtatccaggatttgcttttgtgggagacctgttttttgatgatgccaagtatccatggtttctgtcggtatggttcttgcgcttgcctttcgccatctgtttatctctgatgttaggtgttcttgctttctctggctggagtttgtccctcctgtgggcctttatgcctgtatcagcattcctaggagaccagctctctcccggctgaacttgtgtatggagggctgtggaacagccctagctctgagtgcagatggtgacctgaaggatcctgtcccagtcgctccactgttcctgtgcaatgtgtgctccttgctggtcctgccttggacagttattggagagaaagtggctatctaacctctgagccctggagtgaaagtactcctgggagataagctctctccttgctgtggaacagcccaagctcagggtgcagatggtgacttgaaggatgttacccagcccagctgctccacagttcccgggccctgtgagctcctggcgggcccctgctccagacagttattggagagaaagtcgagatctcacctcttggtccaggagtaagagcactcctgggagaacagctctcttctggcaagacctgtacacagcgggctgtggaacagcttcagctccccatttaaggtttttttgtttgtttgtttgttttgttttgttttgctttgttttgaatactgttataaatggaattatttctccaatttcttagtacatgttagctgtttgtatatgggaaggctattgatttttatatgttaattttatattttgatacttagtaaagcacatatcaactataggagtttttgtggagtctttagggtctttatgtataaagtcatctgcacataaggttactttgacttcttcctttcttatttgtatcccttatatctccttctagctaaggctttaagtgctagactggacagagtagggcaaagtagatgccctgtcttattcctgagtttttctctgtttgggaagatgttggctatgggcttgcctttattatatatcccctgtgttcccagactctccaagacttttgtcaagaatgaatgttgaattttgtcaaagatctctgcatctaatgagagagagagatgtcatgtggtctctatttttgagtcggtctatgtagtggattatgtttaataaattatgcatgttgaaccatccctgcatctttgggatgaaggtgacatggtcatggtagataatctttttattgttaggttttttttttaatttggtttgtaagtatttttattgaacttttccatcatgttcctgcagaaataattttcttcttttgttgagtctttgtccagttttagtatcagggtaatactggcttcataaaaataatttgagaatatctttgctatggaacaatttgaggaatattgatgtttcttctttgaagttttgatagaattctgtactgaatccttctagccctggatttttaagttagattttgtggttgtttttgtttttcaagatagggtctcactacacagtcccggctgtcctgaaacttgctcatgagactaggctggcctcaacctcacatcctcctacctctgccacatgttgagattaaaggtatgtgctatcatgcccagctaagttggaagagttttaattgtgtcaacattatcaggtgttatttctgtttaaattatttcatgagatggctcagtgggtaaaagtgcctgcagtgcaaggtgacttgagctcaattcctagaatccagagaaaggcagaaggaaagaaacaagtccataaacattgttctctgacattctacacatgtgccatgacacatgcttgcatgcacacacatcatgtatatatgcacacataataaaaaataactgtaagaaccattcttagtttatgagctgtcattttccagtctctgctcttaaccaatgaaggaccgtggaaatgttatttcaggcactgcctgcatcactgtgggcattagtttaagaaaatgtggtagcattgaaaaggatttttaaaagtcactcagtagtttgacagcctttttagtgtgccctcagaaatgccctcttctcccagttcccagtcagttactgttaagtgtcctcctcctcagaagaggaccagctgtactcacaatgctattatcttcagaccttgctctttgcaaacctttctttgtgctttttctccttgtagttcttcctctcatgatttatctggctcatgggagcatacaagcctacagcgcacttctgaccacttcagctccatgggcagcatagacagcctcgaccacagctcccaactctacccatctggacacctctcatctgccaagtccaatagcagcattgaccacctgggaggccacagcaagcgagactcagcttacggctccttttccacatgctccagcacccctgaccacaccttgcccaaggctgatgcctcttccactgagaacattctctataaagttggcctttgggaggcctccagaccaggcagcagccgacaaagccagtctacaggtgatcctcagggactgcaggacaggccatcatgtttcatacctagggttcctggtaacagtagtaaaagtccaaggccggaggataatgttgaacccaaaatagccactcatgggagatccaattttgggcctgtgtggtatgttcctgacaagaaaaaagccccttctcccccacctcttggacttcctttgcgcagtgatagcttttctgtggcagccaggggccatgaaaaagcccggggccctccattctcagacttggccagtatgcagcactttatcaccctgccccatgtgcaaccccggggggaccatagaatggaaactacagatcgtcagtggaagctcacacacctaagcagtggaaaagaaataggaaatgtgggttaccagtcagaaggccacctggattgccgttggctatgctctgatgatagagcaggtaggccctcagggcctccgggcaggctccagttctccgatgtgcactttctgaagtcttaccacgggagccagcaccaacagcagtgcagtgacgagagcccaagggccccctcatcaccaagggaactgcttcatataactcctggtggcggtctgcaagagcctcctgaaccatctcaggatgacaaccctactcaggtgaggtggcctggttctgctcaccagaagctagatgacagagggcggagccactattttcctgggtccctcaggcagcctgtacaggggagtgcccaggttgtgataccccgaggtgactattggcattcagatacaactcctgtggaccttgaatatcctctcttacgcccagtaggacagaggacctacctacagcagcatgaggagactccggcctctcatgaaaaagaggggtatcaccagctaaatgcagggattgaaggctgctgctctggaatccaagagcctcctagagccagccgcactgtgagaactggtctgcagtgtcctagcaatgacttcaaattagtggatggagagagtgggagaatttctcgtcagaggacacccatgctgcattctctgacccaagatggtacatggagacccgggaacagcaaggattgtggaaatgataagccaccactgtttgatgcccaggtgggtaaacccacacggaggagtgaccgttttgccacaacactgaggaatgagatccaaatgcgtagagcaaagctgcagaagagcaaaagtacagtgacactagctggagacagtgaagctgaagattgtgctggagactggagagctgatgtgggggctgtcccagaaggttccttccccagcacctataaagagcacctgaaggaggcccagacacgtgttctgaaggccacctctttccaacgccgagatttagatcccaccccagcagatcagtattcaggaccatcagaacacaggacttttgaccacagtgcctcatcttctttatcttctttccctggggagccagactctgccccacgcttctgtgagacaggtctggccaaggcaccctcttctggagttggtgtaccccacgttcttcgaattggaggccggaaacggttcacagcagagcagaaactaaagtcctattctgagccagagaaaataaatgaagtggggctctcaggggaccaccgtcctcatcctactgtcaggacacctgaggatacagtgggtacatttgctgacaggtggaagttttttgaggaaacaagcaaatctcttctccagaaggcaggccataggcaagttcactgtgggctccctagagagaaggctgagaggccacagacagggcaccatgaatgtgagagtacagagccctggttccagaagaggtcactggccacctcctgcggagagatcctcagtgatagaaaagtagaaaaggcctcagagaaattgaacccacccagaaggcttggaaccttcgcagaatatcaagcatcttggaaggaacagaagaaacctctggaagccaggagttctggacgataccattcagcagatgatattctggatgctggtctagatcagcagcagaggccacagtacattcatgagcggtctcgttcatcaccgtccacagatcactactcacaggtatgcagtgtataataagccactacttagcttgcactgagcaccactttaagattcttagggcatatacaacatatatgatggctcactaagatgcgagagtatcatttctagtttgaaagatgaggggatgaaatggcatccagcactatcattttaagtgccatatttgtgcagaaacatctctttatttccagctctctcttccctaacttatacttcatcatctttgtacctaattagtttgtatctagtctcatgttcagcaaataactctaggtgctgggagactataggaagcagtcactttatctagtgacatgaaaatgggtgatttgtgtaaacatatactagccatttctttaaagattttattttcatgtatatgtatgcttgtatgccacatgtgtgctagtgtcatggatatcagatggattccttagagctggagttacaggaaattttaagctgcctaatgtgggtgctaagaactgaactccagtcctctccaagagcagcaaggattctgctgaaccatttttctagcaaaccccacccatctacttttaaatattgatatggggtggggtggggttaaaaataataaaattgatgtcatttactatctagtatttattgtatttatacccgccactcagttcctagggttgaaatttatactttctagacaatcagtctactatggatctataaccacagttgtctttttcctttacttttctttttgagacaggatcattttgcagttcagacaaatcttgaacttgtggtcctcttttctcagccttttgagtacttaagattatagaattttgctctggtaaaatgcatttagtgatgcattaatctaatccactgtttctcccctcatagtactgggagtagaacctagggcttcatgattattaggctatatcatcttacttgaactatgcccacataccaggccctcttgcactgttttaagtttgatgtttgagttaactttgggctttttagaaaactatatattcttatcagtattttagtgttcaaagtcagtcacttctcctgtgcttctcttcttcctctgtttctctctgtgttttttctatgtatctgacctgtggggagaaatgtaacaatatagtattaacagtctcattttcttataaaaggaggagtagtaactttcttagaagatacccatcatgttgtacatgaaaggatagttgtctgttggctttggcatttggtactgaaactccatgcagagctagggaaagcttgtttctgctgtttctagaactctgatttatccacagttcagtatgatctccgagaactctgtgccttctcagttaggattaggagcccagcccccacaagtcctagactgtgaggtttcacagtaatgacttgtgaccagctgtcttttattgtgtttcttttagccaattgtgtcacatggtaacagctctcacataggagttctgtttcctgcttagaaccgaagtggatgcaggggtcctaggtcagtggtctcaataaggtgccttgcagaaatgaacagccatgtcctgtgaccaggtctcaagtctgaaacaacgggtctaaccacaggcattgtgagacaggcacacaaagtgaacccacaaatgaagggtttcataataacagctgtcttaggcatgcaggcagtttgatgactccgtgtcttacagtgttgttcttcacaggaagtgcctgttgaaccaaacaggcaggcagaggactctggtgaccacaaagaagcaattctctgtacactacaagctgaggagggatgctctgctccaaggtaggtaaatggtggatttgggattgctgaaagttgttttaagggtgaacaactttatggaaggtgaatgctaggttaacagaataagtctgggttttgctaattgagtatgatttccatcactgagatcttaaagtttggaggagagaaaacctgtgggttctgcagccctgcccagagaagcagggcagtaatagcctttagtgttctaaaaatggctgttgtaattttctttagtgaagtgctttatggggacaaaataaatgtccagtttaaaatccttgaacaaagtacttaactgaagggatacttttactgtctggcacacagctgtgtttgtaggccatggtctcagaattgtcacaaaggattttggccaagttttctaaattgggcttatttaatgagttaacctgagctttaaaatagaagtcaattgactctccagagagaggcaagatccatgttgttacagtgtggcctgaaacaatcaattccagattgttggagtggatagctattgagctctgcgtaggataaatttgattagatgtgtacacattgtgatcttgccctttctgtggaaggggcgaaagtgaagagtgtatatttgcagatgtaatataaccctgtgttacaagggctggtggaaggatggaaatcagcatgcaccacaatcttcttgagtgatagtttttctaatgccttgtacatcctatgtggctgatgtgatatgcaaatgaaacactgacttcaaagctcaaggttccattgcagaaataaccaatttacatgaatgctctcaagagctttatgttggggtcttatttcacatgtttcccactaactgttgttagccctattcaaaagtgtcacatgtttatgtgactctgaggtgaccagattgatactctgtgtgcctccctcagaaatgcctgccattacttaacagtctgcacagctaaaccgatgcacccatgggtaagaaaggctgctgaataatccgcctacagaatttagcagtgtctgaggaggacaattagagctttattcctggattctgagtcagtcacgtgctgagcaccagctgtgcagggtagtggggtgcagcacacggctatgtatagagaatgtcaccatggacagctataatgtgcatgtggtgtgtgtgcacatgtgattatgtatgtcagtggcactgtcagagcttacagggatacgaggaagggaggaggggccctctgctttatttatcatggctgtgcctctcagctgactgcttaactactctgaagaaattagttccagtagcaatctgcttttgagttacaaacttagccgttttcagaattgcgatctcgtgatctctttctccctctccctctctccctctctctccctctctctctctccctccctcctcccctcccttcctccctccctccctctccttccctatctccctcttccacctctgtttgtgtgtgtgtgtgtgtgtaagagtggcaagccaatgaaatgtaataggaatgttaaaaattcattttcagttttttccagagattatttatacatttctggagggtcagcaagaaataatatgcttgagacattaaagaataataaaaataagggtcttacagaggtgactcattggaaccaggttcagatcctagcacccatatggcagctcacaactgtcttctgatgccctcatatagaaacacacgcaggcaaaatatcaatgaacttaaaaaaaagaataataaaagtaaaagtttataatgcagagatgtaaagatacctagtgtccctgcacaggtttaaataaacataaacatgtctctataagaaattcattattgatctgctagttgatgcttggaaataagtggttttgttgtgttttgtttagacaacacaaaaacgttgaaatagacattttctgtttactggttattcatccaaatcaagtagaaataatttttttaatttaaaattttcttaatttttgagatacaatgtcacttcacacccagaaactccctgcatagtgtagcacatgttgtcatcaccaaattcatgctgatcttcctatcttagaacttgctggggtttcagggatgaggtattacatgcagctagtaacatcttttttgtacatgtgtataagatcctgtaggacattactgtatagcaaggaaaaaaattacaagtatttatagctaaacagaaagtacataattgtacatgtttttggtggttgggggagctgcccattcagcatatgcctgtaatcccagcactcaggctgaggatggagctcataagttcaagatcaactataggctgtagagcaagaccttctctagtataaacaaacagacaaacaaaaagttacatgaaacatcagaaatcagtggaggttaaggggaaaacaaagcactgggtagccgggaaggccgatcacaaaatggtagatccagtggcatttttctcccctacatcacactcggtcttgagcagcccacctcacttgttctgactgtcttccctgttctggggatattttcctagtgattttcactgctctcagggatttcagactgaatattcaagcttattacaaccagcagggtctgtttcttgcaaatgcattcaatcactgacttgggagtcacttaaatgttcagtatgtgacttctaaaggcctatctatcgttaaaaaaagaaaaatatgttctcacaggggctagtgagatggttcacctagtaaaggaccctgccaccaagcctgtggacttgagttccatccttggaatacatatagtgaaaggagcaaccagctcctctgttgtcctctgattgtctttcatgtagactccatctacttgctatgtcctcatttgtttacattgtgggtctctctgttcctaatctctagttcttacaaggacaccaaacagattagttttgagccaccctagcgacctcatttctccttaatcaccactttaaatgtcttgtttgcttacatagttatactctgagatactgaagatataggacttcaacacattaatttgggagaggtctcaattcagttccttacagtaggagagatgcccctgctttttccatacacctttatgctagtgagttctgttcttctgcaagctttctcacactcacacgtgaagggaaagcacttacaatggagagtaataaaggagcttctgtcttatatgtggctaatggggcagcaagatggtagtcggggccttcggaaccctgtatactgcagccttattggatagctcccaactctgttctgtcattctgctttcagagttcggctttgtaagacatttttcttcttaacatcaggttaagaacatgatggctccttccttttctgtcctttcctcgaccagaaccccttttctcagtcctttggtagaaaattttgtttgaccaggtgtaattggctttctggaattcctaaaatgcttaaattctaccctttctatttttccatttcatgccacggctttctaaattagccagtcattagtagacactaaggttaaacccagccaataaggaacaggcaacccgactcccgtaccttagggagaaaagactgaaaccatctaggtgatgtgtgctgctgctattccactagctttatcctggggcagagcataccctttttgcaaaaagcaattgccatactgagttactttcattttgttcatgtattactttttgtaacataaaaattagtttttccttataccctcaaagtagatgcccattatattgtgaacaatgatgtcttctgccgattgggatagtggggagagaatgatgtcatgaatatattttcaccccattgtcctgttctctggactctccctcctcatttctgataggcaatttggaagaacaggattttaatttttcactgtttgtcagacatagtttctatatagattaggtgccaaataaatggttggtgaatgaatacactggtgaattgatagatgggtgagggaacagacagataaaccagtccttgggtagatggatacagagaagggtaggtagatggatgaatggttggacgcctgaatagatgaataggcagatagataggatgaatgagttgattatggatggatatgtcgttatgaatatagtctagggctcttcaattagattcattttccctgccagtcaaagacgtaaaatgcaagaacaatcgtgagcatgacaggtagcaacaaacgaacacaaacagaatcagcagttgaaaggcatttatttattggggatgagaaaacatgtttatgcaacagacgcacagagaaaaatgaccctttctaaagcccgggggaggagaggaatcaggaagctaaaaatccagtctgttcacaaaagagctggggatttttaaagtctctgaagagttttcctgaatgatttaaggtttgaaaacaggatagttaattggcccaattgttatgtagaatgtcctgatgctgctgtgaacttgttgaatcagtccatcagcagccaccctactggaaggaagaaagcccacaaggtcttgaaggtcaggcttttgactcaggtttggagggtgaggaggaaaccagacatcttagaagctcaccagttttaggaagtagccagggcatctctctgatggcctaccaaagagtttgtctaactcattatccctcagttaggtaaatggttgtttggattgataaatgaggggttgttgaaggcatgggtaggggatactaaacagtgaatgagcagacagaaggaagaataggtgagtagatgagtagatggcttgctgttcaatcttccttgagtccttgatcagcattccatggtagtacatgctctgtattgaaattttactaaatattactaacgtttagttaaatattagtaagtgaaatgggctttactatctgcacttgttccagagttaagacataagcatctcagaagaaatcattaaactgacttgttttctacaatcatattttaacctctataagaaaattaacatactacatttgggttttgctccttacatatgagcttctcctggaatgtgctacaaaattgggctgagatgagatctgggggtgaccaccacagctgatttgtcattgacttcaagattgtattttattgggatgggggagaaggaaagaacttactcctatagaggaacaaaactgaattcatgcgagggaaaattctttagagacattttgctgtaatataaaatgcattaaccaacaaagcaaactcactttatgttgtttgctcttgagagagaacttggtgtgtagaaattatgtgaagaccaatttcctctttagaaaaccagcttctgccaagtggattttggaagtaacagagattgattatgggagagctctaccctgtgttcatggctctagggcagatgtttattgtctctggccctcaattagctgtctggcaattgcagcctgccttttctaaaggactgtgctaggtaattatgcatccagtgctggatgggtcaggctaaaaaggtgaaacttaagcttggatgtagagggataggggagggtggacagggatgaggaagcagagcttccatttcataagaccaggcagaattctgaactgaagcactctttctgtatatgcaaacataagaccatcatcccaaaaatgaaaaacagtaactgccagaaaaagacagaggcataagactagttggttggttggttggttggttggttggttggttggtttttcggtccctccatgtagccctggctgtcctggagcttactctgtagaccaggctggactcaaattcatagagaaccacctgagattaaagatgtgtgccaccacacagggacagactttgttttcatgtctattattagtttctcttatcattgttgggacaaaatacttgaaaaagtagcttaagggagggtgtattttggttcatagttggagggtattattctcaatggtaggaaactcatgacagcaggagtgtgaggcagcttcaatttgcatccttaatcaggaatcaggagaaatgaatgctgctgcttagcttactttctccttttattctgcccatgggatggtattgcccatacatagggtggatcttctcacctcaattaacccaagctagaaatgcccttgtagacatttagttttcagagtactaaaaagtaggttctagaagcaggcagcctcttatgagtataggcaagaaagcttgactgacttttccctttgctactttctctgtatgttagctcttgtatattagaactatggaactataacgctccttaggaaagcaaaggcctgttgaggttaagctatctaataagcagctacaggaattggaactcttttttttttctttttttttttaaacagagtttctgtagaccaggctggcctcaaactgagaaatccacctgcctctgcctcccaagttctaggattaaaggcatgtgccaccactgcccagctattagttttctgttgctgtaatacaacatcatgaccaacagaaacttagaaaagaaagagttagctttggcttatggtcagagagagagaaagagagagagagagagagagagaccgagacctgaatgtctggaaacgtatggttttatggcagggccatggagctgactgaccacatctttatctaaataaggacaacagagtgaggaggaggagggagaataggatgtgggagtaaaagctgcacattgtacatcatcaaggcccaccctaggtggtttcttcttccagcaagggactaccttctaaagtaaccatcacttctcccaaatgccactaactagggatcaagtattcaaatatggagggcattttgcaaggaattggaactcttgactttccttaacacatgtaggcttggaaggtacatacatgggggcggggcatcctggatgttattatttgtttgtaagcttaccttaaatcccagtttcttaagctgtgggtcataacctcaggttgtgttacctaactgaatgtgagtcacaagactttgataagaataaaagatttctaaatatataaggaccaaaaccatattaaaagtcaaatgggtaagaaatctgaaatgtttatagcagtgttgacccatggtgtatgtatctcatgactgtgctgcagccttggttctgaacacacagcagggtatacttttcattgcacattctgtcacagtgtgcattgccagcaggctttgcttgaaataccttgactccaatttgaaagtgctacatgttatatatttgggaaggaaaacaaaggacaaagagagatgatatatgaatagggaccacggtagcctgagaagtgtctctgtcagcttttctcaagtacaaccctcagtgcttttgttttgtttttgttttgctacattgagataaagtcttgctatgtagtccatctggcttggaattcaccatgtaatcctagctagctatgagcttatagtcttcctgcctcaaccatccaaatagtggaatcccaggtacacacatcattctatctagtagaaaatgagcccttttagcctgctgggcctattactctccatattaagctgacatagattttgcagtttgtttgcatacaaacttgccaaattgttcagtggttatagactagcatacaaacagaaaataaaacaggttttaaatattctttcagattatttaattacaattaacactaaaaggtagctttacagtgatgctagtttaagaatattacttctgttcatttatcttatccatcaaatctgtcttcctacatagacacagctaatgtgaattgatgctgtgatgtttatctaatactaataattcaatcagctataaatggggagaaagaaggagagagagagaaagagaaatagagagagagaatgaatgaatatgaatgaatgaatgaataaataaataaatatttctgaagtgcagccctcacctaagtcttaatcccgtaggatggaccagggctaccttgaagactggttaggaagtatcaaaggtgggtaagcctggaagagattggaaaggaaggatatcagatacacacacacacacacaatgaggacacatttcagagtccctgaatcctataatgaataaagctggaacatttgaagcaacaaaataaaatagtgatagatatcagccaacatttagaataaattcatggtgtttacaaaactgaatgagtaaattaatacatgggcagtagacaagtctatcatgcagacaaaatgtgagtatactctactctcatgattttgatctaaagtatctcccagagttgctacactaaaaggcttggtagcaagctgatggcttttgagaagtaactagatattgagagctttaagcaagtgagttgagtactgggggatggtagaatcttttggagctgggtgtgattggtggaagcgtgtcacctgagtctatccttggctatcttatcctcagtctccctcctcctttctgcttcctgaatgctatacagtgatagcaccatttttactagaggtgctgtgatattttgaccttacttcatgtaattggccactgtgataccttgcctcactcaggctcaaagcaaagcaatggaatcagggtaatctttgattgaatctttaaaaccttgaaccaaaataaagcctttatcctttaagttaattttgtcagatattttgttacagaggggaaagtttagtatgtctatcctcaaggaggtggagcataactctgggccttcagtaatctaataacattctacagaagtatgcagactgaagagtatggagaaagcttacaaattaaccacatgtttggattgataccatagaaataagacatgttagcagtatgtaccctttgtatggtgataacaaatgataattcacctctgtagtctttacccagaaactcatagacataatctaattataaaaggagggaaaatcaaatgaataacatgttacaggtgcctgaaaaatccttagaagtataacaaataccaaaacaaagggaagtctaattatttatctcctactccattcaggacgatggagcaaaatatcttagactagaagatcaaagcttctcaccttataccatcaagaagcagaaagggaaagggtggacttaggataagatagtgtcttcaagggcacacaccccagtgtgtctagtcacagccaaaaggttctactaccgagtatttctattgttgtttgaggtgtggtctcactatgtagtcctggatggcttggatctcattctgtagaccgggctggcctcactcagaaagatcctcctgcctctgcctcctggctgtcaggattaaaaccatgtagtaccatgcagacaccactaggtatttcaaaccattctggaggctgaagcccaaggttaaggcataagcagatttggtgccttgtgagatctcattttctggcctaaagataaacattttttctctgtgttcacacataaagacactagtctgactattgagatagacacttgcatgaacttttattccccaagtgctctacctcatagttcttaagaggttaaagtcacttggttggttggttggtttttaagaaaggatttgactatagcttagattatctatgaatttacaatcttcctgcctcaacctcctctgtgtgacattgttccttgagagatgtgaacaaatgtcactcatcccagatagggatctgatgacaaaccaaagtacagatagtgccaaagtccagcttggtgaacaagtgagttttaatggggttatttacaggaacaggaaggtctcaaagacagctgcatcaccaaagcccatcgcaacatgggatgtcaacttataacaacttataaaagctggagatctggagcacactatacagtttacagacagcaagttggaaagtgtcattttcaggtagcttagtttttaagtcttttccaggcagctcagtatgtctgagagtcttctaggcagctcaactactctctgcttcttccagtcttgtctgagtcttctcagcagcctttaatgtttttatactcttgagaagaaaagagcccagtgaatgtagtcagttccagggacttcttgaagctattgagtttggtttttcacatcctgttttaacaagcttccctataggatagagtcacttcctcttagaacatgctattgtttcacccccctttttgtattctgcatcttaaagagtttccctctagtggaatgtccttacctagtaaattgctacacaacaccttcatcccgaattctgggattataagaacatatctccatgtctgcatagttatgtttttaacatacacatttgaggggagggagaaactttcagggttatagtatcatcacaaagttactatatacaatgtggtgcctgcctgggatcctggtccaggaaaggaacaataaataatacataataattagtaaaatataaaataatctataaaatataataatatgattattaatacattaatgttgaggtgcttcattagtaagtgtatcagtctcaatgtaccaatattggttgattaactagggtaaatatatatcagactgttttccatcagtacaacaaaatgactgacgtggtcaacttataaagaaaaaaggttgttttagcttatggtttcagaggtttccacctaaggctggttacattgcttttaggcctatgatgaagcagcacatcatggaagaaagacgtgatgggggaaaatccatttaattcatggtagcagagaagcagagtgggaggaagagggaactgatgtactacagtctcctttaagtatataatcctagtgacctaatttcctttctcttgtccctattacctaaagattcttccatttcatagtagtggccctcacgggaccaagcctttaaaacactatctctatgagagatacttaaatactttaaaacattatctctatgagagatacttaagattcgaatgatagtatactatatcatacaaatctgaagcttaataatagagaacacttggtctattatatggaaacttgtttcttttaagttttctgtaatttttttttttcatttgaaaatgaaatgtttttgttagggatatacccagttgatagaatacttgatcaacactttaacatgtacaacaagcctcttgggagaggaaggcaaggatggggatgtcagggaggtgacatcactgtatatgaggacatataaaaaatactatgtggacatgaaaaacactggaaagagtgtgagctttgcaatcaaaaatacaggagcaaatcttcactatgtttgtatcaggtcatccagatttagtaacctcttgtaaccctttctcttaaatttaagcatttagtgggatccaagttagtataccacagagacacccacacatcattgtccactgaagcactgttcacaatagccaagttattaagttggcctgagtatcccataaacacaatagtaaagaaaaatgtaggctggagagtatatgtattttatttggtcacaaactaaaaaatgaaatgtcatttgcagggaattagatgaaactggagatcattgtgtttagtacaataagctagatcaggaaaaacgttttttttttcctcatgtggaagctagattaaatacatatacacgtatatgtatatgacatgaaagtagtagaaaggttagtatttgtgaagattaaggataagaagggggctaaggaagataatataagataataattatatataatatatgtgtgatatattatatataattaatataatatataagataataatgagcaaactgtgatttaaatgtatgaaaatgtaaaagtgaaacccataatgctgtaaaagtgaatatatactaataaaaacgtaaatgcttaatggatataatgataatagattagcagtgtgctatattggaggctgcataataacatgttacttggtaaaatgcgcaggagactgaaataattactgtgtattgagaagagctttatggaaacaagctggaaagcaaaagccctgttggctaagcccaggactcagatgttgagggctgtctaggtgggaaggagctatgaagaaaatttgtgagggggcaatttctgtttaggaccatgccactgaggttgggggtttgtggtcagagtggaggtggggcccggagcctttaaatgcaagtcattgtgatgtgatgaattgagtgagtcgggtcagtctggttgctttgtcttcttgccccagtgcccttgcacacagaaaaagttctaaaacactttgtttgtcagttgatggattacattcctaatgagtgtgtaatcagcgtaagaatatccatcgacataaaataggctattgagtatcttctttaacttcattgtagttgtagagttggactatgtatgcctgtgatagcattgatcagagtttttaagtagaattcatgaatgacattcttgcagtgggttcttctatattttccactttaagaaaatataaaaagaaaggacacccattctccatgcctattaggggttttaaaagtagaagcctcttacagcttagtcatgggaagtgctggtaatattccctgagaccagatatactgggttttggagttgacagaaccttcataaacttgtacatcataaggcagcaggctctgatattccagctgttgccagcatgccttcgtgactccacaatgctgtaggcagcaggattctgcggtggcagaggcgggctttgggtccctgaagcacttagctgcctttgcaggctgaatgagccacagtctacagcagcaatcagggatgcaggtaagagactctagtgctccttctcagggcatcttatccccgaggggaactgttttaaaaatcacttgtgctatttgtgaggagggtgtagttcccaatgcctcttttgttctacagtcttaaagggcaggttgtttgtcagttcacaatggcgtgggtctgatctagcaagatctgcaaacattctcattgtttattgttctgtctaaagatgaaaaatcatgcaaatcagggttcagattctagatggagcactctgcaagcgtgcacacatgtgacagggggcacatttgtccatgctgcatgcatgtttaagggcacaggcagttttttcagcctgggttttttaaagctggataaaaagcacgttggaactgaaagctgtcgtccctaactggtgggactggtagcccttgctgtgtggaaaaatagctctgtgtgagttctgcacatggatgacccaagaacgcaggcaggagggatctgtgaagacttgtctgcgttgccgtttctttttcagtagccataagatgcaggcattctcactcctgagacactgagtgtggacactgaaagaaatggtgagttagccacatccaaactggggggtggtggggttgtaaaaccaggtgtgcatgcttggtcatgcaaatgatccatgtgtacattcacagagcttgctaactgcagtgaaaaaactctataaggagaaaatggaatctctgtggcttttaatattttagttcttataatttattgttttgatcatgataatgttctttctttaaatgtgttagtgtacatgtgcttgcatttttcattcttcctctttcattgtgattaaaaatgcaggttattgttttgggccatgttgctaaatgatgaattgcctttgctgcaggcaaggaagctttttgcatgtgtagaaggaatgccattttcacagggaaactgctgcatagctgtctctgtacacacatacatacactatctgagtctgtattcactgactcatgggagtaggtgtcatcttgaattgcacatttaggcattggttgtgccagtgcagaggcaaaaaaaaaaaaaaaaaaaaaaaaggaggaggaggaaaggcaaattaaggaaaggttttccagaatctggtagcactataactaaatagcttgctgtctaccagctacattttttaaatgattggaaaataattttcaagcataaaatactggaacaaatttgaatggttggcatattttctggttgaagtagatataagtatttttgatgatttttgtcattttgtggtagaaaaagggactagtcaatatattttatatatagtaggaaaatattttatgtgtaaatatacgtgcacatgctcacacatatacacacccacatgtgcctctgtcttaaggagaaagtttacaggggcattcttattcattaacgcatacacaaaggtcttttttctacattatggaaataatcacaagtgtgtgtcaactagatgggttacagaaggcttctgctacccagctgcagtgacaaatgacatagtaaaagcctgttaactgctgcatgctttgcatagactggccactcccccaaagtctgactttggatgctggaggttggggaaggtaataatttatatgcccttttagaatgtatttatatggttcttactattttagatctctgttggggggggggagacggagggaaggaaggaaggaagatagatgtatcatggttggggaaccataggaaaaaaactggcattttatgtctaccttgagctatccatctttccctttcttggacattagaggttttacctggcttctttctgctagagcaagttaacagtcagatcactgatagaattgtagacatttctggatgtctaaagagattcagaatctatttaattacttaccctttttacccccgcccctttaaaataaatgtttagatagggtgggaagatagttcaaattaatataaaaaattaaagagagaaaattaaaatcatccttaatctccttacccagtgattccactgtagaacatgaaagtgtgtgtgctttgaagtcttgttttagcacgaatatatattttatatacccagtcattctccacatggtatatgcagactgcctttaaaaatacaaaaagattttatatgtattatgcatggtattctaagatatgaaaaatctgtcttacagtatagatatttaaagctgcttctggccattcacaattataaataatactttagtagacatattgtactgagagagtcatacccttccatgtgggttgtcttaaggcatgatagatacatatttaggagataccaccttgtggatctatgaagtgtatccttgctatttatgcctcactcaccagccatctaggaagttctgtttttctcacaattttaccaatattaagcattaatttggaattgtggattatttttttccaattttttaattaggtattttttcctttacatttcaaatgatatcccgaaagtcccccataccctcccctgaccccactcccctacccacctactcccacttcttggccctggtgttcccctgtacctgggcatataaagttagcaagaccaagggacctctcttcctaatgatggccgactaggccattttctgctacatatgcagctagagacatgagctctgggggtactggttagttcatattgttgttccacctataagcagaccccttgagctccttgggtactttctctagctcctccattgggggccctgtgttccatccaatagctgactgtgagtatccacttctgtgtttgccaggcaccagcatagcctcacaagagacagctatatcagagtcctttaagcaaaatcttgctggcatatgcaatggtgtctgcgtttggagtctgattatgggatggatccccaagtgcagcagtctttagatggtccatcctttaatctgtctctgcaactcctttcatgggtgttttgttcccaattctaagaaggggcgaagtgtccacactttggtcttcattcttcttgagtttcatgtgctttccaaattgtatcttatgtattctaagtttctgggctaatatccacttatcagtgagtacatatcatgtgagttcttttgtgattgggttacctcactcaggatgataccctccagatccatccatttgcctaggaatttcataatttcatatttttaatagctgggtagtactccattatgtaaatgtaccacattttctgtatccattcttcttttttttgtttttttttttgtttttcaataattttatttttttctaattttgtaattttaatttcccatagcaccttggcaatgttgaaaacaatacaaatacaaagatgctcgttttaacagtttatgcatgaatatgtgtcacacaatttggggggggcagtccattcttcttttgaggggcatctgggttctttccagcttctggctataataaataaggccgctaagaacattgtggagcatgtgttcttattaccagttgggacatcttctggatatatgcccaggagaggtattgtgggatccttgggtagtactatgtccaattttctgaggaaccgccagactgctttccagagtggttgtacaagcttgcaatcccaccaacaatggaggagtatatctctttcttcacatcctcgccagtatcttctgtcacctgaatttttgatcttagccattctgactggtgtgaggtgtgatctcagggttgttttgatttgcatttccctgatgattaagaatgttgaatgttgtttcaggtgcttctcagccattcggtattcctcaggtgagaattctttgtttagctctgagccccattttttgatggggttatttgattttctgtagtccaccttcttgaggtctttatatataatatattagatattagacccctatctaatttaggattggtaaagatcctttcccaatctgttggtggtctttttgtcttattgacagtgtcttttgccttacaaaagctttgcaattttatgtggtcccatttgtggattctcgatcttacagcacaagccacttttgttctattcaggaatttttcccctgtgcccatatcttcaaggtttttcccccactttctcttctgtaagtttcagtgtctctggttttatgtggagttccttgatccacttagacttgaccttagtataaggaaataagaatggatcaattctcattcttctaaatgatactgcaagttgtgctagcaccattggttgaaaatgctgtcttttttccactggatggttttagctcccttgtcaaagatcaagtgaccataggtgtgtgggttcatttctgggtcttcaattctattccattggtctacctgtctgtcgctataccagtaccatgcatgcagtttttatcacaattgctctgtagtacagcttaatgtcaggcatggtgattcctccgagtttatttatcattgagaagagtttttgctatcctaggttttttgttattccagatgaatttgcaatttgccctttctatttccttgaagaattgagttgggattttgatgggggttgcattgaatttgtatattgcttttggcaagatagcaatttttactatattgatcctgccaatccatgagcatgggagatcccaatccatgagcatgggagatctttccatcttctgagatcttctttcatttctttcttcagagacttgaggttcttatcatatagatctttaacttccttagagtcacaccaagatattttatattatttgtgactattgtgaagagtgttgtttccctaatttctttctcagcctgtttatcctttgtgtagagaaaggccattgacttgtttgagttaattttatatccagctacttcattgaagctgtttatcaggcttgggagttctctggtggaatttttagggtcacttatatatactatcacaacatctgcaaatagtgatattttaacttcttcctttccaatttgtatccccttgacctccttttgttgttgaattgctctggctaggacttcaaatactatgttaaataggtagagagaaagtagggagccttgtctagtccctgattttagtgggattgcttccagcttctcaccatttactttgatgttggctactggtttgctgtagatttcttttattatgtttaggtatgggccttgaattcctgatctttccaagacttttatcatgaatggttgttggattttgtcaaatgctttctcagcatgtaacaagatgatcatgtggtttttttctttgagtttgtttatatagtgaattacgttgatggatttctgtatattaaatcatccctgcatccctgggatgaagcctacttggtcaggatggatgattgttttgatgtgttcttcgattcggttagcgagaattttattgagtatttttgcatcaatactcaagggaaattggtctgaagttctctatctttgttgggtttttatgtggtttaggtatcagagtaattgtggcttcataggatgaattgggtagagtaccttctgtttctattttgtggaatagtttgtgaagagttggaatttggtcttctttgaaggtctgatagaactctgcactaaacccatctggtcctgggctttttttggttgggagactattaatgactgcttgtatttctttaggggatataggactgtttagatcattaacctgatcctgattcaactttggtacctggtatctgtctagaaatttgtccatttcatcctgattttccatttttgttgagtatagccttttgtagaaggatctgatggtgttttggatttctttaggacctgttgttatgtctcccttttcatttctgattttgttaattaggatgctgtccctgtgccctctagtgagtctggctaaaggtttatctatcttattgattttctcaaagaaccaactcctcatttggttgattctttgaatagttctttttgtttccacttggttgatttcgcccctgagtttgattgttccctgcagtctactcctcttgggtgaatttgcttcctttttttctagagcttttaggtgtgttgtcaagctgctagtgtgtgctctctctagtttctttttggaggcactcaaagctatgagttttcctcttagaaatgcttttattgtgtcccataggtttgggtatgttgtggcttcattttcattaaactctaaaacgtctttaatttctttctttatttcttccttgaccaaggtatcattgagaagagtgttgttcagtttccaggtgaatgttggctttctattatttatgttgttattgaagatcagccttatttcattgtgatctgataggttgcatgggataatttcaatatttttgtatctgttgaggcctgttttgtgatcaattatatagtcagttttggcgaaggtaccatgaggtgctgagaaggtatatccttttgttttaggataaaatgttctgtacatatctgttaaatccatttgttctaacttctgtttgtttcactgtgtccctattcagtttttgtttgcaggatctgtccattcatgaaagtggggtgttgaagtctcccactattattgtgtgaggtgcaatgtgtgctttgagcttactaaattttctttaatgaatgttgctgcccttgcatttggagcatagatgttcagaattgagagttcctcttggaaggttttacctttgatgtgcatgaagtgtccctcgctgtttttgataactttgtgttagaagttgattttcttcgacattagaatggctactccagcttgtttcttcagaccgtttgcttggaacattgttttccagcctttcactctgaggtagtgtctgtctttttccatgagatgggtttcctgtaagaagcaaaatgttgggtcttgtttgtgtagccagtctgttagtctatgtctttttattggggaattgagtccattgatattaagagatattaaggaaaagtaattgttgcttcctattatttttgttgttagagttggcattctgttcttgtgcctgtcttcttttaggtttgttgaaggattactttcttcctttttctagggcgtagtttccgtccttgtattggtttttttctgttattctttgaagggctggattcatggaaagatattgtgtgaatttgcttttgtcatggagtactttggtttctccatctatggtaattgaaagtttggctgggtatattagcttgggctgacatttgtgttctcttagtgtctgtataacatctgtccaggatcttctggctttcatagtctctggtgaaaagtctgatgtaattctaataggcttgcctttatatgttacttgacctttttcccttactgcttttaatattccatctgtatttagtgcgtttgttgttctgattataatgtgttgggaggaatttcttttctggtccagtctatttggagttttgtaggtttcttgtatatttaatggcatctctttctttaggtttgggaaatttttttctataatgctgttgaagatatttgctagccctttaagttttaaatcttcattctcatctactcctattatccgtaggtttggtcttctcattgtgtcctggatttcctggatgttttgacttaggttctttttgcattttgtattttctttgattgttgtgtgtatgttccctatggaatcttctgcacctgagattctctcttctatctcctgtattctgttgctgattctcgtatctatggttcctgatttctttcctagggtttctatctccagagttgtacccctttgggttttctttattgtttctacttccatttttagatcctggatggttttgttcaattccatcacctgtttggtccatcacctatttgaaagtgttttcctgtaactctctaaggcatttttgtgtttcctctttaaaggcttttagctgtttacctgtgttttcctgtatttccttcttaatgtcctccatcatcatcatcataatcatcatcataagaagtgactctagatccatgtcttgcatttctggtgtgatggtgtatccaggacttgctatggttggagagtttggttctgatgatgcccagtaaccttggtttttgttgtttctgttcttatgcttgcctcctgccatctgattatttcaagtatttgctgtcctctgattggagcctgtccttcctataatcccagttgattcaggactcctcagagtccagctttctctgtgatcctttgcttgtgggctcctgtgaacctgagattatgggtgtgccagagttcttggcagtgaagttcctctgagaccctggaatactggtgtgaccaagctccttttatcctgggatcctgttgtcaaaggtcctgggcgttttacagtgcctggggtgtgttgtcttctttgaggagtgtggagctgtctggtcagtgttcctaagatggcatggagagtcctctagggaccatggggatgtcctccaattccgcgcccaaggtgaccaagtgatggtgttgaccggaagggacttgtgcccctggtcagaccggttttctgcttccctaatgctgtctcaggtcctgcctgcgcgattggattggaacagaagttgcattccacacacaagtggtcctaagatctcgtggagagtcctctagggactgtgggggtgtccgtcgactccctgcccaaggttacccggtactgacgctgaccggaagggcaattctgtggtttattaagtaacccatttttaacatgtatttcttaggggcttgagaaaggcaatgttctttcatatatttactgatttttttttattcattactgttcacattcctattaaaagtggtccttccttaatcatcgtcatgtaggttacaatgcatttgtgtagtatggtgcatacttttcacacatttacagttggtttgggttaaattatttctaatcctaacctcttgttattgaatcctcttgttatggcccacatttggctactctgaattaccagttctgtgttttagcagccaccagcttttagcaactatgtgtttttgttgccagggtttagttaccaattgcatggcattacatgcaaccgtctacagttctgtcaattctgaaatggttttcaatgctttgcaaagaagaaagagtggctaaggatgatgtgttatgttgtattgtaagagaaatggagaactcagaagacagatgtaaatcctagcttaaaacaagttgttgcttctggtagggcttgctgactgtttgtaggagattggagtgctcaagaattagaggacagtgccatgtcctatgtactcagctatgttcttagtctgcaaagtatttggaaattgaattggctattatgaggactttagaaatgtttgtgatcctaacatttgtagttgttaaggtagaaggactctgagttcaatgccagagtgagctacatattaagatgctgtctcaaacaaagaaatgaaaattggaagagtgattcaagcttgatctgaatattatgatcttcactcattacctccatagttgattctggtctgtttgcgtcacatagttacccaatataccgcaaataagctaactggatccttgctccaggcatgctcctgattcttgaatattaaattaagataaacaatatattacatgtaggatgaagtcactagatatatactcctctttctgactcaaatggtaggtctccaactgattttgctataacctatgaccatatttctactagtaaatctctcagtaaattgtattgtgtgcagtcttggattttttcagcctttttttttctttttcctaaaatatatgtaaatgaatgttttgcctgactgtatgcatgcatgcatgcttgtatttttatatatgtatgtgttagattccctagaactctggttacagatgtttgtgaaccaccatgtagaggctggaaatcaaatctaggtcctgtgcaagagcaacaagtactcttcatcactgagccatctttccagcccctgtctgtttttctcccataggtctcacagtattttggggcaggttttcacaggaccaaattctttcagagcagtatattctgaaaaaactcagtttatataccatgtaacacaccagtaatttaatacccatattttttcttaatgaaagtgacatgccaagccaaggattaaaatttgtagtttgctaatccctgttatacataacaaggcatatgctaaatttttaaaatcacaagtggcctgacctagcattgccaagcctttagtctcagctacttgggaagctcaggcaggaaaatctaaatccatgtccaggttgggcaatttatgtgaaaataaaaagtataaggttggaaatgtagctcagtggtagagtggttgttttataggcccgaggcctcagtttttgcagttcccagtattgtcaaaggtgaaataacagtaacaacagagtgtatataagtgctcattttaataaacattgtgaaggatataaggagaatgttaaggctagtgatataccccaattggttggtaaagcctagcatccagtaagccctaggttcaatcccagtactacataaactgggcattatggtgcacacctgaattccaccattcaggagatagaagcaggagaatcagaagtccagggctgtctttggctatatagttagctcaagatcagcttgagacacatgagatcctacctcaagagaagtagggagggaggggacaggtggagagaaggatgaagagagagaaagaatatgtatatgagaatgccaggaaaggagacagaagagtttatgtagtggagggtgtaatgaggttttaaaaacaaagtttcctggcctctttaaatgtgaggcaatgttgctacacctaagtggagctccacagatttcatttcaaagagatatcctggcccagggctcagaaagttgttctgactcttggaatatgggtagattccccctagacctagtgccagggaactttcagtgtcaccatttttatagataatgattattttttttggaagggacattccgagccaagaataaaaatgcctggaatatagcttttgatacccacatacatgtaataggtagaaaagtgggagagaaggaatttgggaagggaagttttgcaaaacagattcttaatgttttcttcacatccaaattgcttggaaggctggttttgaaatagatttagaggcatgtcatccttcactattcaaccctctgccagggccttctgactaactttaagaagagcccagtttcttgctacatcaaatcttgggaccacgtatgaagggatggagccacagaaatgagaaaggccttgccacagattctcagaataaatgttgtaagagcatacatagatccctgggatagttgagcagcagttagagagtatactctctcaagttcaggccactgtgcttgtgtacatgtatttgtgtgcttgtagagtccagaagtctgtatcagtagctttcttgatcattctccaccttattttttgagacagtctcttaacttaaaactcatcaatataattcatctggcaggccaattgagcttcaggacatcctcttgtctccaatacctgccccagcattagggttactatacacacataccactatacccagcttttacatagatgctggtgatccaaactcaagtcctcatgcttgcacagcagacatttccccagcccactcccccatttaaaaattactgaatactattaaaaagtcagtgcctgttaatttgggtttgcatcatctttgagtgaaatttctctttaaatatgtcttctcccctatccacttaaccacaaatgatttatccttttttccaattcaacttcactattacttggcatctgcgtctctgtaagctaaaatgaagtcccaaggaaactgcaaaccttttttatccatctgtgaagacattgaagaaataaaactcatctggttttctaaattgcttttcccacatggcatgaaaaacacagggcggcatagagagaaaagctttagctaggaggaattatagtaaacacatgaccaatgtcaggatgcttctgggcttgtgttctccccaaagtacatccagcaacacacaagactttgacaactgggtatggtagtgtatatttgctatctcaactactcaagttcaagcaggctttcatgggccatgtggaaagtttgagctcaatcttggctgcatagtgagaccttgtcttaagtacatcttccctagatccccaaagaaaaacacaggaagctgttcaataaaaagatccatatgttttaacaaaacttgcagaaatagttctcttccttagcatcataagcataatatgtctgttactttagcaactacaggttaatcattcacaaacctaaaatctgaaattctcttgagtcagaaacggtgcctacatattgccacaaaaagacaaatttctacatttgacctcacattatactctgatgagttgcagccaaaatgcaggtacactaaaaataatatattaaaattatctttcggggctggagagatggctcagtggttaagaacactgactgctcttctgaaggtcctgagttcaaatcccagcaaccacatggtgggctcacaaccatctgtaatgagatctgatgccctcttctggtgcatctgaagacagctacagtgtacttagatataataataaataaatctttaaaaattatctttcatatatatatatgcatatatatatatgaaacatgtaaaatgtaaatgtgtatctataaatataagtacatggcataagttagaattactgcattcgtgcttataattaagttccatataattaggttcattcacacacacacacacacacacacatatatatatatgtatgtatatatataatatgtatatatacatgaaaatagtccaaaaagtcttttaattccaaattcaaatacttcttcccccaaacatttgaaataatagatactcaaccatgttgtttccatccctggaaattggacagtcagaggataatcagacagtccctcttctacagctgcttatgctttaggacgtctgatgattaattggcatttctaaccagtatcattattcttaaatgttcatgctctttaaatgtttctgatgaactctgtgcctttgttgattggtcagttggttaactgattgcctctttggtgctctagtgacatatctcactgtctcatttcccacttcattcgacagttatgagatgctgtgttgatggaagagcttcctgcttgtacttggacaaggaatttatgtgactgctaagaagtatcaggaatgtgggaagggtggttagaaataccaagagctcaccatgaggtctcatgtaccagacttatatatggaatgacttgggtgtcctatctcttagctgtctgacttctatacacagatctagctgatatatccctctgtagggcagattagttatctatgattgataatgaataagtctactctttctcaaatcacttttctctataccaacaaccagaggagatgccacattcaaactgtaaatgtgaaactaaagagaacatgggacttaagtgatgttgacatttccccttcctggaaacgcagctgtttccaaggcagagattctgggttccagtctagttgttctatgagttaattgggcacttcacaaaccaactgggcagctagctctcaagtgtgattctcaggccacagtgcagaactgctcctattcattgattgctctctctctctctccctctccctctccctctctctctctctctctctctctctctctctctctctctgtgtgtgtgtgtgtaggtaggtagagggtgtgtgtttataatagaagtatatgccacatcacatatgtgaaggtcagaagacaaccttagatagtagtcctcacctccttgttgtaagcaggaactcttattgtttcactgttgcacataccaggtaactggcatacaaacttagaaattctcctgttctcggcctcccacctcaacatggaagcaatggaattattggttctcagcacttacactgcaattgccttagtcactgagccacctcttcagcgtatattgctattctcgacaatatataaatatgcgtaaggcatgttagcattttgcatcatgctttaatgaaaggaggaaatatctcagtgtcatagttatttttctattgttgtaccaaaacaccatgaccaaggcaacctattaaaggaggtatttaattatggtttcagggggttagagtccatgatagtgaaacataagcatggcagcaggaacatctcaaaactcacatcttcatctgcaattaggaagcagagagagaacacactgggaatggcacttgtcttttgaaacctcaaagcttgcccccagtgacacaccttcttcaacaaggtcatatctcctaaggcctgggggggcattcttattcaaactaccacactcagtgttatcatctattgaaagtttgttctgtcatagcccagagttctattggtagccttgatgtttataaatcactgagtggctggcttggcctcttgggggaatgcccttcctaattcagaaggcgaggctgttctgcctgagttttttatattctgcctaggttgtgtgatttgtgtcttagcagttgtatggtgattttgtcatggagtacaatggacagaccatctgttgttgaatgtgtcttagatgcatggctcagaggaattccacccaaatcctcccattatgctgtgggatctctgtgcctcgatgcttacagcttcccagctatggtttgaatctgacatgcctcctatagactcatggtttgaattgttcaatcactgctcatagcacaattttgatggttgtggagcctagctggtagaaatagggatgaaggttattcctgccccttatccttattctggcctgctttctctgcttcctgttccactaagatatgaaaaggctccatcatatgttcccactgtcgtcgaactacttcaccatgtcatcttcagctatgatgaagtgcacaggtggcttgcttctgtgctttctcgcagaagttccctcttcctccaccacctgctccttcctactataaccacaaagcttcctccccctttctggccgctcctgagagaacttgaggagccacaggtaccagcttgagtaagatggatgacagcctccctcgcctctgtgacactgaggttagcattcttccctgataactggctgggcacttccaggtgcagctggtgcctgtccttggaaaaaggagattagggtcccacatttgaatcatggaagagaggtgatcagaagccacagacagttgtggccggtcataaaactagtccccataaagacactccttaggtcggaagtatccccctctcagcctcaattccaccctaccaagtggtatcgtgtttgaattatgacttgcctcatccacctcccctaccaagtattcaaagaatctctaactatgctgtatataagcatcaagccttccaagcttgtggttgtactcctgtcctacgctgtgggaaggtctgtgatctgagtctgacttgaaaagacgattgcatcggactctgcagtttttaaactctcctgggtttcctgcagaatcgtggcataataatggactgaaatgcctccgaaaccaggagtccaaagaaagctttctttctatgttttattgggtattttattacagtaacaagaaaagtgagtaatgtacacctatgtgacacagtatagcctgtgatgaccatgaatctgaaaggatataaagcatcctcaggtttgtttactggttagataacaccaggctggttataccatggattatgatttgaagtatctgccagcaaaatccctaggatacatgagactcatattttactaaggcctcatacgctatgccattgatagagcaataactgaccatgaatccgagtcctgttcctgtcattgacaacaaaatccaaaaatggatggaaaagactctatagtgtttgcttattaacacatctaaaagaattggacaatttccccatcatcctctataaaggtgatataaactccattagcaaacagtggtgaattaattagtgacgatagagcagtaaaacaaatgtttatctagattgtccatacataaagttatttcaccaaagacttagctgtttgcatcttgaaaaagtacctaccacccctctgtgtatataacattcttcacattgactaaaagtgagtgatagcaacaagtgtacttatatatataattggttgccttttagacactgaagaaaacaggttataggtctccacacacaggagcacaggctgagtagaaatgaactgtaaggtcactttagagtcccatgctagggtgggacatgaagattgtaatagggttggcatgtagtaagaagacaggtatgcccaagatctgactacagggagcagagaacacaaactgagagcatggaacccagatccctcagctgctgtagtgagcagatagagtctggaagtaaaacagccattcctcatatgcagaaacttcccattgaggtctgaggttgcttgtctccagagcaggatctgatatgtcaatttaaataatagtggagttaacaagatttctagaatttttgtctgttttctcccattggtgttgtgaccatgctataccagaacagacacatctgtacctttctatggtgccaccacaaagtatgtcatcagttttattagcaggaatttgccaagtatcttaatcagcattacgagtgtctgtgggaatgagtatattatgatgagctctgttgaaggtttgctgtgagtcaagctgtagaattcacaggcttgggtggagtttagctgcaaaaatgaggagtgagactgtgaaggccatagaagtaggcctagacagaagaatatatgcacaaatggagggcagatccagacagacaaacaagtagagtgacatgggatatatgtacatgacatagccacttatacacagccacacatatacatgtataacatacaacacagtaaggatgcatagcacagcacacatacacatctgccatacatacaccactggcacacatgtacatttacatatctgcacagatgacatatatagcatatacagtttacatctatttataaatatgcctatattcaaacatatcacagatataccatactagactctgtgtgtattatatatctcttagataccattaaaaacatagatttgaatttggttttgacagaactccaaattgctacattttagtccttttttattgtatatatttgtgacctggtttaatagattcttactaactgcgacagttcaaattagttggtgattctataatgttgattctgaaagcttgagctggaaaaggaccaagagaaaaagaggacagttgtgagtgactaatgtgagtgactaataatgcatacattttagcaacaaattggagttcatttgattctggttatataatacagtgactatttatccaataatactaagtactaggatcttttgactgggagcatggctactacatttcaggaactgcagggtaagcagttcatgtatattccaacttttttgaaatgacacaggtgacgggaatcaaaatgacctttacctaaagccctggtttatctcccagttcccacacagctcaatctacatgtgcatagttcttgtcctttgttttctctttatataaatttggatggtgctatgagcaaggcagagacatactgagaatttctttttccctgaatttggccagaaatgtaatcaattcattttccatatatatattatatataatgaatgatggtgtgtgtatactgattcaggtgaaagttcagaaagaactaagctttatggctaggagtggcactaataggagttttgcaacaaaaacagctgttaaactaggtattgttccctaaactatccactatgctgcttaagatactttggtgaaacttcaaactagaagcttctgtgaacgtctgtatactacaaatagaaaatggcacttctttgagtcttgtttttttgctctggtaagtttagtagttttgttgaagtttgttttctaaacagtctttaatctcctgagcaataacacaagtgtgcctggcctcctaaatggctcatgagaacctaagtggtttgtttttcttggtgatatcagggaaattggggtccccttataataaaagaattaagaatggactcaaacataagcttgaggacaatttcattagagtttaaaagaaccccagggtaggcaagctgtaaacttaagcagctttgcagaagggagagagtggaggagagaaagaagaagcaacactgattgagttaagccagtatagaggttcaaccatatggtggggaacagagctttatagaaagaatgaaaagaggggtgggatgtagcttagttggtttctgcctaaaaagaatgaaaaagtcaaaagtattagggaaagtatatttaggcattggccagcattgaaaagaaaagacaaacagcaaaagaaaaagttaaacctttctaagtcaggccgacgcttgtagggactacactggggagcaggaattcagggaagcaaaagtacattatctaattaaaaagctattctttctatcatttttagcaggatttgaagatgaacccaccctcttgagggatggttccttagctaggtcaataacctgtctaggaatgttaaatctctgcacaggccagagatttcatcctctctaccagaggaaataatttcctctgagcctttattgctgctatgtcattaggatatcagtttctagctccattgctagtggagtttaactacttctatttgcagggatacagggcagcagagaggcattggttctgctctattctggaacatgttaacccaggaagggaccttcccctcccatctccccaggacacaacagggttatccacaagacagggcactgacatgatagccctgcagatcccacctgtaacactgatattatatatcatgtgcaggttgtaacaagtgcagaacctcaagtactctaggtatgaaacagggatgggttcctcttctcaatgactaggatatatcctctcaatgctacttatatatgtgctgtgcttgtctgagtcagtagcaaagttttcttggtagtatgctctacccctacccccactcccaccaaccaacctctgagtcaaacttagggctttgacacgttaggcgagcattcaaccactgagctatatactctatccctcaaaaatcaactgattgttcttgaaacaactcactttgtagcctaggcttgcttttaactaggtgcattcctttcactttggcctcccaaatacagggattatatgaaacaccatgcccagcccagaagtcaatcttagattgagaattgctcttttccttaaatcagaggttcgtttttctccttgggctttgtttggtgtagtatgttggcagaggcactacactctgagttgttttaagtttgctggtagttaatgcataggctttaataatggcatagacaattatacatccacaccagcttctatctgtgtgtcatgggcaggcctatgtgtatatgtgcatgttcatgtgatatgatagtataagggaaaactctgtaactcatagctgcttccaataagcagttgtctttctcattttgcatgtctaattttaaggtttttatgattgaattgattcttggcacatcttagaaaggccctgtgtatatgagcatttcccataagtcatgtaaaaatattacaacttgaagtaaatagtcccaaatatatgtggatctgacaattttcacaaaaacatgatttttctttttaagagagggtatttattttaggtatttattttattttagggggttattaaagaaatgtagttgatatatatacgtgtgtgtgtgtatgtgtgtgtgtgtgtgtgtgtgtgtgtgtaccaggtttgtgtatatgtgtcattaatgcctcatatattccttatataacatgtttcacatatagcctaacatttaacatatgttacagatcacaagtggcagtgagcacaggtgttaaaaaaatatgtagtccttaaagtgatccaagagaaaagatcctaattggaatttttgcctaatttttattccatcatcttctagacaagctgatgccctgtgttaggaagttagtctgagaacactgcaggagctactgaaacaactcaaaggccaatcccatattgcctgaattgtcccactccaagaaagacccagagctccctcctgtggagctctaatctaatctgtggagcctggactaatctgggactctacctcgagagtatacatactcagaggagtacacactggtgactcgggaccccaagtccaggattcccccttcaccccctgcctgctcagaaacacactttgtggctaatgagcatgaccctgtaccctaaagaggccttgattgcctaatcttgagcccaggaagtactagggcctagacagtacatcttcacctgtggctttacttgtggctgtccacaagtccttaccaacatcatttactgagtccgtggatgtatatatgtgatttgactgtccctctctcacagctcctctgtgctcagcagtgcccagccgcaagacagccagcatgtgaatgaagacacaactttccctcaaccagaaacccagctctcttccaagtgtcaacacctacagacgtcagccatggaaacttctcgctccccttcgcctcagtttgccccacagaagctgacagataaacctcccctgcttatccatgaagacaactcagcaaggtattgtcttatgacagcatgctctgtatatatcccatgcaggcttcgagtgtttgttgctggagcattgctgcagcttcaagcactggggtaaaactcagtcacggaaaattgtgtggaggatgaacacagctcaatcgaccagttgtgatttagtgacatcaggatcccctttgaacttaatgcatttcatttgccttacactctgatacatgccaactatgcatgttttgccaatgatcaaaatcaggtttagcctaagtataagatctttaagtaaagttgagtaatgtccagtattttcatagtctttaaaatactccttcacaagctgggtgtggtggtgcacgcctttaatcccagcacttgggaggcagaggcaggcagatttctgagttcaaggccagcctggtctacaaagtgagttccaggacagccaggactatacagagaaaccctgtctcaaaaaaacaaaacaaaacaaaaaatactccttcactcttttagtttttatttgctttttgagacaggctcttgatgtatagtctaggttggtcttgaacccactatgtagcctaggctgtctatgtaacttgacctttctttgaactccttatcctattgcctctaacctccaaagtgctaagatggccaaggactcaaggagctatatccttagcttctcagcctaacccctttaaactctggaataacccagataaaaggccgagtgccatgggttacctcttttcaagttattggtcagtgaggtctcatagaccctaaccataataggttattgtcattgctctcagttaccttccagaacttcatgcctattgcctattgtagaagacaccacatacttgagtcgtaaaacatggagaaaagaagttggtaacgacattaaagctttattcccactagctaagcatttcatagtataagaaggtgttatggatgatactaggggagtaattaatagccttacccagctttgaactctgggaactataataatgaactgacaagatatgcctactcatgcaatagtgacagaaattttaaggaaggttttaagacttgtttcacaaaacagaacttaatgtctcctactgttaacagtgcatagactgtaagagagaactgctatcattctgctatgtggatttagcattaaaccctcccttaagtgtttgtatctcttaaccctcatcagaaaagtttcttttgtaatagatagcaattaacacagtgatctacaacttttaaacatgcagaaaatatgaaacttctaagttttcaaccctaaatgcaacatcagtgttacacgtcctcttcccaaagttcattgatcattgtggaagagtagcagaggtagtaaatgactgtagtgaaactgatttccagacaggacagggcagttgtgcacgtgagctcacagtgcctttgactgcatgcacaagatcaagccatacaaatcccagcataaatggaagcacaaagtcccatcccctatctaagaagctgttggcaatcagtagctactgggagagggagagtcagttttctttcaagatgtggcccctgaaaggctccccatgctccaatagatagtcctgcacttatgcacatactaacagcactaagtgaactcagtggttttaaaagacaaaacaaaacataaaagtgagaaggaatagtggaggaatgtggggtggatttgatgaaaacataagtaggtatgaaattatcaaacaataaagattaagtttagaaaggacatcagttatgttgtttttgcatctctctcttagttaggttcctactgctatgctatataccatgaccaatagcaacttggggatgaaagggtcactttcctctcacaatttacagttcacccaccattaaaggaagtatgagcagaaactgaagcaagagaccttggagggagaaccactactattggcttgctccccacagtgtactcagcatgctttattatacaacccagggcctcctgccaaagtgggaggggccccccacatcaatcattaatcatgaaaatgatttagacttaggccaatctgatggaggcattttccagttgaggttccctcttcccagaggactctagcttgtgtgatgttaacaaaaataccaaccagcacagtctccagtgactgtgttaaatccacagttttatgtgtgtgcctcagctgtgttagtcatttttcaattggtagcactgttagggatctggagagaaaagctctagtctggtagtttctactttaatagaaccccacaggctaagtagcttagaaacaacagacatggcttgctccttcctgtttctagagactagaagaccaaggtcaagaaggtgtggcagattcagaaaagtgcttcatagatgacaccttcttgtgtgctcacatggtagaggaggcaggaagttctctactgttctttaataaagacactcatactattcatgaggctcaattttcaggacatctggaggaaagactgacagatctgtatgagcttggtctaaatagtgagagcctatctcaaaaaaaaatcaacctaagaatttgggtacatatacttggtttttttttcataccagtaggaaatgcaataagatgacgtgtgtggtagacaaactgtataccattttctcatgccagtcagctcagggtactctagcttctcaagtcactagagctacagtgagcacaatgggcttcatggtgaaacagtgtgtgagtctaggaaatggctttttgtcccagtgaatactggctggtgcaccctctccctctccctctccctccccccttctttgacttcgtttgctatttatgacagactggccggaaattcagcaatcctcctgcctcagcttccctagtgctaggattacaggcatgagttactatgcctagctagaaacttatagtttttaaactatgtttgccctgggtgagtcactgagactaatacagaacaagtaagttctcagtatactgcatggtatccctcacagggtggctttaggtgtcagtatgtgggagacacatggaacacatggcaaagccccagagtggaacccatgggtagaggtgctcagcaataattctaaacacagcaactctgaatatgtattctagggagaaggaggaacacccaggtacctgctgatatgcaacagcctacttttaagtttgtggtgattctgtccactgatgatttttcctacaaagggcgaattaataaatggtacttgatgcatttgtattgccctcagaataaaaacaagaaatcaaagagtattttatagccatagctcatgcgatagagcatttgtcttcccaatgcaagccctttgggaattcaatgcctattttcataagaaaacaaaaatgagtgttaaacagttcttatgtcattcaggatctctttgtctttgtccaggtgtgtgacagagtttgagttggactgctaggcatccagagaccgtgaggggtcagatgaggacactttccatcctctgctatctttctatttggctggttgacagtgggtctttgtgttgggatccctgtgtgggtcgtgggtggaaatctgtacatgtcaagatttcagaggacagcccttatctttgcagaatcgagcgggtgatggacaacaacaccactgtgaagatggtgcccataaaaattgtgcactcagaaagccagcccgagaaggagagtcgtcagagtctcgcgtgcccagctgagctgcccccactgcccagtgggctggagagggaccagatcaagacactgagtacatcagagcaatgctactcccgcttctgtgtgtacacacgacaggaggtggaagctcctcatagagcccgccctccagagccccggccacccagcacgcctgcacctcctgtcagagatagctgttcctcccctccctcactcaactatgggaaggccaaggagaaaaccatggatgacttgaagtctgaagaattagccagggagattgtgggaaaggacaagtctttggctgacatcctggaccccagtgtgaagatcaaaactaccatggatctgatggagggaatttttcccaaagatgagtacctcctagaggaagctcagcagcggagaaagctgctccccaaagtccccttacccagagtcacagaggacaagtaagtagatggcacacaccatagctgcttgtttctcagtccctatctcataggcttagaagtgaaagaagggactcagggggtgtatctataatcatgattgcttctgcggacaggtgatggttttccttggggtcctcaaccttagcactgtttggtaaggtttaaaattaccatacctggatctagcagaggcaagatgatgcccactgcagcaaatgtccttagcttacagctaaatcctttccagttttgtctatcactctggagaatggggcactcctgccatctagtggaaagacagtaggtactactaaagatcttatagtgtgtgaaatagcccatctactaatatgaagctaactgtccaccccattacctgtcttatgtccatcatctaatctctgtatttaatatgcatatgatgtgcctgtccatccatttgtttttgaagtagggtccctctaagaagcttgggctcccttaaacttgatcctgctacctcagcttcctgaatgctagatttataggatctaccaccatacctacctatctccctcccacacacttcttggtaatgttgaaatagaacctaggtcctcttatatactaggtaaatttgtcatcactaagttacaagtcacacccattttattttgttttgagacaagttaactggactggctttgaactcaaaaaatcttcctgccttagattcctaacagctgatgttgcacgtatgtgctaccacacttggctatttatcttaggttggtctctacagctatcatgtaatctttccatatatttaatctgtatctctttttgtctgcctgcctttcacctacttttgaagcacattacaaagtctgcctctagttgaacagcattttctctcattagagatgtttctgtgtgtttaagtttcagttacctaggggctgaggatgcaactcagaggtaaagtatttacctagaatgcgcacggccttgaatgtaatacaaatcactgatgggataagaaaaacagttttgcttccacagaaggcatgtgaccatgtgacagtgtctaaagacatttttctttgctatatctgggggcatggagttggtatctagtatgtagaacccagaggttgttttcaagattcagcagagcataggatagcccaacacatgcataagcatgcgcgcgcgtgcacgcgcgcgcgcacacacacacacacacatgtttttaaaaattaagaccctatagcctggattggggatatagctaggtatgagagtacttgcccaatatggcaaggtccacagtttctaaattactactaaaaaacaatggcagaaatgaataacagtctgtgaatcttatattagtagaaaaagtttttttattttgtttttgaaaacattttgggcttagtcttcttttctcatttccctggttcttgtccttctctccgtgccatttgttacaacctaggtactaagttcaaagagtgggcatgtgtcacagctgattaaaattttggcctcttcacccaggaaacaggacccaggtatgccaggggttgtgtccttggccaccaattctacctattacagcacatcagcccccaaagcagagcttcttatcaagatgaaggacctgcaggagcctgaagagtattcagcaggtgacttggatcatgacctttctgttaagaaggtaagaaagagaagtacaagtctgatgccagttcagtagctccaactcacagctattaaggtagctgagggaagagaatcatttaaggccagaagttctggaccagcctgggagaaattgcaagatctgcctttatacaaacaaaattccttgccttctgagcatggtgactaatgcctataatcccagcactgagaaggctgaggcaggagagtgagtcagacagttgatgctgcggggtaagttcaaagccagcctgggcttcacagtgagatccttcttcaaaaactaaagtaacccttccctcaaaattatatgctgggccattgaaaggtactaggaccactcacctcagcagataccttccacagcatctctgagggcatttgtgcttgcttttcatggaaggcattggcatgaataagctgttcatgcttaattgtattctaagccttctacaaaacccttgtaggcagactagagaaaggagctctctgtaagggtccccgtgttctcaggaattatgtaaggccaccaccaacaataccaccaccaccaacaacaaaaagatgtctaacataggcttggtaaaccttactgttctgcctacttttggaaataggttttttgaaacatagccacatccatttgtttaaatattgactgtcactgaccatgtaacaacctacaaggagtaaaatagctcctctctagcccctcatgggaaaagtttgccagcccttgttattctacatcaggtattggacagttggaacagggtgagtgaatagagagagagagaactgcctgattgtagagacccagatcagtgccagagctcaagccccataagtgagtgctgtgtgagggaaaagtgaagcaggcgtagatgccctatgggaagagcttggtggtcttggggagaagcagcagaaggtaaggcttcagctttgggaactaagaaagaaggttggagattaattcaggatcaccttatgtggcacccatgacagtcactgcaaggacagtgttatctctactgctaccaacctggtaatttgaaagatagcatagattgatcttaattaccttagaaatgttagggagggaataccatgaactatttatacattaaaaacatcatttcagtggattctgggaattaaatatggagatgggtgtttggtctcacaagagactttgaattatattattatgtattttattctagttgcatgttcgtattttaaaaaacaacatcttcaatttttgtcctcatagaacaagtcatagaatttgaagcattttaatttaggccacactgtacatacactttccttacagttaggccttgttatttcatattgtagtgcatttagaagtgcataccctggccaaggacatagcccattgggagaatgcttacccagcttgtattaggccctgggttctttctctaacactctaccctacaaagtatatctaaatattttaaaattaaggtatggtagcacatatctataatcctagcattcagaaggaagagggaagagggttagcacaagttcagggtcagtctgagatacatagccagcttgtacaccatccagaactacatagcaagtccatttcagaaatgtcatcccagccgcggggggggggggggggggggggagggggggggtgcacgcctttaatcccagcacttgggaggcagaggcaggtggatttctgagttcaaggccagcctggcctacaaagtaagttccaggacagccagggctatacagagaaatcctgtctggtaaaacaaacaaacaaacaaaagcaagaaaaaatgccacccccaaaaacaatttaaaagtgatctcacccccctttgtctgtatagtgtctgtatttgctctgagaggcaccaggagctaggatactgtgtcattagaagcaactactttgggtctcagggaatcaaagtttgaacattttttattttatttacttttttttggacatagactcatgttatatagctcagactgacctataacttgttatggaatccaggctggcctctaacttgtcctcctgcttcagtctcctgggttctgagatttcatacctgcaacaacacactcagccagacttacatttttagatagtaaagattaatttggcggtttatccaccccatttttgggatgaaagtactctacccataaattgcatcccaatcttccttttaattaaaacaaaaaagtgtgtgtgcatgaggggtggggttctttgtgtgtgctatacacatttgtatttgttatatttactttagtttttgagagagaatcttgctacatagccttgtctggcctggtacttcatatgtagcccaggctggtcttacagccttccttcctcagccacttcagtgttagacaggcatgaacaactatatccaactccacattttattttacttttgctctttgaaaatcaatgcttgatggctagagagatggctcttgggtagaatgcttactatggaagcatgaatattggagttcagaacacacataaatatataatgaatgtgtcactctgcctgtaatcccagtgcttaggagacaaagacagcgactctacagagcaagctggctagctaaaatagccaattcatcaattcatcattgtctagtttcaagtgagaggccctgcttcaatataccatgacaatcaagagcgacactcatgtcaacctctggctttcacacacatacatgtacatcatatacacatacagtgaagtcagggtacacccatcatcctagcattgaggttgaagcaagaggaccatagattgtaggccactccggactatacagaaagactatctcaacaacagtaacaataaaacaccagaaacaaaattagtgctttaaggttagggatatagctcagtgacagagtacatacctaacatgtaagaggtcctgagtttcattcctaagactacacacaaaaataaaaataataataaataaaacttattcttttctttttttctagtgtaattttttaaaataaattttaaagtaagatgattcagtatggcatgtgtatccatgtggatcattatacttttcttttttctttattagatattttcttcatttacatttcaaatgctatcttcaaagtcccctataccctcccccgccctgctccccaacccacccacccccgcttcctggccctggcgttcccctgtactgggacacataaagtcatcagactggcaacaagcacccttatctgctgacttacctctttggctcatataaacaaggaagcttatatttaaccaggaggtcttctcatggttttacaaaaccccccattatttgatgatgcaaagactaacacacccaatctggctgaattctgcctaggctgtatgtaatttgtctacactttgggcaacagcttggggtcatcctaacaaatatctccatgcctctctgtgccctacagcaagagctcattgacagtatcagccgcaagctgcaggtgctccgggaagcacgtgagagcctgctggaagacatccaagccaacaatgctcttggggatgaggtggaagccattgtgaaagatgtctgcaagcccaatgagtttgacaagttccggatgttcattggagacctggacaaagtggtgaacctcctgctgtcactgtcaggacgcctggcccgtgtggaaaatgcccttaataatttagatgacaatccttctcctggagatcgggtacatgcaaacacatctgtctgggaaatgggaagtgttgagaatccttcagagtggctgtccttaagatgctaagaaagtcagctcttagaagcatcgtattatctgtgcatggcctgtgtactctctagagcatggtgccctgatacatctggggtccattctcttggtttcctttcaaatgacagaacaagataagtagatgcagggagtcaggggcattataagcatgtaccaccatgtgtatcctcagttttcttgtactcaaaagaagagaagtgtcttcctttctggttttatttcatagattgtattttagtcaaagtctacattctttgcatagtatggaaaagaaggcacagacagagacaggaaactgagaaggagcctacgagtagcttttgggaggggtaaggaaggaagaactgtagagaagctagccacagttacatgtagactacatcctagtcattcctatgggcatcccatgtggcttcaagatttccaagtctccaaaccctgcagggcctctcagtggttagccagcctctactttagtcctgcctcgactgaactttctgtctcccttccccttaatagcagtcactgttggagaaacagagagtcctaactcagcagcacgaggatgccaaggagcttaaagagaacctggaccgccgtgagcgcattgtgttcgacatcctggctacctacctcagcgaggagaacctggctgactatgagcacttcgtgaagatgaagtcagctctcatcattgagcagcgagagctggaagataaaatccacctgggtgaagagcagctcaagtgtttgtttgacagcctacagcctgagagaagcaaatgagaggcacattcctacagaaggtggacaccaagccctggagattaatgcctgagactataagagtgaacccaagcctatttgcccatctctggagagacatactctggagccacgaggctagtaaaaaagcaataatgtcctgctagtatgtgatgatttatttatgattttcatttctgttggtttgctgaacatagtttcatatcacatgtgatttcacagaatgccaggctttgctaaacaacaagggttctctagccctcctttgcagcagtggcaccaatgttcctccctcgtgtagatgccaaatacagtcctacagtgcatgagaggaaagacccttgtgatttagccagacacgggctgctgtgtgttctgtccttgttcatttaacaatgtgagcattcctcattctgtcatggtgacattctctgactcagtaaaaatcagtgatgatatttattcatgtgtggaaaacatgaacagtttcctagtagttaaagactaactataaaatgaacaatctacatattggatccattcattccaagattaaaattatcacataacttgtgtgcatgttttgaaataccctaaacagatatctagtatccttcttgtcacatcttaaatactttctagccaagtgattttaattggataaaagtgtgtctactaataatgttattgcttgctttttatttcctgagaccaatggaatattttgaagtttccttccctggaacactaatttgtgtatatgatctttaatgataatcagtggtttatctctttttatgtctgttaccatgggccacatgccacatgccacataccttaagacttaagactccatctagtggtcagaggtcctgtggagtgactagtgcttacatttgaaacagagttttgtccttaacagttcaaatggcaagatgacaaatagagtgttattcatgaaagctacactgtcattctgttggtttccagttgacaggacagattgggaaaagacatttttaaatcatgtgtctgacttgttgctcattttgtttttgttattatttgtttgttttagaagagtctaacccagattggcttcaaactccctatgtagtccaatgaccttgaactcctgatcctcctgcctccacatcctgagttctgggtttagcagcatatcccacttcatgacttcatacatctatctgataaaggatttgtataaagaacttccaacatccaatagtaggaattgtttgaaaaaaaaaaagtgggcaaaagacttgactagacccttcaccaaagaggatatatgtatggcagataaacacatgggaaatgttcagctaccaatggcgtgtataacttgcttatgttaaatgtgtgtagatttggtgttgttcaaaaggtgtttctgtaactaagtgcatggtaagtgatgagcaagtctcttggtgacttggtatttaggcatcactagtctttgttctaccaagggattatttaattcgtatgttcccctgagactgcagcatatacgaagatttccctctcttagcagtagccacaccttttccaaaatacacatgcacatttacatccatgtgtatgtgcacgtgttcacactcccacacacagttgtcttaaaggaccagaatccatgcttcttgagccagaggaacagacgttgacagcagaagctctggtgaagatgatacagtgtcctccatacagctgagtcaagattggcgagattttatatgcagaccatggatgacatggttgacatcctatcactgtcagtcagaagaaaatctttgcaaaagtgttgattcctgttaaatgaaactattctaccttttgaagttcctgatctgccactgcagcctctttctccttccacttggtcatcctttgctgtgaatgtgggtcatgtcagaaaacacgatattggctctccacaaactatccaaggtgttgcagactattttgtttttaatttacaccaagctatttacctgtggttctttaatcccaaatacagtgttgtgaacattttaatgatatgtgtgtaacatgtgagtaatggaattttgtttgtctgtaacctgctttttcatgttgcttcaagcttgtctgttatgggaaacaatatgtagtgctctagcatgcttgtaatgaaacacataacaattatgaccttcttatccatcccctgcttgcctgttccatgtctgattagcagggacccaagaattccagagagtccatgtacatatgtctatgacttgtgatattactgcataagaaacaatctggtgctaatggttggtccttggcatgcataggcatgggcatgggcacagctatggaactctctgtaaatatactgaccttgcttgtggtcagcttttgtggctttaccctgaactctgccctggcaaatatgcacattcatgcttgatgcttaccacttatcaacagatcctcttgcttgactttaacaaaataaatagtgtctcttcagatgaaagtagaatgtctttatttcctactgtatagctttgtaaaaagaataaaaataccagtgctgggcatgtagcccatggggaagggtttgaacatggtgttctgacttcaaatagtagcatttctcctccagaaaatagcctaagccaggcactgtggggaacacctgcaatcctggtccttagagtggtgcacagctggacccacagcacagtttttccttctatatacgggtgccaaacacatccttaaaggggcatagtagataaaattcttgtgatttagcttgattcaggctgctatgtattttgtcctttctaagtcaacagtgtgacttcttatcacacatgtcataattgtgtgacccaacaaaaatcagtggtaataatgtttagaaatataaatggtttccttgtagttaaaaacaaactaaaataaacagcatacatgttgagtgtactcaatcaaaaattaaaatcttaaatgc

SEQ ID NO: 115 - DNA, 146709 bp, mus musculus
tcccctccccgcgcccttttccgcgctccctcctggtccggcccgcgtagcgctttccaagttgcaaagcaagttcagcggtggccggcggctactgtagtggcggcggcggcccagccgcctggaggctcctaggtggtgggccggttcgtgcttcccggagtgcatgggcgtgggcattagcgggtggaagggctgagtgtggaggggctgagcgccccgcgtcatggagggcgccgagccccgtgcacggcccgagcgcctggccgaagctgaggcgccggcgaccgacggcgtccgcctggtggaggtgcagctgagcggcggcgccccttggggcttcaccttgaagggcggccgcgagcatggcgagcctctggtcatcaccaaggtaaggctaccccggggtctgccccgtgacagtcctgagatagtccggacccagaaggctggtcggggtttcagggcgctggatgggacgtccggttcgcggcctcgttttctgggacgcgtctgttgggagtcacctgtgggtgctgggttctgttcagccataggtgtgtggttccggctccatcctagccgccctcgggcggctcccaacattgctggtagtttcaatggctcctgttccgggtctccttcccctccccctctgggaaagggcctggcagtcccctgtaactcctggcctgtccagcggtggacctacacctgcgaggctgccatgaaatgaagggaaaaaaaattcccaggaaccagggagtgggtacagctttcccaacttttgtttgcttgtttagggcccctggttgtcacccttttgatctgtaccggttttcagtctgaaactccctactagaagctgctgccaggcagtttcacgattcccaggagctcatcaatatttgctgactttcggcttcctgtcctacatccacgcgctctggatatctaccaacacttaatgaaactttttcagagtgcttttaaagtagaatttgagttctgatagtaagaaaagagatcttacttggaattaacgcgtgtgagtgtgtgtgtaggttgctttagaattggtattctcttaaaatgcaatctatcctgatacttaccaactaaacatgtataaacttgtataaataaacaacaagccaatctctcaggtgttctggttaaaagaaactagggccctgttctctaagcagagttgagtcttaccagtcctaaggacaaagtctcctttaaaatgcaaatattcctggctccttagaggtgtttgaaggtgtgaaaatgacttacaaatttccttatcttcccacccggattaaaagcgtgaagaattaggtggctccactggtcttgactttgaaaagtggtgtggtgttggcggcattcaaacagcaaaagacctcaaatcgatcaatcacccctcaccctgttacaaaattagccaccatgtaatcttttatatcaaagtggattcttttttgtttgattgtgccattccagggaatccaagccccagggcattccacatgcgaggaaagttctgtaccactgagctttataccaagtccgagtctgatacactcactccccttttttcttttcagtgctaggattgaagtcggccttggcagtactaggcaagtactcttctctcactgagctatctacagcccttatttttatttttatttttatttttatttttatttttgagacaatggctcactaagtttcactagcttgccttaaagttgcagccccccccccccagccacccgagtgctagtattacagggctgtactaccacagagaatctcatctgtggctctaaacaaatacttactggtgtttcttgtgcattgtgttttgcctgcatatatatgtctgtgtgacggtgtcagatcccctggaactggagttgcagacagttctgcactgccgcatggatgagtgctaggaattgaacctgggtcctctagaagagcagccaatgttcctctgtgccttttaataaaggttttcgaggtcatttctgatgtagttaaaaatgtatcaggtacatctctcagttctttcacgcttcactttttttttcagctgttgtttgtgttgtttgtttcttctttttcctcctctgaggcactcttttgatattttatatatatatatatatatacccggctaaaattttaggatttttaaaacagtatgtgtgtatatatatatatatatatatatatatatatatatatatatatatatacatgcatatatgtgtgtgtgtgtgtctcctctgcaacaagtattcttaagcactgagccatctctctaggccctagcatttgggctttcactgtataagaaaggtggaggttagccgggcatggtggcacatgcctttaatcccagcacttgggaggcagaggcaggcggatttctgagttcgaggccagcctggtgtacagagtgacttccaggacagccagggctatacagagaagccctgtctcgaaaaaccaaccaaccaaccaaacaaacaaacaaaacaaaaacgaaagttggaggttattttaaatggaaagatttgctagagggatttttgtgctcttttatatcagatagtcctggctcgctctcagctttttagaaatggaagtaggtgctggtcaaactcagccatgctaagctgaactactgagctatattctcacctatgcataattttcacatttcattataactgaaaatttataggtttgttgcttaggatgaatgggactcagaacaacttggggtttttgtatttccatgtacacatagacattcatgtactgttgctcctgtgtgcacatgcatggacttttaccacatgttctattgtgtagaattaacagtatttcatctacttgtcagttctttactattaagaatattagtacataggcccagcaaggtgactcaactcccttttaaaggcactaagcctgatgacctgagtttggtttctggaagccacatgaacaccatggtacacatacagtaaaagtaaaaacaaaaccattatcagtgctgtttgcttacagcatgaaatctggtaattatttgccatattatttaaaaatgacaaagggctcgggagagagatagctcagtggttaagaacattggtggtttttccagaggactcacatgcaatttcaagcactcacatggtgacttacgacttcggtaactccagtcctagaggatctgacaccttctggcctccacaaacagtggagcagatatacattcagacaaacatttatacatgtgaaattcaatctcaaaaaaggatgaaggaaacatttttgtttacagccaattaaagttagaaatagactgctctgtagttactagtggaaaattgtcacctggaatttaatctaaatttttacttttctagtagctattgaaatgttattgtattgaagcatattaaatatgtttttctgatagtcctttttccatttaaaaaaatctatgcaatagttaatgttggatccttggtataccacaagagctttctgtttttctgttaattagaactatattatttttatatttatattatatattcgttattttaattctgtttattaataattttctgtttagctgatactgatttgggagtagcttgatctaatttaagaggacacattcttttgataataatgtgactatcatttgaagatcttatgagcacatatcttagaactgggaagggctggagatgtgtgtagctatacaagatgcagagtatgatcttcaacatcacaggacaaaacaaaactagaagagatggtaaaaaccaggctgatttagtcctggtttttaactgaagaattcttattggcccattttgtggattgacagctatgaccaagtgagggtaaaatggtggactctgaggtcacagacatggcaagttctgcataggaccttgaaagtcagactctgattgtgaggatctgtcttgcttcctgtccagcagatactatctgcttgtgactgaactcccttgctgtgttatttatactgagtaactcgatgccatctgtagggtgacagtttttccatcttggcaccattgatattctgttgtggggtcttttctatgcactgtagtccatttagctgcttctttggcttctacctactgaaggccattggcacatgtctccaggtatgacagtctgaatgtttccagacattgccacatgcccccaatctacagttataaatcatttattaggctcctagtgtgtcactttttcttttaaagactggatttttattttttattttttaaaatagtggccttttggtggtgtgtttgaaggcacttggcgtttccagtgttttcatgtaggtctgtttttctttttgagatgagctcttggctttgagaaaaggctttatttacacagtaaaatgcaaacaaggacttgcttcatctgcatttttgtagttggagaaaggaaacagagcagagactccccagaactgtgtgcttcatgggcaatcaaaatagatgttggagaaggtctgagttttctcaggagccggtttgaagttaaaggatgttaactttccctgaaaaaaaagtaagagcctttgtagaatttcagatacaggcctgaaactcaacaagacctctgctgaaggatagcgttaggagtcataacttctgagtatatttataacattgcagcttgaattttttctaccattagcaaacaaacaagcaaaacgtgtgtgtgtgtatgtgtctccttcactaaaaaaaaaaaatgaaaacacattaaacttcattttttcattctgatattgtaggaaaaacaggaacaacttgcagtttctaaggtgtcatgacttggtaatactctttgagagtattcatgtgttcagaaattctcagggcactggaatatcacacagttaattttctatttagttggtggtgatttgtaagtgaggtgagccattgggttgttgttgttccccctgcccccacccccacccctgcctttttctcccctaaattatggaaacagggctttgcaagtgctctaccactgagtgacattcctaggcaagtcttgctggtgttacttgtttcctctttcaatttagccactgagaatttcagtgggggagaagagcaagctcatttctatgatgtcacctactggagagttgcatctgccagctgggtatcaggaggccccctgcaacctcaggaatgtttatcacggaagaaggaatgaagcactggctattcatcttttattaaagccctccttccccccttaagaatgccagaaattgctaagaacacattcatcagggcctgggctagcttgaccttcctggcaagctcctttgaaaacctagttttcaaattgtctttgggaaatacaacattcttgatgtgcgtgtttgtgtatgtgcactacagtggtataggatacttggaagtgttttatggaccaggacaagcagttggtgatgggtatgtgtgtgaggtctactgtgtaacaataataccttagcgattgagaaaggagtttagaggctgtgtggagttaaggtcatggtggcctgagaccagagacgttaaaacagtagcccaatggttgtcccttgtacccttttgtgttgttgatttttttttgtttgtttgttttgtttgtttttttgagacagggtttctttgtatagctctgactgttctggaactcactttgtagaccaggatggcctcgaactcagaaatccgcctgcctctgcctcccaagtgctgggatcaaaggagtgcgccaccacacccggctttgcaggttctttttttaagttttatttttattttatttacataagtgttttgcctgcatgtaagtgcacagaatacagtgtccacagaggccagaagatagattggatcgagaattacagaaggttgtgagctaccatgtgggtactgggaactgaacctgaattctctgcaagagcagctggggctcacttgagtcatctttccagacctcattattgagaggctccatagagcccaggtgggcctcaaacttggtatacagagaaggatgacttaaacttcttgtcctcttggctccagctaaatcttttacagttctatgcctccacagctatggggtacggtgctagggattttgagagacaatgaggtactctaccatatgagtcccatccctaccccctacatttgattttgatttgatcaccaagctggcctggaaatctgtgtcaaattacttgagtctgagtgctgagattatgagtgtgctactatgcttaaggggtttttgttttttgtttttgtttgttttttgttttggtggtgctggtggcggtggggttgctggctgtagatccagagctttttaaaggcatgaagttctagttgaagttttgaaagtgggactcattgaatttagcagtggaaagataaatgtgaacttctgtctggatcttggttcacttctgtgtgccacacagttcacagcaggccaaactactactctgttagtgtttgagagagcttgggtcacctccccacccccacctcctcacactagggtgctaaggttctataagtcctcagaatggtaaaaccctgtctctatgcagtggcagtcacagcaggatttgcagttattaggatgagtgtaattctaaagatatatttgtcgtgaaaattcagagtctggttaaaaacactaggtaagttttctttcctgtgctgaaaggccttttcacttgggagacttgccttgccaactggctttcaaatatatctttattaccccttccagcttgcaaattaacttggccttgtggaattctaatccttgttccttcagagatgttttaggcacagggggtggggagccaggcacaatgtctaaagatgtagtccaaggtcttatagctggaggctttcagcttcaaatcacggaggattctctctatgggaggcactagagtatgtgactcacacctataaatccagaggcttccaccattacaaaaaactataaacctgagctatgccccacacttctgtattgtgctgaattcggtcttcctggctgaggtaggagtattgcttaacatgtcctaacatttatctcttgggaaaataataaaggtagaaagctagtttgcctaagagctacatgttgaataataaatagtagttttcacttggacataatgagatagtcttttgttttttctgttttttttttacttgtgtatttcatagttctttacttaggaggactttttaaaatgcattttggaattatttccttgcagaagttgttttgtgtcagcatgcaaataggcttggatttatggcccagctcttagaagcaaaggaggaaaagtcctggggtctgttttctttgcatgccaggcaaggaggaaacattcaacaagataatttcagggtataaaggctgaatgggctttttattcaggccatcttttactttcagacactagaaaggtgtggggccaaggccttataggagaaattgtacagtatttggaagattaggctcttttgatatatgtgtgctgagaattttaacccacaggaggattctgaaagagttctattaggactttaaaacatacagctggatgaggagtgaggggaattggtggtccctgaagataagactcagctttctttttttggtttggttttttgagacagggtttctctgtgtagccctggctgtcctggaagtcactctgtagactaggctggtctcgaactcagaaatccacctgtctctgcctcccaagtgctgggatcaaaggcgtgcaccaccacgcccggcagctttctttttatactgaaaaatatttttcatatagtatattttgattatgtttccccccccccaatctccaactcctcccagttccttcccacccctctacccacccacctttatgttttctctcttaaacaaacaaaaataaaacataaaaccagacatacaaaccaaaacacaaccagaaatcaaaataaacaagcaaaatacaaataaggcaaataagattcccatcccagatttgtttttatgtttatggaaatagctctttggtattaaagtttatttttttcattttttttgtttgttttttatttttggtttttcgagacagggtttctctgtgtagccctggctgtcctggaactcactctgtagaccaggctggcctggtactcagaaatccacctgcctctgcctcctcccaagtgctggaattaaaggcgtgcacatgtgccacaactgcctggctcagatggttgttcttatgtactctgaattacccaggtgctgaaggtaggccttttgtatactaggcaagggctttagtataggttttccatgaccaccagtgaggtacagtaccaactcttgaaactctttcatttatttcttatccttaaacagtccatttatagatgtcactctagtttttgttgcttttcctttgcactatagactaggatttagtcttgcctctgcaaagactcctctgctaatctttcatctcccaactccttgggcatatttattgtcttttcttccattcccagtgagtccataattttggctacaagaatattttttcaacatggacattattgatatttggggctaaattattctttatcatgagatcatttgtgcaaggtaggatgtcatcttaggctaatcccccctcagtgacagctggtgacagccaaacagacccccagatattggtagatgttttttgtgtgctggctagttttttgtcaacttgacacaaattagggtcatctgggaagaggtgacccgtgttgtgaaaatgcttatatccgaatgacatagaggcaagcctgtggtatattattctgattggttggttatttgtgggggagggcctagcccactgtaggtaatgccaccccagggcaggtaatcccagggcttgtgtgagaaagtgggctgagccagcagtgggaagcaagccagcactcctccatggcctctgccttaattcatacaagctccaggttcctgccctgacccctcttcctacagcactaatacctataagatgaaataagtcctttcctccccaagtctcctttgctcattttgtttatcaataacagaaaccaaactagaacaccctgaggactaggttaacaattttcagtgcttatattattttatttatttatttatttatttattttttactttgtggtggtagaaatagaacccagagcctcatatattctaggttaacatctctctcactgagctatatcttcaattgcaaagatttttaaagcttgctttctatatttacttttagtattttgtgtgattgatgatcaacttagtgctgtatcctatgcaagtgttcccccactgagttacaccctagtcctataatttggatggcaaatgatgtcactgtttggcctatgggaaggagactacaggcacattgtgattatttttcatctataagattgcacttgggctggtagtggtggtgcactctggtaggatttgctgaaggaggcagaggtaggaagatcagaagtttgaggccagcccaggctacacattttacaaaaaaaaaaaaaaaaaaaaaaaaagccgggcattggcgcacacctttaatcctagcacttgggaggcagaggcaggcggatttctgagttcgaggccagcctggtctacaaagtgagttccaggatagccagagttacacagagaaaccctgtcttgaaaaaccaaaaaaaaaaaaaaaattgcacttgggaggcagaggcaggtggatctttgagtttgaagccagcctggtctacagagggagttccaggacagccagggctgttacacagagacactctgtctcagagagaagtggggtagggaggggcagagagagacagagagagagacagagagagagacagagagagagacagagttttatttcattgcttaatttcttctgcagttgttacttactgtaaattctcagtggtggcacatctcttcttatatttttatacacaccaaagtagcttttcttcactttgcaatattggggttatcttgccactctggtggtcacagttctccgttttctgcagtgcaatattatagaaataaggtcagacatttctggtttatgatctgttagactttctctattttttctctcttatttttcatttacttgtgattttgatcttgggagattttgtttaaccttatcttccaatcttctttttttttctccaaattccaaattttgtttcagagttgttctttttgttgacaccatatggattttttttcatttcttttctttcttttttttttttttgattaattcttttgtctaataatactgaggcggttttcaaaactatcaactttccataaggattttgtttctggagtcggcttttattagttgtctggttttctctcttccctgacagaagtttctggtggtctttggacatctcctggcattaaagaacagattgtttgaattacatatactgtgcatatgcatgagtaacccagtgagactgttttttttctgggaaatcttggaagtccaaacctcaggttgtttcttttgagagtggtcatatccttatcatatagtaacttttgcacatatttttgtgtagagtggactgcaaggtggaaggctaacaatagaagagacccttcccttgctcagctgagtgaacaagacagaagagtagtcgtgtcctgtactctagccatagtggttccagcttgaaggaagccaagccatccactagtaataagttgtcaatgcctgctggtgttcacagctagttctttcacttggtccttagcctttttaactctctatcccacagtttgttaaacttagaatcatttctgctttattgtattactgtaggggattaaatgaatcagcatgtaaagcgagttctagaattcattctcttcctcctctcccctcaatccagattcattataaaactgagaaattattttgtttttgtgtgtgtgtgtgtggtctgtctttttgttttttaatgtatatgagtacactgtagctgtcttcagacacatcagtagagggcattggatcccattacagatggttgtgaaccaccatgtggttgctgggaattgaactcaggatctttggaagagcagtcagtgctcttaagcactgagccatttctccagcccctgagaatttattttttaaaaaactgtttatgtatacttcttagttaggggttccattgctgtgaagagataccatgaccaaggcaactcttttttttttattttgtttttcatttattattttctttatataaatttcaaatgctatcccaaaagttccctatacccacccgcccctgccctgctcccctacccacccactcccacttcttggccctggtgttcccctgtactggggcatataaagtttgcaagaccaatgggcctctcttttcagtgatggccgactaggccatcttctgctactcttataaaggcaactcttataaaggacaaaatttaattggggctggcttacaggttctttttgaggttcagttcattatcattgcaggaagtacatcagcctccacacatggttgctggaggagctgagagttctatatcttcatccaaaggaagccaggagcagactctcttcaggcagctaggaggagggtctcaaagcccaaccgcagagacacacttcttccaacaaggccacacctcctaatagtgccactccctgggccaaccatatttataccaccacagtatcaaagtacttttttattatagacagaatttgagctggattttgcatagtatagaaatttaatatgtaccaaggtgattttttaaaaatttatttattattatacataagtgcactgtagctgtcttcagacccatcacaatagtatgtcagagctcattatgggtggttgctaggatttgaattcaggacctttggaagaacagtcagtgctcttacccactgagccatctcgccagcccccaaagtgatttttatactacttattagtataggtttcatagataatgcatttaagttaaagatagatctaatttgaggatgttcctcagtggttgagtgcttacctggtgtggccctgggtttgatacaaagctgcaaattatagatacatgactaaatgaaagtaaaagctacatccaatattagtttcagtctgttgttttcattttatgtagccccagaaatgaatattttcttctatctctccaaaacttacaattttaaagtaatacttattgtaatacaaatgaataataacacattttgctaattttataataacataaatgttctttcagatcaacaggagttgtcacaggtgattttttttttaaggtgagtgaaactagtgagaaggataaacactaaacatgcttgtgacatcaggctacatcttacttcactcctttattgatttgtaatagaaaatcattcaaggagttgaattcacaggtgtggtgtgagtgtgctttgtggaaaactccatgtagctgcttcccatgcatgcatgtatggctgtgtgaccatcctacctcagtgaagtccaaagagaagtaatgtctgccatttttttttttttaaagatttatttattgattatatgtaagtacactgtagctgtcttcagacactctagaagagggagtcagatcttgttggggatggttgtgagccaccatgtggttgctgggattttgaactctggaccttcggaagagcagtcgggtgctcttacccactgagccatctcgccagccccctgtgtctgccattttataaccaacccccaaagtcccgctctgcctggttgggataaagataaagtttcagaacagggctttatcaacataggtccttgaatgactaatgaggttgtttcccaggatctgtcattcacagagtattactactgtatgagcagcatgatcattcactttatctatactgccattacatgaaacaaacctgcattgcgatttggttcctggattgcttattaagtcagactgttctaacaaatgaaatcctggcactaatcaaaagtttttctttaaacaaatatgctcaagggacaaaatatataatgcttgaaacctgtgtaggaggacatattttactttgttggaacaatcacagtggctgtccagttagcacacggcttattccttacatactcattatgtaatgtgagacttccacacctgtggcttcttcaactctatcctttccttttagtcagtaatttaaattttacctagtcttgcctttcctccatgtctgtagatgcttacttgggaattctgtagaggaagagcagaaagctgtgcgaatgcttagtgtagataattagccctcaggtaggactgggtgatgtaatgatgttggagtttgtaccttggcagtgctgtccttttcttaaccacatggctttaagtgcagaacttgttgcagggaaggctacttgttaagtggtcatgaatggagctgccttcatcagattagctaattataatcctgaatggcagactttttcttcccttgaggaataaaagcagcacatagacacatatgagttggatcagcagtgtgatacctggggaagatgtgaggaaatgctaggtaagtagcagaaagtccttcctgcatttgtgaagtaggtaaaggtagttctttgtctacagatccaaattcctgtatctggtgaaattttatctgtatgtgaattgtgtatatgtttgtaaatttgcgaacaacttgatatttatcagtgttagttttacatatgtttgtaaagttgtgtgcatggtggcatgatggtactttaatattgtctggggttgtagttcattgatagagcacttgcttcatatgagccaagtcttgggtttgatccataacacacacagacacagaaaatacattgattagtagcttaaacataatatgatccttgtagaagtataattatatttattaatttttctctactcaggaattctgtgctgaaaacagtgtaagacttaatgattaaatgcttgaagataattatcttaagaatcacattgtcaaactgggtgtggtagcacagaaatcataactttcagcccttagaaagtggaggcaggaggatcaggaattcaaggttaacttctgccattatataattagtttcagggtatataaaggcatacctcaaaaaggaaaacaagcacacacaaaaaataattatactgccaaatctttggaatcagaagacagatcaaaagaagtttaatttgttcacgttgaactgttaagaaatgacttttgggcttagagagatggcttagtttttttcagagcactgagtttggttctgagccaaatgggaatcatttatcttttctagtctcctggatttctaatcttggctataggtttattactaaatctagaaatcatctttgataattctctcattaaacttctataaccagttgatcgtgaacatatacttgtcacataatcttcctggtgagatgttaaatatctatttatttactcaggtggaagggcatagacacaaaacagaaaggattccatctaagtgcctcctgatgaaccagtgagtttgttggtattttcctgctttagctgtttctgaagtcaccatctggtgggtgtgggtgtgattggaaagaggtgtggtccaggataaggaagatcatggagcagcaggacccaacaaatataaagctagagaggctgattatgaggtacacttgagcacagagaactaaggttttgtcctggataaagaggagcattgttgtatttaaacagtttccacttctttctgaccttgtagctttgaaagcattctgatcttgagttgtaggaatttctcttaatatagtggttctcagccttcctaatgctgtgaccctttaatacagttcttcatgtttggtgacccccagccatacatttttcttgttgttgttgttgctgcttcataactgtaattttgctcctgctgatgaatcataatataaatgactgatatgtgaccccaaagaggttgtgacacttgtatgcctgatgtccatggaggccagaagagggcttggagccatgtaggtgctgggaatcaaacccaggtcttctgaagagcagccagtgattcttaacccctgagctatctctagactgaccccttttaattttgtttttttttttctaacatggtaaattagttacttttaagattgctactgcaacctgacacaaacaacataaggaaggaattattttggtttagatcaaggattcagtccatcatggcagcaaggttacggtatagaagcatgatgtagctggtcacattatacctgtagtcaaaaagcagagagcaatgaatctttgtgtttcgggtactttctcctgtagatttagtccaggatccaagcacatgctacccatgtttgagtggatgttcccacctcagttaacctaatctagataactctttacaggcatgctcagaggcttgtgtcctaggttaatttgaatcctgtgagtttgacaatcaacaataatcataacagatgggaatatgctatatttgtttcccaggctggctttaaattcctaggttcaagaaatcttcctgcattagacttcctagtacttgggactataggtgtcagctactgtgttcagctaaaattcttccttttaacgtgtaggcttaagagtttgtttttttttttaatttactaaacctcatagttatcactttaatgccagaacatttttatcaaccccaaagaaatcttgcacctccattagcagttcctttctatcctctcactacatctatagcatctactaagtgtttttatttctctaactctgttagggtttgtctagtttaggtatttcataaaaacagaaccatgctatgtagtcctctgtgcctagtttcttttacaaagcataatgtttatgaggctcattcatatgtagtatgatgtagtatgtatcagttatgatccaatactattccattttataatggaccataatttttattcatttgctgatgggtatttgggttctttccactttgggagtgttatgaatgctgctgctttgaacatttatttactaactttgcctaggcattttcatttggggaatttttttttcttgtgtttcaggcttgttaacatcctctaggcatggtgtctgtgaggccctgtgtatagggaggaaccctgtgcttcataaaggaatacaattggtcactggctctgaggctgcttacccagaatttaaactagcaatttataaaatgatggggtgaaatgggtcagcaggttaaaggtacttgctgctcaagctttgcaacctaagttcaaatccctggaatcctagcaaagatggatggagagaacaactctacacctacaatattgcatgcccctcccatattacaatttttcaaaagctatagagttgtatgggcctttgcttatccaaacatgaatcgtatctcatgatagctctcagggtcctcccaaatagatatatttcagttaccagaatatatttgtactttggattgccatgatagtttctttataatcctatgaagtaaataggacgattttctactttactaaggatgacaaatttgttgtgaggggagactgtattctctcatagtgtcaccttcagatggggacaggaagtagttcacatgtctactgttcagaggacaagaatgtagactttaccttcttacaaggtggccatctttctttcgcaagggtgtgtgtcaatatccattcttcagttggcctagtaggagaatgtccttttcaccactacgaactgatcctggaatcctattgggaaattagtagtcgtcttcttttttttttttttaaagatgtatttatttatttattatatgtaagtacactgtagctgtcttcagaaaccccagaagagggcctcagatctcgttacggatggttgtgagccaccatgtggttgctgggatttgaactcgggaccttcgaagagcagtcggcgttcttgaccactgagacatctcgccagaccccagtagtcttcttttatccctcctcactctttcctctttagaataaccaacaactctgctgcaaaagaaaatgcaaaccatgttttttgatagtttctagttatgttttcattccacagtagaagggaactaccccaataaatttgttattatagaattaggggtcattgagtgtattgtagggtttatagtttttctgtgaatatttcacttatgtgtttgtttttttgctttctgtgtgctgggatttcagttgtgtgccccaccaagcctatcttaattatttttccttttttttttttttttttttttcctgagacagggtttctctgtgtagccctggctgtcctgaaactcactctgtagaccaggctggcctcgaattcagccaccactgctcggcttgaatatatttcttaatgattcatttttaatattttatactcttttactatgcttaattcccaaagaatattttgtatgttttgaaacaacttggtattcaacattatatataggatcttcagttaatgttcattaatgatatttttagggtatgaaaggatatgactttaaaagttgaatgagccgggcggtggtggtgcacgcctttaatcccagcacttgggaggcagaggcaggcagatttctgagttcgaggccagcctggtctacaaagtgagttccaggacagccagggctatacagagagaccctgtctcaaaaaaccaaaaaaaaaaaaaaaaaaaaaaaaaagaaagaaaaaaaagttgaatgaattttttatggattatttgattctcaaaatactcaatattattaatatgcttgatgtataaaatgcatttaaataataagaaaatttaagaagaaaaaaatttaaaaaaatattttgaccatttctttaaaaaaaaaaaaagccacctctgtccaagtggcattcttttactggtaatgttttactctctggatgtttcttcagacagcaaccaaattacaatttatgtacagtaaaccgcctctctagaaggtgtacaagctggtgtactttgactatcttcatctgggacactggaacatcacaactaagccactgagcatgcgctccttagaccccgctccttcatgaggttcctgatttgctttttgtcacaaaaataaatgagtttgtactttagaaaattctgcataaatataattacaaagtatgttctttatatctggattccttcactcaaatgaacaatcatttgagattcgtgtaatctattacaggaatcgattgtttgttcatttgaatactgagtcgcatcccactgtgtacacatgccacaatttattgttcaggttgtttccagtttggactgttacagtaaaagttgctaaaaccaaaaaaagaagaaaaaaaaaggctatgcacaactacctggcttccttcacccattcttagctccataagaagtaccagaagtctcaagctaacaatacatgtgcttgggatggttctaatagccagataactgtctgtaaattaagaaccaacaatcattttatttaaaggtccacagagtaaatattttgagggttgtgtgtctatgtagccagaaatagctatagacaatataaaaatgaaaggaccatgtaccaattaaactttattcacaaaagttggcagttgagggtggagctgtagcgatctcagtagttaagagcacttgctgcacttggagaggactctgtttcagcaaccaggtagcagctcacaactgtttgtagctctagcttcactgggatatctggacccttcttctgggcttcatgggcatgtatgtggtacacatataggtaggcaatattcttacccaaaaaaggcaatgggaaggatttggtatgctgattgatattaagcagtgcattttcagtgtggtttcagcagcatcagtatccactgagaatttgttaggataaaaacttttggacgctgctctggaattaatgaactcaatattgcaaggctgttgaggataagccagcttattctactactgactattttgaggactattgccttaaggaggcaaggtcattttgcatgggaatcatcaccatcaccatttgcatttttaaaatatttttattagcatatattgtacatacttgatttcttttttttgggggggggcagttcccgagacaggatttctctgtgtagccctggctgtcctggagctcactctgtagaccaggttggcctcgaactcagaaatacgcctgcctctgcctctcaagtgctgggattaaaggcgtgcgccaccaccacccggctcacaatatttttatatatgcacttagtgtattttgattatatttatctctccgcaaaatgctcccttgtttctgttcccctgattctcttctcttgccaactagtcctcttcctcccttttcatgccttgagaaaaaacatcttttgatggcccattgaatttaattaaggttgcttacacaagcctggatactttaccagtagctataccacttgggggaaaagtctcatctttacctgcaaccattaactggccatagatccttaggtatgagtgtgtccttcctcttgtataggtaatcatagctgctttgagctcaagagaggaccatccatatcatgtgtcaacattctactctctggctcttttcacctcatttttcaatgttccctgagagttggagggggtgatatagatgtcctatttatggctaagcattcaagagtcacttattttcagcacattggtcacttaaaagtctgcagttagtacttcccgttgaacaaacaaacaaaataaataaataaataaataagaacttatcttaccaaagctgatagtatcagtaatgtaaggagataatatagttgttttatttttttaaaactctgtgtgtgtgtgtgtgtgtgtgtgtgtgtgtgtgtgtgtgtgtgtgtaggggtagacatgtgagtacaggttccataggaggcctgtggcattggattcccttgaagctggacttaaggatggttttaagccacctagcactggtgctgggatctgaacatgggtcctcttcaagaatagtaatttgcttttaactgctgaaccatttctctaaccctgaacataattattcagaatatcatttcatgagtacgacttgtccatttcatcgttagattttttttttaaagtctggatctctctgtgtagccagatatttatacgtctgagattaccagtgtgggccaccaagtccaaatgagacaattattgacatgtgcaagaaaaacaaaacaaaacaaaaaacatgttttctggaccccagaaaggtaaattttagcaactggtccagatggtctgatgcacaccagaatcagaactgatttctggagagatggctatgaaggaagtactgactgtcttctagaggacccaagtttgcttcccagctctcatgtggtggctcacaaactacaactctagtcccttcgtaggcactgcacaaaagtaatgcacagacatacatatagataaaacatccataaatatttttaaaataattaatttagaagcaaacaggaggcattagggaaccttttctaactacagccttcacttcagttgaggtggtttgcaaggaaaattgtgaatgtggaaaactggagatgtgtgttgtgtggttttcttttgtctcatgaactttacccagagtaactgttccagtatctgcattcacatgcctatacacatggctttacttatcctggtacctcaatgtattctgaagtgctggagaggctgggattttgatgtgtgaaatgaagatgggttgaggaatgctgttcaacacgatgacttggatagggagtgcctggaacagattattgactgcaagagaaaatagaggcagtaggatcatgagtttgaagtcaaactagactacttggtgagtgtcaggctagcctgggctatatatgagacactgtctcaaagaaagggggatgcccccatacacagattcaagtgctggccagcatatggaaggaaggtcctgggttcagtcttcacagtggaacaaaaggcctcatatattttactttggattacaaaaccctgagctcttggaaggcctttagggatcacatgcattgtcagttattaggatggcccagcatgcatttcatagtagtcattgctaaatgctttgtgcatgtctgtgttggtttggccctggatctgacccatgactggacagtccttgggagagagataggtgctctttaagaggcctcatcatcccatgctgactgaagggatctggagaagagagtcatagcaggcaataggtgaggtaggaggagcaacatcctttttgaaaggcagtgagagccatggaaagattttttcttttgttttgttattattttctgttggtgatcaaatctagtatactagtcatatactctactcacatgctctgccactaactcccagtaccgtggacatttttaagcaaggatgtggaagccagggccactggtaccaggtgtgtgaacagatgcaggggtgtgcagagagtatcaggaaactttgagctgctggggagaagtgtccagggattcaagtgttatccctgaggcactgttaggaacacctgacccttggatggaggatgctctgtggctttaagagtctgctcccttcttttaatttcctctgtaacccatgcctggaggaggccacggctgagtatggttggtcactggaggcttggctactagatctgctgcaccatgcactagacaggtagcagctcctgaaagctctgggtgttttgctagatgctgtacaggtcatacctttttctatttcttggtgcacacctggaacaggtgtgcttaggtgcctcagctgggggctgagccaccctagggcattgtccctccttagagattcaatcaaacaagtggtgtgaatttctgtgctcagttccaacagctaccaagagggatggaaattgaggtcctccagacccgggagtgttgaagcgaccaggtgtgtgccaataggccttttgaaaaaataaggattattataaaatagctttctaggcgacacatttggctcactttgatataaaatttcattttactttctcacatttttacttatttaccttattttaacttatttatttttgaggcagtcttgctatgtagcttgttctggctagaacttgaggtactcttgtttccccctcccacatgctaggattaaatttcctctgtttaaagaaacactgtaagtcataaataaaaatctagcaaacatgggagttacctgttaggatagagatcagagtcttttttttttaataagtttttttttaaagatttatttattattttatgtaagtacactgtagctgtcttcacacacaccagagggcatcagatgtcattatggattgttgtaagccaccatgtggttgctgggatttgaactcagggccttcagaagagcagtcagtgctcttaaccactgagccatctctccagccccgagatcagagtcttatctgcttttctttttgaaaataacatgcagacagctagctacaacatggagactgaataccaccataattacgattttagtaacacaaaaagtgacaagatggataggcaagctgcctgtccctaacaattaagaaatgtatcagccagaactagccagttgaggcaggggcaagcagatattgccagtctgggctggcccagaattggaacatagtgagttctaggctagccaaggctacaaagtataactttttttttcttttgtttttttcttgtgctgaggatggaagccaggcccttgtatatgataagcatacttgctatcactgagctatatatgtagctatatgtagccctgacaaatgttttatctggaaatgtgtgtgctgtcttaagggattatagaagaacatgggcagaataaacctgtgtgtttagcagagagaaaagtaattcagtgagtctgcttgagggaaaccttggctattaaagccactgcattcaactgtcagtgctctgaggacccaattctactactaatgctttaagctaatttgttatggtaatttacacagctcagtgtgaatattaatcaccatggaacagtcattcatccgatgaaccacctaattttgcaaagatcagtaactactttattatatatggccattgccaaattacttgcactttggaatgaaagctcattattttatgaccaaataagttttctcgatgttttgttcttaggaatttcctttttactttttcattttgagacagggtctcatttagctcaagttagcctcaaacttacttgcttatgtaactgaggatgaactgatcctcctgctttcatgtcccagttcttagaattatgtgccaccatacctagtttacgtgatactgaagattaagcccatgccaggcaagtaccctaccaactgagctacctctatatccctaaaaggaagcatttgaaattccatcacaagaaataaagttcttacatgtgttgtttgttttactttctagtagtgtaaacttgagccatgaaaacttagtttgtagcagttacttttcatagggtcaggctagctctatattgtgattttataattatatttcagatataagtggagaaataacgtaaggttttatattttattttttcagttttaggatggaactagggtattgtacttgctatccaaagaactctaccattgatcctcatcacttgctccaacattaaggtttttttttttatttttttattttttgaaagagtcccatgctggctttgaaaaactcactatcctcctgcctagtgctggaactaagaggtcagtcttgatgccatctgcaatatttagctttttagaggaatggaatttgcatacgttctaagttttctctcatcttttaagtttaaacaacaatataaaaaagtaaaattgcagcaagaacagagcctgtataaacctagatagaaatcctccataaattctcctctttccttttctatcttattctttattgccctttctttcccttccccttcttttaaccctcaccctccattccaagaaatcatttatgtggataaaggtaatttcaggaaacctcttagctagttcctagatcttcccttaaggaacatggaggaaggcaggaaagcagtctgggtattggaatttggttgcatggaccagcagttcggctgtgcttctatgatcctagcacataagaatctaccattttgaactgtgcagggtcttggttgggctgggctgggctgggctgagcctggcagtgtgttttctcctatcaggggtgttcagttactgctcaatacatggaaaatagtgagaaaagctccaagataaatgttcttcaaagtctcctatggagtggtacttagccatctgcctctaggaccccagtctttcctatagtctcaggactgagtaagtgagtaaatgaatgaatgagtgtgcttgtgcggggtgtctctagggaaggaggagggcagtttgacctttttgaatgaagtatctcattttcacatacaaataatgtaaaagaagcaaaggtttttcctaagtgaaagttcactctgcttgtaataaatttggataagtctccctaagaaaatcatactacagaggttgtagggtaatctgtgcttggaatggcttttaaggtatccatctagaaaatctaaaagaggagccagggagatggctctactggaaaagcacaagaatgagtgtgatccacggtaggagagaagtaactccgcctgcagaatgtcctaagacttctacccaggtaacacttagactctgcatgacatacacacacaaatagatgtaatgaccccaccttttgtgatgtcatatttaaatgagtgactttgaaataaaataaaaagactcatgaaggggtgtattgtttctggggctggagtcctagctgtatagctaggcaagctttctactgttgctcgtgacggtatttaatatcagcttccttgcctgggtttccttactgttctgtgactcttagcagaggcttctgttcattgtgttatattacttctgccttgaaagagatggggtggaaggggggagggaggcatgctaatcatcctatgacaaggtgaaattttaattgtagcaaaaactgttttagttctcatagtgttgtgaaaatcttgtgagattttgtcttcataagctctactggggatgagaaaattaatgagtgggagtttggagactacattgtaacttctatcctgcttcctgtgtttacctccaacactgataagaaggcaaccctgtatagtttatctgtcaggaacttgagtgtcaaagacaatgtgccttaggaaaagggcatttcctagcttttttttttttttttgacattctttgttcaagttgtatttctggtaccatgagagggatgtgtgagcatgtttcagcaaggcagatcagttcagaatggcttccctttcagtcagcactcattcaccattcaccagagtcttgaatgttttagtcacttcgatcattttttttttttgtttgtgtgttgtgtttgctcacatacacactctaggtagggactgtggaagtcaaaaggcaacatcaaatcctggttcctgccttctattttgtttgaggcaaggtttcttgttcagcacagcatatgcacagcaagctggttggccgtgaatttctgggtagtaagcacactgtgattctgcttttggctttacataggctctagggatctgaactccagtcttcctggttgcatgtagctatataagttatcattagcctttcttggtctcaagcctctagtatgatttggaggtggtaggacccttaagaagtggggcttcatttgaaagaagggtagatcatcagggacatattcttgaaggggatagtgggacgccaatcacttgtttgtctttgcttcctaacagccttgctaaggagcttgctttggcatgggcactgttaccatgtgggtacttggaaccaaacgtggatcctctgaaagaactctatactactgagccatctctccagctctgagtagccttaattcttgatcgaggttaacagcaaaacactaagcattccttgcaaaataataataataataaatttatgtccacttggctattggcccattgggggggggcagaatatgttttctatgacaagagaccatgttctctttgtgcctggcatagtggtggagtgaaactttgtctggattctagtgactgagaggtgataggaaaggaaaagaacactctctgctgtgactgaaactagtgggtcttaaagcataaagagtttcaaagaaacaggacaaaggagagaacaggtctggaaagtgaaaggtgttgctaggctgagaggcaaaggaccatgagtctgcattccactaaatgccttgcagtattgaggcaggctctaggagaacatccagagacatgctgagtctcaggccccaacaaagatttccctagtctcaaactaggggttaaagacttagcttgcattctgttgaattctaggttagactttaggaatgtcaactataatgagttctgtttcttatatctagctgatgttggaaacttacatgccccgattctctaaagtttatagcattttccaaaatagcaccaacagttaagaaccaagggtttaatatatgaacctacaggaaatagttcatattcaaagcttgacaacatttactccctatgagtgtgtatacaagcatatgtatatatgtgtattaaagacaaagtcttactgtgttgcctaagggctcaaatgaccctgatgcctcagcctttcaaaaagctaggactacagacacaggctgccttgcctggcttctccttttatattttagcatcactggtacttggtgatttaaacagtcttatttcagcctgtcagccaatcatctatcaattcacctacacataaggttttagaaatgacagtgcgatggccatttccattttgaacaaacaaaaataaaaccatagcaaggtacatcataaagatgaccatagaattaaatgtgaggtagaaatcaacacaacaacctttcatgttgattaaccttacaaatctttctgcatagtagaaagtcttcctgtctctatgtttatatccagtgcaatgaagaacattctcttttacttttgactccatctcttttcttggtactagacaaatcattgttgcctctcctgttggcttgttttcctgtaatttccttgtatagtgtgctcatactttgcctcactggggtagctgcctccagagtgctacatgctttacttgagtcacaggtgatggctagactagctctaaaatctgttgtattcttttctctttgcacctagggttgtccatgaggcaggtggcagcacccaccttcaggggaatagaggtggagaactgcaggttttccttttgtagagagccatgtttggagatgctggattagaggttacccagagaggaataagagaaaggacaaggaagagatgagggaagagaaaacaggagccatccaggaggatggaagaggataggcagacgagggaccaagtgaagaggagaatagaatgagtagtatagctctccaatgccaagacataaaaattactggattcccttctaagggaaggttaggaccctagtgtcccagctctcttgtgaccagctcccttgtgcccatttctacaaatgctctgatgttgcagccagtttactttgagcctttggggggagttcgagaagggatggggcaagggctgtgagattttttgagatggagactaagcagaaagacttccaaatgcctgaaagccatcagtgcctgaaatccatcagcacacagtttgagcattaaatttcttagaagtatgcaaagcgcgtcctgggactttccttgttagagagctgttctggggaaagggagaggagctgttatcaagcagccctgtctctgcctggtgctgtctgattcccttagcactgactggatttgttctgaaactccacccagcacctgctatcagcagcttcctccattgggaggtgggtgggtgctggtgtttctagctcagtcaaggtcatgccttaatccccacagaggtcagcagatttttcagaggatgaatatgtccttatggagagaaggttttattatattaacttgacagactgctcagtgaagggaaaaatgcagctgacagtgtttactgtaaatacagcgttgtattttcatttcttaactgagtgtcaggaaattgggcacacagttctgtgctttgtgattgcttctaaagactagaagtctggaggagaaagggtatgtggtacattgctagtcatgggttcgtgtttcccttcttccagcagtcataatgttctaaggcaacttcattcactttgtcccctgagactatattaggaatgcagagtataattgagaaaaagcatgtggcttactaaattttagcaaattgttgttaataatcttgagttggtatagtcccaaagactatgcctggtagaaggtttctgtcttttagcataggcatatactagcgttttgattttagaaatcaggtctctggaaggtccccagacatgcccaaggcactgggtgaacaagcccacattgttccccaccaccatcaccaccactctgatgggtgctttctgtttggaggaaaaacaatattcaccaagtttagctggtctggtaggaactggagatctccattggctcaggtatgaggatagctttgttatggagcccagtctggaagccttgttgcaggggtggggatgggtgaacattcgccataactagtgcaacttatgaaggaatttgtccttgacctgctgcaggctattgatctggagggactggaaagggcagcctatagcacaaatgatgccagaagccccttaccatccccttcaagactcgaggtccaaagcagcatgcttggtggcatagttcctgagtttattcatccaagtacctgttttccaaggtgactgtaagttaaacaggaaccatatttcagcaggtctcatctttaaaccagggatgaaacttcttctgcagcactgtttccatggtccagtggttctcaagcttcctaatgctgcagccctctaatacacttatgctgtaatgacctccaaccataactgaagttttgctactattgtaaatcataatgattttttatttttgagacataatgaaacagttttggagatagaagtttgccaaatggaccatgagccgcaggttaagaattactgccatatttgtgccttttttggaatctgtcttccctctgtagtctcaggtggcatttcattcttcctctaacccttgaaatagggtctcccttcagtctgtctcaacctggatcccagatactttgttaagtgccttttcttttttccagagttttatgggggcttataatttttacaataataacctcatctgttctttgtttgtgtgcatgtactactagtacttgaacccaacctaggccctaagatagatccttagtcctctttttgatttttgacacagaatgtcactgaagttgcctaggctggctctagactcactttgtagatcaggcccacaagtttactagttttaagtttagtgacttagtaaattcagagtttgtgcatccatcacaacacaatttcaggtcattttcattccgctccccaaaatgatgctttatacatgtaaagcacccaatttttctcctgccttagcaccagacggctgagagtctgctcttcaactctgagcctgctatggacatttcctgtaagtagaatcatataacattgactttttgtgtccagcttttatgtagcactgcacagtcaaggttcatgcatattgcagaaggcctggcagttcatttccgcctggtcctgagtatgtatctctggtgtggatagaccaccacttgggtggtctccttcatcagctgatgaacattttctttgcttcactgaactctgaattatctgctcctgttagtagttttccaggccccatgggtacacacgcctgggagatggcccaggctctctgagagtgagtaagctctgtagcttgtgggagtcaggtcatgaaagtcttttgaatataaactttatcccttgtgatcagggatggctttcttctttatatatgtattctaggatggttggtaaaatttaataaaccaaatatttaaaaaatgtgtttcatgttgcctctctctgacctcaggaagtagctctcaatttttgtcatatggagaaaaatctgtaacatcattaatctgacaactggctggatagataaagccttctgcatattctctgagttgtttcttgggagataaaacacattgtacgaatatcctgcctcttttgccctcctgatgctgtagaaagcggcgtagacagaaagacctaacttcaacagcagcagcagttttgctgtagtgtagtagaggcctgtgctctgaagctaaccttcgttttgtatagttctctttgatagaagaagtagagaagccaataggtagttaggcacatgttagacctggtcacgtgccctgtgctttatctgttttctccagtaggctgctgtctgctgtccttgtacacaagctcctctcagctgcctgaacacctcattattttgtctcaaccctgagctcagtgtctgaataatgaacagcagctctcccaagacatttcatgaaccagtcaggacaccttcaatgggacattgcaattgcttcttccagccttagatagtgaatgcccttgtcactgcccttgtattgggccttttctcatagcagggctcagttaaatgagcagagaagctggaattgattgatctcaagcattactgtagggaattggagtattgactatactcagggtttaaatatgggcagctggttggagttggattagtgctggcatacaggaaagctgcaaatggcatataaaaggcttgttgtatgtatagctactagcatgttttaatcgcagtgagccttggggtgcacgaacctttgatacatagataaatcataacaactaagggtggacttgaggtagtctgcaggaaagaatctatgtagggaacaactgtacttagcatttgttttccttgaggaatgttttgggtgtgggagtggctcaatatggcaaccaggcttttgagtttgatcctttcaagcttgggttagagtgaactactagtatacataccactgttctccaagcttccataggaagtccagtacaggcctgtgtactccagcaaggtgaatgaaaaaaaaagacaaatgttttaaaaatattttttcaagacagggtttctctgagtcacagccctgactgtcctggaattctttgtagaccaggctggctttgatctcacagagatctgtctgcctctgcctcctgcctgctgggattaaaggtgtatgcccccatgtctggcaaaagacagaaattttaaagaagaaaaatttaaaatcactgctccatttttcctcaaccatgttagaaaaacatattttctagttcaagaaggctacctggttctttgtaacagcatcacgaagtcataagtaagaaatcacccactaaaatacagtttctagctacactggtgatatatacttgttatcccatcactctggaggtagaataaggaccatcatgaattcaaggccagcctgggtgacatagtgattccaagtctctgtgggttacaaagtgagaccctgtctcaacacacacagagagaggcagacagacagacagacagacagacaaacacacacacacacacacacacacacacacacacacacacacacacacgactcaccttatagcttatgatctgctaagacttcacttttagtctaatgagaagaaatcagaaaccaaatgaaaaccagatgcatgaaaagagtctcatctttttcctgactgaaatttcaccaggagccttttggtgtagagatacgcatcacagatcaatcttgagttacactgagtattaattatttctgtcatttactaattagtgtctaagagagcaacagctgatgtgtgtgtcctgtaagcacatctgaatgggtgatgcagtggcttgaagggatgggaacagtttcccatgtgttcctttcatgggtttgggtggagtgcatgctaggaattggtcattttcttgtcattcacatttcctaaccagatgtggaatctaaccagaaagaaaatcttgtttgttcatctggcttgtctgaggggcacagagcttattcccccattcccaagagaccactggaattgtgtcccttctgcttgatcattcatccccaacacaaatgtgtgtcctgccatgataagttagtgtacatttcccagaaagtataaaatatgttttgttttgttgttttgtcttagagacagagtctcactaaacaaggtggcttcaaacttactatgtagttcaggctgccattgaactctctatcctactgcctcagcctgtgctaggattacagaccttctgtaccaccacattctacttgagttttatgcaaatgtaatcctatagcagatcttcttttcttgctggctcctttcactcagttattacttagacacttgcccttgtttaatgtgtgatagtacattgtcaggtgggcaagctggatgttggtaatgtccttttttaaacattagattttttaaagatttatgttcattattttaaattaaacaaattgtgtgggtatatgtttctgtctgtctgtctgtctgtctgtctgtctgtctgtgggtatgtgaatatgagtgcaggtgcccaagaggctggaggcattctatcccctggatctggagttagaggagtttgtgagctgcctgatgttggtgaactagggccccctggaggatcagaaagtgctattaaccactgggctatctcttcagcccctagaagttaattttaaagagacagttgaaaggaaatctaagaggatgatcaaagaaaactccctaggtttatacagattattcctttcttgttgaggcaaacatgatgcttctttttctttctttctttctttttttttaattttagatgctaaagattaaacctacagccctatgcaggttaggcaagtaatgtgtcactgagttatgatcccagctatttatcactctagttggtgacatgaacctgggacagtggcacctaaatgtaatagccaactttattcagagcagcagataatttgtactctgagggttaagaacagagtcacctgagtaaaggatacaatcacaaggacaagctgcatgtggcaaaacatatgactaacaacagctgaagtaacctcactcctatccactacacctgggaggggcacaaaaacacattccaagaacaattccatgtttttgaagaaacagaagtcacaggattcttgtcttgtttttttggacctttctcacaagcactcagaattcccctcacatgactccattgttgaacctagtttcaacactcagccttgtttttcccagcctctcttttattttctttgactcctgcattcatttgaaatgtcatggaacactgactgcaactttgacttcattttccaaggtcacataagatttctattctctctggttggagacaaggtcttctgcagtttagcacccacaggacaagagaattttggagccattaaatggtgcaaagttaggatatatatctcagtggtagagtgcttgtctattataacaaaagtcctgggttccatcccaacactaccaaagggaaaaagatactttaaaagagaggtgtaacttagagaatacagggctgcacacttcttttcaatagacatcctttcttccattaaggtattaaccagaccagaccctgtttagcttcttagattgggttctgtcagagtggtggcctagacaataatgaatcatttgtaaggaaggcccttttttatattactgttttttaaaagttgaaagaatatttttatatatgctaagagcaaggcacttcattgtaagatcattaaactaaaaaaatagagtggattctttttttttttgggggggtggtggtggttttgagacagggtttcttctctgtggagccctggctgtcctggaagtcactttgtagaccaagctggcctcgaactcagaaatccgcctgcctctgcctcccaagtgctgggactaaaggcgtgcgccaccacgcgcggctttagagtggatttttgtttcaaattcctatgaaggtatgacagaaaatacaacttttacctcaaaattcagatcccttgctgctgctttcactgttgctaagtgaaaatagacttaggactggagaattggatcagcacttaagagcatttagctgctcttgcagaggttccaggtttgattcctggtacccgcatggtgactcacaattatcctcagctacagttacagggtgactcttctgacctccttgtgcaccaggcatgactatggtattcatacatgtatggtattcatacatacatgtaggcaaaacactcagtacacataaaataaatctaaaaaaataaacaataaacaatccaggagtttagagttctatgaaatcttcaatatgttgttgtaaggagcttatggtagaacagttgcttgcagttgcgtgtaaaaaactacatgtactacgggaaggagaaggaagaattgagatagtattctaaaattgccaaatgttggttttaaggttgttgaacatgggtgctgtccttgccctttagcactcttctgtagccaatatttaattttaagaaacagataaatgtaccaacttgatttgcaaaacaattttctcctggagtgaaaaactaaaagctgcctattcctcccttcttcccccccatcctactccttcacatagtcttgttccttcatggcggggtcttgtcatataactcaggctgttctggaactcaatgtgcagcctgggttagtttttaacttagaatttttctgcttcaagcctcctgagccctagaggattacaggtatgtgcttccattctggacttatatttattttttccccctctcctttaaaaaaaattttttttttctgtgcgtcattaagatggctcagctgtaaaaggcactcgcttgctgcccagtctgacaaattgagttcagtcccctggacccacatgatggacagagctgacttcctgaattttgtcttctgatattcacatctatgctatggcatgcatgtatgttccctccttaaataaatataattttatttttaaataaattttaaataattaaaaataaattgtatcctccatgacaatgacaaataataagtatggattttcataatgtataaaatgtatgttattatatatctccttcctttgttgtggcattgttgcacagaacgagagagtgtgcatgctagacccataagttacaccctaatctatttcctttgctatggtttatttaccttgtccatttgggtcatgttatgatttgctgctgctgtggtttgtttgctttttttttttaaagtcagagttttactatatagcttaggctggcctgtaactcaaggtcttcctgcctcagcttcttgagtactgaattataagtacttgagtactggaattataaacattaactgccatgcctggctctactgtactttgatgttcaagcgtcacattgtaatttgacaatttatatagtaaacatagttaattaatgactttttcaattatgacttgtttctttttttcgtttttattacatttattgtgtgtatgtgtttgtgagagagagagagagaaacagaggcagggagcgagggaggggaacaaaaatgaacacacatctttaaggagctggttctgccctttcactttgtgggtactgaggcttgtactcaggttgtcaggcttggaggcaaatgccataacctgctgaaccatctcacgagcccacattttaatctctaaaatatgataaattgccgggcagtggtggtgcaagcctttaataccagcacttgggaggcagagacaggcggattccaggccagcctggtctacagagtgaattccagaacagccagggctacacagagaaaccctgtcatgaaaagccaaaaaaaattcataagtttacagattgtataatttttctttagcttattgtcctgctttgtgattaatgtgaattaattatttttcctgtgctggggaaggaacttaggacctttgtacatggcagactagaagctatggtccattaagccacacataaagcccatatgtgtgtttatttgaagggattcctgaaaactcatgggattcatggactttctttaaaatgcagttgcattttctctgcgtcaccctcagcagtctcagttctgcctattgtcctggccttgaggtagtttctgctgcagagaacacagtgggccatttctaaggctaagtctaaaacatggtaccctgccacacactccaagaagccctgaaccttctcttccttgttcttgagtctgtagccaccagtacctttgagaatgagtaaatgtctgtaactttcaaaaggattcccactcttcctctaccaaaaggaaaggttgagagccagggaggttttaagtagtaattagttacttggtttccacaagaaagctagcaagcagggcttaagaatgctctgttgcattccataaagggggtgaggcaggagtgggatgctctggactgtttccagctctgactaccctttctttcttgctgtttccagatctgcctgcccagtaggcagggtgacctatcctagaaggggaaagagcaggaaaaaagaagaaactgtaatttgcttttaaaaccctccggggtctcttctatatcctttcctaaaaaggctccacccatcagggaagtaggttgtagctgctagccctggacaggagcacaccattgctggccctctggggctgggttttccatggctgaggcaaacataatacagagttgagttctaagtccccaccgatttccactattgttactatattactattgtatgtgtatgtagcagtcaaccaacacattgtttgccatgagtagaatcccatgatttaatttactttccttattgctcttattttcttgtttttttttaaaggacattttaatgaaacttttatttatgtgtatgtgtctgtgcatgtgagtatgaatacttggagactatgtattggatcccttggagctggagttataggcagttgtaccaaggatatatgggtgcttctagccaaatgcagattctcttcgagaatatacgcttaactgataaattctctgtagccttctaattttttttttttttgagatggcatcttgctttgcagttcaggttgatcccgaacttttgaacttgttgctcttgcaggtaatctgtgttggttcccagcatccacatcgcagcttacaaccactccagacttcagtcccaggagatccaacagcctcttttaacaaacagcctcttttgatgtcctggacaggacatggacatgatgcacatacatacatacatatatacatacatacatacatacataaatgcaaaactttcatagatataaatacaaaagaaaagagataggtccttttgaattaatggaaaaatgttactcctgacaaactttcttctatatcttaaagaatgaacaaagctatgtaacttactacccagattcaggactcatgcagaaagctcagggttccatccacagcattgattcctctacccacccacccaaaccaaaccaaaccaaaccaaaaaaaaaaaccaaaaacaaacaaaacaaaacaaaacaaatataaagaagaagaaaagaaagagaacatctgtattaatgttctagaagggtctagagccctttacagatgatctttagcttcatttccccaatgatgtaactatcttgaattttcatatggctagctcaaaaaacagtttgaatttatgtatctcttgtagatgtttatgttactgaagttatattagatattttttgagaaactcgttgtatgtgtcttaagtatttaagtgctaaatatgtttcaggatatacaaatcttgtggggctgtggatgtagctcagtggtagagtgtttgcctggttcaattcccaacacagctcaaacaaaacacacacacacacacacacacagagagagagagagagagagagagagagagagagagagagagagagagagagagagagaaaaaggtattaatttaaaatcttagaattactgcaaagaaaggggtgatacttatgttctgtgcaacttttcttgattgctttcatttttcattagtccccccccccccccattttctaacctattgggtgactgataacaaatgaagccacacatactactagaactttgacatagtcattgtttgtttgtttctatgtgtgtatacagtacgttgtatgcttggtgaccgtataggtcagaagaaggtgtcagattccccgaactggagttacaaatgtttttgaagaaccatataaggttctgggaaccaaatccaggtcctctgcaaaatcgacaagcacctaggtcctgacacagttataattcaaggtttttaaaaagggatttgtttgttggtttgttttgagacaggatctctatgtagctcagactggtctgtaactcattatgtagtccaggctaacctcaaactcaccatcctcctgtctttgccaggattatagtgatgtgctaccatgtctactatttctctaatcttgaaaagggaactagatttgttttataaactagttgtgaagtaagttggtagcctgtttctgtgaaaggttctacaaggatccattatctcctttaaacttggcaataggattgggggtgtggctcagtgtttgagagtttgcttgcttaacaagcaaaaaagttccaagattccacccccagtaccacagcaaaagaagtgtgtagggtatgggagttgaggaaggctggtggggtagctaggttagatcatcagcaccaaatgaacctggtgcattactgtaatcctaacacattgaaggtaccaggcaagaggcttaaaagttaaaggttatccttagattattagtttaaagctagtctgggctacatgagactctgtctcaaaagaaagggctaggccaagagtaggccagtgttcattgacatttggcttatctatctcccttctccatagtaacccattttcttttgaaagagatgtttcagtggtgagtcttggcatagccacagggttaacctacctccctttgcatcttccagtttagacttctttcttccttccttccctccattgtatttttgtcaattcaagacagatgtattatttttaacatagtgttttttaaaaaccaccaataataaaaacttaaatgtgatattctctaggataaataaaattatactataggtcctagtaggtttcatatatagggataaaacttatattatttagaataagaatttatatttaagaattccaattgtttttggttataatttcaaaaaatattttcttaagatacttttttctatcttctcaaacctgtatgcataaaatgacaaatttaattgttgaagaataaagacaacagaacatcatgatggttttattttttaattttaaaaaacattttaaattatttaaaacaacttttaagtttaaatatagttttgatcatattcttaacctccctcaagtttgtccaggtcttttatgcctccctacccacccaactttaagttctttctcaaaaatcaactcaaaaaagtccatataacaacaaaacactgcaaatctagaaaaacacgaccgaccccatacccccaagttcattatttcttggtcaactatttctgaacatgagatctgctctggaatggttgatatacccagtatcattccattagagaaaactgatttcacctctcccattagatataagtgatagttctgttgttaacctttacaccagtggcttggttttcattcattcattattaaaaatatacaaaacataagataaaaaaatctgtcacatcaaaattggataagacaaagtaacagaaggagaccgtgtataaatgaagaggccctagggcacacctatccaggccctgtgcttgctgcatcagtctgggagttcatgtgcaccttgatcatattgtttcagagggccttgttttcttggtgtcttccatcccgtcttgctcttacactctgtctcctttgtaaggtttccttgagctctgagggggatggattggatggagacaaggtctctccctttctgtgtaatgtctggctgtgggtctctatatttgtttctatctgctgcaggaggaaagtttgtctgatgatggtttaaaaaggcactgatctctgagtatagcagaatatcattacgagaaaaaagattcctttctttctttctttctttcctttctttcctttctttcctttctttttcctttctttcctttctttcctttctttcctttctttcctttctttcctttctttcctttctttcctttctttcctttctttcctttctttcctttctttcctttctttcctttctttcctttctttcctttctttcctttctttcctttctttcctttctttcctttctttcctttctttctttctttctttctttctttctttctttctttctttctttctttctttcaccagtactaatttggttttaccctaggtccctaggttatctagtctcaggttgtttgttggtcaccctagcattatcaggtatggattctatcttatgcactgagctttatgtcaactagatattggttggttacccccacaatctgtgtgaccattggtctagcagatcttacagacagcacacgattgtacataaaggttttgtggttggcttagtgtttatgtttctcttttggtagcttgcagagtaccttctagtactagatgctagcacatagaggcaaagatcctgtgtaggcatcagctcaaattctccatgtttaatgagttgtgaaggtggtgttgtcagcaatggacccttgctgtcagtttgtggacagcctatagtcttggcaacagtctgggttgtttggagtttcccataggaactctttgaccaacaactcaattttagaagtaacccaaacctggaactggaaactttagtgacaagagatacagagccatttgggaccatctcctccattacttggtgatttcatttagattgctttcatatatgtatatattgtaggagatttctactatatttgtttgccatattacccctcaaatgacccttaattttacctgtctctccccatacttcatcccactaccccttctttccttcctattcccacttgattgtcccagtgcaaacccctcacctatccatagatagtggattctatttcctattctatttctctttcctagtgagatctatctgttccctctagtcctttactctgtacctgtggttctgtggagtgtcacatgattatcattgacttaacagcaaatagccacttataagtgagtacttaccatgcatgtctttctggattacctcactcagatgatctatctatctatctttccttctctctttctctctcttttcttttcttttcttttcttttcttttcttttcgtttcgtttcgtttcgtttcgtttcgtttttcgagacagggtttctctgtatagccctggctgttctggaactcactttgtagaccaggctggccttgaactcagaaatccgcctgcctctgcctcccaagtgctcggattaaaggtgtgagccaccatgcccggccagatgatgttttctagttccatcaatttgcctgcaaatttcatggtgtcagtttttaaaaaacagctgagtagtacttccatgtgtaaatgtatcatattttctttatccattcttttattgagggatatctaggtttccaatttctggcaattatgagtagagcagcaatgaacatgtttgaacaagtgtgtctgtggtatcatgaagcattcattgggtatttgcccaagagtagtgtagctagctcttgaggtagttgaattgctatcttattgaggaactgccacacttatttccataatggatgtatgagtttgcactcacgccaccaatatagtaatgttccacttactagatagacatcctcacccctttttctgtcacttgttttgttgattttagccattttgacatatgtaacatgaatcttaaagtagttttaattttctttttttgattctttttattagatatattctttatttacatttcaaatgctataggtggaacaacaatatgaactaaccagtacccctagagctcttgtctctagctgcatatgtagcagaagatggcctagtcggccatcactggaaagagaggccccttggtattgcaaagttttaatttcatttccctgatgactaaggatgttgaaaatttctttaagagtttcttagccatttgagtgtcctctgttgagaattatcagtttagatctgttcccatttttaaattgactttttgtttcttgatacctagtttcatgagttatttatatgatttggatactatgtatcaaatatggagttgataaatcttttcctggtctataggctgttgctttgaatggtggtgtcttttgccttgtagaagcttctcagtttcaagagtctccatttattaagtgttgatcttagtgcttgtgctaacagtgttctgtgccaatgagttcaaggctgtacctgctagtccggcatggctgcataagggaaagtgtgacacagctcttgccctggagcattgccaggctgttgatcccatgatctcccacactgatggttgctgttgccccgaagttgatcagctgtcttactactctactttcaatatttctttcaggggaatctactttcctcccattactcagagctaatcacaccatagtaattgaaacagatgcactttttaggaatgaggaatagagatggtcatgaggctgtggaggatgaagaacaggccctctacttggcctttagggctatgggaaaggatctagacaacataaccacaagggccataaaaacctacatggatggtcctttgtagaaatagttcattgccagacttggccttgaatgtggaaacatgaggagatacatatatcctccggtccaatgactgctgcactaagtagccagggtgaacttggggacatcaagaatagagagttaaagtggtgtcaagaagaaaaggtatggatagaaaaagtaggaaattatataagatgtaggagtaaatagtatcagaggaagagtgcatgaggctatggaattgctaggataaggaaatgaagattagagaattaacagatgatgtagaagcatataaaaagtcagtactctgtttttctagctgagtgaagaattggggatagtaatgcctggaaagatattagagagagctgttttaccattttacttacataaattcaaaactttgtaaggaatcattttaactttagtagtctatcatttttctgctctgaaaatagttactgaacactgctgtctgctgtactaggaaaccgtgggagctgtgcccagctacccatgaagaacaggctgtgaaaacctataaggaaatgtgctcttgctttgtatttagttctgctctgaggaaacagaggttgggactattgatccaggactcatagagtttatgtaaacctaatctaagaattttttgataattattaacaacgattaaagccttgatcatgtagctctggtaaataagagtgggttcaggctctctctggttattaagctgaagaacatttaagctgaagaataatgaatactgagaatcatcagggaatagagagagtacctgaactaggagcttccatctactactgacttcaagttattattgaatcagcactgttcccatttccccctttctcaggaccctcctcacattgaggcaagacataggcatatacctctgtgccagtgagttcaaggctataccgctctttctcttctgtcaggttcactatatctggttttatgttgaggactgtggtacatttggaattgatttttgtgaaaagttgataaaaagttgatttggattcttctacatgcagacatctagttagaccagcaccgttgttgaagatgttgaagtgtatgtgtctggcctctgtcaaaaatatagtgtccataggtgtgtggacttatgtctagttcttcacttctattctattaatcagtgtgtctatgagccagtatcatcttattttcattattatagctttagagtacagcttgaagttggggatggtgacacctctagcagttcatttatttttcaggattgcttgagctatcccagggtgtttttgttgttgttgtttgtttctacatgaagtttaaaattgtccttttaatatctgaagaattgctttggaattttgatggagattgcattgaatctgtagattgcttttggcaggatgttcggttttactgtgctgatcctactgatccatgagtgtgggaaatctttccttcttcaaagacttgattttgtttttaaaaatcatacacacctttcacttgcttgggaagaaataccccaaggtattttactaggtattttatatttgaggctgttgtgaaacacgttgcttccctgatttcttgctcagactgtcatttgcatatagggggcactgatttttttgagttactcttgtattcagctactttgctgaatgtgtttatcaggtgtaggagttctctggtggaatttttagggtcagttacatatactatcatatcatctgcaaataaaggtactttgactcttcctttccaatttgtatccccttgatctccttacattattttattgttctatctaagacttcaagtaacatattaaataggtaaggaaagagtggacaaccttgtcttgttctgatttcagtggaattgatttgagtttctcttcatttaagttgatgttgtctatgggcttgttgtaaacggcttttattatgtacaggcatactaaaatatattttgtatgtcctttgttaattagcctttttattgttttatttgtatgccatttgtatccctaatctcttatgaaggagtgatggttttgtaaaaggccttttctgcatataatgagatgatcatttcttttttttttctttttctttttgtctttcagtttgtttatatggtggagttcatttattcctttatgaatgttgaatcatccctgcatctttgggatgaagcctacttgattaaggtggatgatcttttttgatttgtttgtgggttccagtttgcaagcatttttgcatgttcatacatgaaattggtctgtaattctctttgttgtgtctttatgcggttttgttatcagggtaacttgtaaaatgaattgggcaatgttccttctgtttctgttttatagaataaattgaggtatatgggcattagcttttctttgaaagtgtggtagaattctttacaaacatctggccctgggctatttatttattttggctgggagactttaatgactacttctatttcactagtggatatataggcctgttcaaattgcttatgtgatataaatttaactctggttagtggtgtatatcaagaaaattatttatttttagattgtccaatttgatagagtacaggtttttaaagtgtgtccttacgattttctggatttccttggtctctcttgttatgcacccccccccaatttgtttctaatttcattagtctcactcaaccttttaatttgtcaatcttactgattttctcaaagaatcaactctgtttccctgatttttttgtattgctcttgtttgtttctattttattgatttttagccctgaatttgatgatttcatgccatctactccttttgagtatggttactctttctgttttagagtttttaagtgttctaagttgctagtatgagatctctccattttttattgatatatatatatatatatatatatatatatatatatatatttatttatttttgtccttggccccctcttggtcagccatcccacagttcctcattgcattcttctaccatctccaagaggatgtccccacccaccaggcctctcaactccttggggcctcatgtatctcaagggttaagtgtatcttctcccactgaggccagaccaggcagtcttctgtatatgtgtccagggcctcagaccagctcacggttactgcctggttggtggctcagtacctgggagatctcaggggtccaggttagttgagattgctggtcttcctttggggtcgctctcctcctcagctccttccagcctttccattggttggatgtaagtgttttgtctatcttagtcagctgcttgttgttgggtctctgaggacagctatgctatgctaggctcctgtgtgtaaacacaacatagcatcagtgatagtgtcaggccttggggcctccccctgagctggatctcaatttaggctagtcagtggacctcctttctctcagtctcttttccatttttgtccctgcaggatgttgtttccctattttctttctcaacctgtttatcctttgtatagaggaaggcttttgatttgagttaattttatatccagccactttgctgaagttgtttatcagctgtagaagttccctggtagaagttttggggttgattattgtcttagtcagggtttctattcctgcacaaacatcatgaccaagaagcagttggggaggaaagggtttattcagcttacacttccatactgctgtttatcaccaaggaagtcaggactggaactcaaggaggtcagagagcgggagctgatgcagaagccatggagggatgttctttactggcttgcttcccctggcttgcttcacctgctctcttatagaaccaagactaccagcccagggatggtcccacccacaaggggcctttcccccttgatcactaattgagaaaattcttacagctggatctcatggaggcatttccccaactgaagttcctttctctgtgataactccagctgtgtcaagttgacacaaaactagccagtacaattatgtatattatcatcaacaaatagtgatgccttgacttcttctttgctaatttgtatccccttgatctcttagagtaggcagccttgtcttaaccctgatgttagtgagatcgcttcaaatatttctccatttaatttgatattggctgctggcttgctgtatattgcttttactgtgtttaggtatgggccttgagttcctgatctttctaatactttttttttggcggggggcttttttggggaacttttaaaaaattggatatttactttatttgcatttcaaatgttctcccctttcccccttcctcccagaaacaccctattacatcctccctcccccttcttctatgagggtgttcctccatccacccacacactcctacttccccactctagattcccctacactgtagcatctatctagtcttcataggaccaaggatctcttctcctattgatgcctgacaaggccatcctctgttacatatgcagatggagccatgtgtactccttggttggtggcttagtccctgggagctctgggggatctggttggttgatattgttgttctttctatggggttgcaaaccccttcaactccttcagtcctttctctaactcctcttttggggacaaaatgctcagtgcaatggttggctgtgaacatcagaatctgtaaggctctggcagggcctctcaggagacagctatatcaggttccttttggcaagctattcttagcatccacaatagtgtcagaatttggtgactgtatctgggttgaatccccaggtgggccagtctctggatggcctttccttcagtctctgctctacactttgtctccatatttgctcccgtgagtccctttctaagaaggactgaaacacccacactttggtcttccatcttcttgagcttcatgtggtttgtgaattgtatcttgggtcttcctagcttttgggctaatatccacttatcagtgagtgcataccatgtgtgttcttttgtggttgaattacctcacccaggatattttctaggtccaactatttgcctaagaatttcataaattcattgtttttaatagctgagtagtactccattgtgcaaatgtaccatattttcggtatccattcttctgttgaaggacatctgggttctttccagctcctgactattataaataaggttgctatgaacatagtggagcatgtgtccttattacaagttggagcatcttctgggtatatgcccaggagtggtatagctgggtcctcaggtagtactatgtccaattttctgagaaatcgccagactgatttccagagtggttgtacaagcttgcaatcccaccagcaatggaggagtgttcctctttctctatatcctcaccagcatctgctgtcacctgaatttttgatcttagccattctgactagtatgaggtggaatctcagggttgatttgatttgcatttccctgatgactaaggatgttgaacatttctttaggtgcttctcaggcatttggtattcctcagttgaaaattctttgtttagctctgtaccccatttttaatagggttatttggttctctggagtcttaacttcttgagttctttgtatatattggatattagccccctatcagatgtaggattggtaaagatcttttctcagtctgttggttgtcgttttgtcctaataagagtgtcctttgccttaccgaaactttgcaattttatgaggttccatttgttgattctcgatcttagcgcataagccattgctgttcttctgttcaggaacttttcccttgtgtccgtgtgtttgagactgtcctcaccttctcttctattcgtttcagtgtttctggttttatgtggaggtccatagagaaaccagaaggctcctgtcccaggttgctccttggttcctgtgtcctgtgatctgaggtttcaagggaggtccctctgagcagtagtggtggttttacctgcacttacaggcttgttggccctcctgggatgctacctctctcccagtgctatttgggtatggagccctgttgcagaggatcagtttacctactctttttttttcttttttaaagatttattatttattatatgtaagtacactgtagctgtcttcagacactccagaagagggagtcagatctcgttacagatggttgtgaggcaccatgtggttgctgggatttgaactccggaccttcggaagagcagtcgggtgctcttacccactgagccatctcaccagccccagtttacctactcttgacttaactttggtgaatggtatctgctagaaaagcatccattttatctagattttctagttttatagtatataggcttttgtattaggatctgatgtttctgtgaatttcctcagtttcttttgttatgtctcccttttcatttctgattttattaatttgaatactgtctctgtgccccttagtttggctaggggtttatatatcttgttgattttcacaaagaaccagcttttggttttgttgattctttgtataattctctttgtatttgtttgattttggccctgagtttgactatttctactgtctactcctcttgggtgtgtttgcttctttttgttccagggctttcaggtgtgctgctaagttgttagtgtaggatttctccaatttctttatgagggcacttagtgctatgagttttcctcttaacactgctttcattgtatcccataaatttgggtattctgtttcataatattcattgaataccaggatgtctttaatttctttctttatttctttcctgaccaagttatcattgaaaagagaattgtttagtttccatgggtatgtgggcattctgtttttagtttttttgttttttgttttttgtttttttgaattgaagtctagcctttagtccatggtgatctgatatgatgcatgggattatttcagtcttcttgtatctgttgaggcttgatttgtgactgtttatatggtcaatttcggagaaggtaccatgagatgcagagaggaaggtatatttgatgaaatattctgtatatatctgtttagtccatttggttcatagcctcaattagtttctctgtgtctctgtttagtttctgtttcaatgacctgttacttggtaagagtggagtattgaagtctcctagtattattgtgtgtttcaatgtatgttttgagctttaataaagtttgttttatgaatgttggtgcccttccatttggggcatagatgtttagaattgagactttttcttggtagatttttccttttgtgaatatgaagtgtccttccccatctttttttcataacttttagttgaaagtctattttattgactattagagtagaattccagcttgtgtctcgggactatttgcctggaagactttttcccagccttttactctgcagtactgtctgttattgtcattgaggtgtgttgcttatatgcagcaaaatgcctgatcctggttgtatatctagtctgtaggtcttcttattgggcagatgatattgatagatattaaagacaaatgattcttagtttctgttatgtttgatgtttcaagtggtggcattatgtatatgtgattctgttcttttggttttcttgtaagatgattaatttcttgttttttctttggtgtagataccctccttgtgttggagttttccttctagaatcctttgtagggctagtttggtagatattgtttaggtttggttttgtcctggaatattttggtttctccatcgatgatgatctagagtttttcagagtatagtagcctaggctgacatttgtgttttcttagggcctgcatggcatctgcccaggctcttctggatttttgggtctctgttgagaagtctggtataattctgataggtctgcatttgtatgttatttggctttttttttccttctaagacagtgctgttaaactctgatattagtagagtctgactttttttgaaaagtgaattttttggggggaggggggatgttctcagttggcacttacagtatcaagtagatgaaaccctgaaaggctagtttggataatgggaagctggtatttagacagagactagtcagggctggctcctgggatgattcgttcctcagccattcttacagttacttttcacctggaatgtatctgtgtggcaacagtgctttgtcaggagaacatacaggcacctagcaagttaacactgcatactctaaaaatgctgcagtttcccctataagattccattgtgttcttttcacttctgcctactgacagacaccacttctagcttcaatttgaacagataaaaagttcaaaacatttttaggtcataaaattgttaatcaattatcaagcattcaggtacatttaactgctgaggattttccgtgagtgattgaagtctgttttactccttcagcttctagttttcagttgacaagtttgccatatttgaaagaaggcttctgttcttttaatgagttacagcctgagggctggggtgtagctcagtagtagcatgcatacttcacatgtgtgagggccttggttctattgcccagcatcatcacttcctcaaaaaatagtattgtccagaagaaagggcttgctcattaaaagcaacctcttgtgaagctgactgagatatattggaatgcaaagcatggctagtatctggctgagcaattaaaaaactttggagcaggttagtgcccatgaaaaggtttatgaaggttgtcagaaaaaaacaaaaacaaaaacagaaccttcaggtaacctcccagcaggacatcagctaatgctataaatggaactaattttttccctatgctttgctttaagaacatacattccaagactgggatatagtgcagtggccttccttgtcagtcctggtgtggctggcctagaatgtgcttattggctgtcttagcatgtgcttacttctggagttgaatctagtccctgcagttgattctcagcactacagcaaaatgaatgaatctatcaatgaaaaagactcatctattcttctttgtagtttgattgaatagtaggtacaatgtattgctttctgattcccagtcacctatgggaagtttctgtttgggtactgcctagctccttgccaattctgtgtagcacgtgaggcttcattcattcttattgccatcattttgaaggcttgccttaagatgggtgtgcagctttttctcttgttatgtatcatcctcctcatcacctgccacattttatatctgtgaagacaatcccatgaattccagttttaagggtggttgaatttgatccacagtaaagacaacagttgtagttctaaacccttaaaagtcaaaggaggtctttatagcactagtgaaagcttcctacatggaaggcaagtagtctacactgagcctcatccctgcacaattgagtctagttgtttcacaatatataatatactgttgaaattctggaagccagacaccctaaatcaaggatgttagcaggccacaccctttttggatgctccagccaaggtcctttctgcctctttcagcttcttgtagccctaggcatcctttagtttgtggctgttttactctaatctttacctccgtcatgcatctaccatgcatttatgtctgagtttacctcttatagcaatttaagatgagttcatcctaactaattacatctgtaatgatgtgtctaaataaggccaccatcacatgttctgggggagagactttgatgtacttccatcccgttctctttttcttctacagcatacctctttcagtgacatataaacttacatggcagaaataatacattttaatttttcttgagaaaatgcttgcaacatgaacatagatgtcaatgagtttttatagaatggaatctctgtaatcacctatatcaagtaatagaagacttggtctcttaaccctttgccctatcctacctacacctttcaaggaagccctgttggaatattctgtctcaatgttcttctagtacggctggggtattttagattttaatctgatactttgctgacatgtaagcacagggatgtgttggttcctctttatgccttgctctgcaaacctgtgcctatcataaattaaactgagtcttaattcatttacaggctggctgataaataactcaggctttaactaattaggaggaagtaggatgtaagttaggccatgtacactaacattcaatgataagggtgtcgtgctgtgaaccagaatcagcactttgactttgtaacctgcatggcttcctgggaactctattttttgttaagcatattgttacagaacaaattgcattttgagtatgaataattagattgaagctagaaattctgtcatatgttctttttttatcaaatgaatctacagtaaggccatttatattctcaatgtgaaaaggtcactctatctgtcattgtcaccttggattctgatagacctttgcttatgcttctgttgtggctgtgtgggtggcaggagaggactgcagctcttagccagccccatctccatgtcacacagtttgagacttgagtttagatgggaaagtctctggcctactggtaggagttttattcttctgcattttcttctgtttaaaagccacaaattcttttctgttcttgtgaaagtcccatacacatggtaactatgacagtaagtcacttatctttatgatccttattttattttcctgtagaattgagagaaaaattcttgcccggctatcatctttcagggtgtgtgagtgtgtgttgttttgtttctgaaacagttgtcttactgtgtagcccatgctggccttgaatttataatcttcttgcctcagcctcctgagtagcaccgactactgtgctgatatgagctaacacactgggctgaaaaaaaatctgtagtctataatgaaaaaaatctgtattcctttttgaagatggacaaattcctcaaatgtttccatattaactttagcagatgaatgtattgctttatgtaataatttgtccctgaaagggctgaatgagaacagaacaggacacaaaataagtcagattacaaaagaaaatgaaaatgaaccagaaatggctttgaggcttcagttttgttatgtcaagaattttaagcccagctagaacaaatgatggctccattcttaggtgtgtgttggggggggcactcacagagcccagaaagagaggatattgggtcctcaggagctgaagttacaggtaattgtgagccacttgcagtaggtactgggaatcaaactcagggcttctgcaagatcaataagcactgttaactgcccagccatctctctagccccagttttccttttatatccactcgaactgtggatgaacttagaaggaataaacatatcattaaggaattaagattttcccgtaggagagttgactgctgagcaagtcagcatagggtgtctcatttttgtttagtcttgtcttggttagtgtggcataaattttaagcaccttgctgtgttttaagtgacagaagagttacaacttagataataggatatttttgtttgattgtagtaccatttctgcctggataaataatactaatgagatgagaactatgttggttttcttgaaacagacagacaaacaatatcaaaaattgccttcatgtatttacattgctctttttaaaaaaatttatttatttatttatttatttatttatttatttattatatgtaagtacactgtagctgtcttcaaacactccagaagagggggtcagatctcgttacggatggttgtgagccaccatgtggttgctgggatttgaactccggaccttcggaggagcagtcgggtgctcttacccactgagccatctcaccagctacattgctcttaaagaaattgaattccatacacattaatccttatatatttttttaagttcattgactccatgttctactagatgtaaccaccataagtcacaaaaaatttagagaaaaaaaattgtgttaaacatatagacttttccttcttgttattagtccttaaatatcatagtgtaacaactatgtacatggcacttgcattgtattggatattattgatgatccagagatgggttaaagtatatgataggccatgaatagattgtatgtgtgcactgttccatagtatataagggacatgataatcctcagaccttggtatccacaggggatactagaaacactaccccctccatcagataacaaagacaactgtacatttctttgttatcaggaaattcagacattagacaaaaatagaaatgtaataatgccattataggaggtagatgtagggtaaatttaatctattcttactcttattatttatttatttattggtggtgctgaggagaccctacagcctcatccatgtttagcacacttaacccaatatgtcttactctgaaaccagcaagggttttctttgcttttttttcctcagcaacaataataaattttactatttcatagttctaattataaaagtaagcaatgtttttaaccacataaaactattctcataggtgttgtgttttgaaaggaaaaagaaaagccaaaaatttaacccaggctcagtgattcatgccttaaatctcagctcgtaggtggattcaagagaatcagaagttcaaagacaacctcagctacatagtgagttccaggtcgacttggactgattagacccccatctccaataaataaaaataaaataaacaagtatataagctgggcatgttgcacgttttttttaattttatttatttattatatgtaagtacactgtagctgtcttcagacactccagaagagggagtcagatcttgttacagatggttgtgagccaccatgtggttgctgggatttgaactccggaccttcggaagagcagtcgggtgctcttacccactgagccatctcaccagccccgcacatttttaatatcagtatttcagaggcaaaggtgagaggattgggagtttgaggcctgcctgggctacagagtggtagtgtgtcccccaacaaacaaacaaacaaacaatatatcaataagtaaatagagctagaaaccatctgaaacatcagacttttctaggaagagttattctaactacctcattttaggctctttaggtagatagctgggatcctggaccagaaaattttctggagtctcagagtcctgaagttttgtctatacccatagccataccacacctcggcctatagccctcaagttttccttgttgccaagtagcttctgcatccacaggtatcctgtcttagttcaaggacagagcaaagagatggccccagatatctctgcccttatattgctctgcagcttccagcagttttcttctcttctctctgcatagtgcacattcttccctctgcagaggattcagacactggaaagcatggggctgggaattatcacagagagttcagtattactgatgagggagggagagggacgacttccaaaagacacaatcaaggatcacagggaaggaacttggacatgagtcaagctacagggaaaggtcaactatggagagtcctgaacctttgaatggtaaatccaggacaaagaaaacaaggaaagtgaaatttgcctttcaaataacaaaccatttattagggacttgaacaccttgaggtactgggtatgtgcatggatgattaaaaaccccatgggtatttatatctgagaataagttttgaattaaatgagccagccatggacatgaatttatggttctttaatattttttaaatcctgtattactgggatttaaaaataacacaaggcttctagcagtgaacagtaaccctagctatcaaccccttttaaaatagcgcctcccaatgtactctgtactgctctcaaattcatgatctttccttagcctcccaagtacagaatggcagatgtctatcatcatacccagcaacataattctatttttgcagggtgagatggaatagaggaatcaattcttttgaaaagcaatgtaaacatttgaaacagtctaccctgtaaaatcaagattgatagctggagacacctgctcttccctaaagttatttctctgtggccctggatcgtgtctgtggcttctgaacataggatcatgccattgctccgaggttgttttgtacttccagcgctgccccccccctcctgtgttcaccctttcaaccctataaacacttgcatgtcaaagacagagcttttttttaaaaatgtttgcttttgaaaaggatcaccaaaatgttttcccaataaaagatagtctttgtgaatagcaagagcatcatattgtgttcaagagaaaggaagactgggggtggtggtgcctgagttcacttcaagggaagtcactgtagctcagttccccctccctctttccttcttacgtgcacagccacagtgcattcaattgtttaagagcaatacatcctttgaactagccctaggatgggaatgcccattaaaaataaacagctatgtgtcctgagcatctggaactctatgttctaacactcagcagttccgtttcctgtctcttgattgtgtatctgttcttccagattgcttttgtgctttgaaaactgcagatttcagtagtcctagtaatctctatggaagcaagcatttaaatgacctgactcctctgtacccagatatctgtgagaactgcttagtaacacataagcattgttgctagatgggtggaaagcctgtttggaaagctaaatatttggaaaccttcttgcacagccaccgtggtatggtgtgtttggtagtggtggtggtggtgggtgtctatcctaccccttccccccctcgcattgttataagatgaatagtagggtatagtcaggaactttctttatctttgctgagtcttttcctctttttcatcctttccagaaatgatgtctgttgtgtggtcaggacatctgtacaagaaaggagaaagaaatatatattaaatttggtctttgtccttagaaaaatgctagttgtattagagctcttttgtcactgtaacagaccatctgataaacataactcagtggagtaaatacttattctggctcctagtttcagaggttacagtagatggtcatctggctcctcggttgcttctgtatctctggtaaggctgaacattatggcgaaagggtgtggtggaacagaactattcatctcacaatagccaggaagcagagaatggggcataggatcagggacatgatatatcccatctaggtcataacctactttctccaactacacctcacttcccagtaatgataatcttatgaactcactaatggcttattttatgattaggtcagagccctcacaacctagttacttctcaattgctccaccaggaacaaccaggcctccagtacataaggtctggagttttctaggctgaatgtgaatgggccagagtaatgtacatttcagtaatgagtgtgaccgcaagacgaatgatgaatagaatatcaaagctttatttgcatggaagtggtagaacaatgttaaatatgatggcctacctggcctctccaagctcttaggcattctgctacagaccagaaggaggctgatttgtgtgacgcaggttgctccctgcttcctgcaatggtacataggaagtgacttggctttggttttctgttcaacatgagccattctagatatctccaatatatcatttaacatagtggttctccactgggagggatggtgtctctcaggaggcatgtgacaatgtctggagagatgatagcagtagctagcaggtgaaagttgagaagcatagtacatccattctgcccaaagcaaagaatgacctggcatcaaatgttatcagtgctgctgagaagtttgctttaggtaagggattctgtttggctatccaatttttttttcaccccgaatttttactaaccagatatttgagtaaaatagccactgttgagttcttacactcaatattggtgtaagcattcttctgagcgtctttgataaatataatggtatgattcggatcttaaaggccccctgatgtccctgtatttaaagttgctgatgtgtggtactgttaggagatgttaaaacctctaggaagtggtacctagtaattagaagatgggccattgagaacacaccctttaaggaaatgttgataccccaggctctgcctcattcatgtcttgactgctttgaggtgaacagatgtgttttatttaccaggtgctcctgctgcccggtttactgctttgtcagcagcctttcaagtgattctcctaggcatttgtcatagttttgaaaagctgattatcacacatctatatacatagctccagttatctgctattcacttgtgcattatgcatcaggcctttgagctgcatatgtaaaaatggttgcatgtgcttttgttcctgtagatatcatgatcctagtacgattctgaagttgggcgtttccccacgttgctgtcggtgcacaactgaggacctgaggacaggaacctttttctttcttagtcagggagcagaagcaccaagggttctgtggcaagggtattttaaaagcattagaaacttctgagagagggagaagggtcacaggcaaatagagggccttatactggttatcccttaactaagttgaactgctgatggttagcacagcccttgcttgtcaaggtgaagaagatgtagagcagcggagtgtgaaaagaggttggagcccccttctgggcccttctgcgtctatcatctcgtgtgactgtgacatgacctcttccatctgttgcaccacctctgccttggcagcttcctcttttgacctgatgaatagagatccttgaaaaccgttttcctgacccatgcacagtctcttccttcagagggccagctggtgagatgtgttttctgttacccacttgattgtaagtacaggatatttagaccatgatattttaaagagagatttgtattagcctaacaagttacctacccccctccccctctatcgtctttctatatagggcttcagacttgctatgtagtttgtatctcagctggcctctaactctccatcctcctgcctcaaacattttgagtgttgggattacacgtgatttctgacatatacaacaaaatcagtggctatgtgtcatatgtgcatagaaggttctttagttttcttacatcactaagtatggaactcaggtccttgtgagggctaaataagtgatccaccatttagccatccccagccccagccccagctcccagctccagctattaggtagcctttaattcacaggggaactgtgacttggtttctacataattcacttaggctaaaattttaaaagtcaccccacttagaaattcggtaatgttataccagctgtatagaaaacttattgtttagacaatacaaatgtacaggataagaaacctttctaaataggaagcattctacctaactttggagaggtctccctttccactaagcttctgatgttcttatgttattaccaggatctgtagaagttgccactgaacctgagagtgggattgtttgtacttcatttcagtcccccccacccccttttctttttcttcttcctccctcttcagaccactctttttggttattgagataaggtctcatatagcccaagatgacctgaaactcacaagctgaggattattttgaactgcttgccattctccttcctccatctcccaagtgttgggttgcaggcatactctacaaagcccagctcccagtcccaatccaccataaatagattataataataatagtaatttgtgaataaatttgtataatacttggagtttgtagcatgtttcaaacatctcagttatatcctatagttgacctagggtgttttcatcttttggaggcagggtcttgtatcccatacttatataggatgaccttgaactgattcttctgccttcatctcctaaatgcttggattttacaggcacttgccaccacaccagactttaatctcattctgacatgaacagagtgtaacaacagtgctctgtgagtatacttagtattatgagtttgcaacatatctccatttttatcttaccttttatcttcctgcttgtctttcctggttgtactgagtgttttctttttgtccattctcctttctcttccttctctctcttttcctttccccttttcttctcatttcccaattcccttaactttcttctccttttctgtcctttcttctcccttttacttatttgaggtacgatctgtgtagctcaagttagtcttgaatagaataatatagttgagggtgaccttggactctggatccttttgcctcttacctctccagttctggggttgtgggtatttgccactatgccttgttgtcctggtagttttttttttttttttttttgcttgcttttattgttttttttttttattaatatttggtctcactgaagcccagactggcttggaagcccagactggcttggagctcccagttctccttaataagcctcccaagtagctgagattacagcagtgcatcggcaaacccagtttaagataatcaggttttggaaaaccaaagtgagattaaagaaaaatgagtgacttttttttaccaaatcctgtacaaacaagtcttaagtcccatttcctgcctcaatgttttgtaaaccctctttgacacaaacctttttctaccttgccacctggttttctcttcctctgtgccatcagggctgtgtatctggtaatgcatttacctcagaacttttatcaattaggtttgggtaacaaaccatacagaaattagaataaagattgcttagtacaaatcagaatttggtgaattggctgtgttatattctgtcttgtctctttataaaaacaaattagagcagttgccatagaaaccagaggtcttgcaaagcaagactgattttttttttttttttggtttttcaagacaaggtttctctgtgtagctctggctgtcctgggactcactcggtagaccaggctggccttgaactcagaaatccgcctgcctcagcaagactgatttactctatgcctgtggctcttgatttaaaaaaaaaaaaattctcctgctcatgcacctatagtcacagtttctcaggatgctgaggcaagagattgcttgaatgtggtagtttggtgctagttttgacactataatgtggactcatcacttaaatactgtatagaatcattaactagcattaggctattgtttttgtttttctttcttttttttttcttttttggacctggcattaagaaggcagaatctccagggtatgtacaaaaagagaaatctgtcttcccttcctcagcaccccaaaagcttggtggtggtggtggtagagaaagaggggggtggaatgagaatgagactgtgtgtatgtttgacgcctgactgtcttctctagatagggaagacagtcagggccacaggcccagaggcaatcagtaaaatgtcgtcctgtgctgttcttgaagctcactaggaaactggctaggatgccctgaaactcactagaaagccatttgaaagttgttgctaaaactcactgggaaactgctgaaggggtgctaatgaaaccaagaaagacacttttgaaactattgtcactaggtgtaccacaggactgccatgtcccacagggctggcagagaggaaagcacgtgagataaggaagggaaaccagtcttctcttggtgtccctccagtgccctctgctgactgtactgaaaaggtgctagttgtgactttagagatgttcccggtgtagggtattgtttccgagcttgtgttttactgtcattgagatgtgagtcttggctttggagagtcaaatcagggtggttctaggttcttcctttttctgacactgcttaggccctatagataagcttttttcccccttttgttttaggtttaaagttgtgagttaggacattggattgctaactggtggtgctttgcagtactgaaaatatgctgttttaaaatcctttgtttttatagaaatagaactttctctagaaattttttctgagtttattttttctgtccctgggtgtcttttaggaagactgtatctggcactatttagagtacagtcttgtcctgatagagatttgacattgtcctgatagagatttgccaggcttttacctcatctggggaagaggtcacccatcatcatgaaaactgtgagtccttgctgtagaatgtaaatggctctctggttcccagtctatcctacctggctgctgagcctgcctctctgtcttgcaaaactttgaaccaatgcctggttctcacagtcaggagagcagtcagctcctttttgttcactaatatctatctgctcagcctctggatctcttgggagactgaggccccataggtacttctgttttccattttcgtgtctacatgaccctgcccttgcatcagaacttgtcaccaattcattaccttcctttaaaacatttcatttacctgtctttgtcaccccatccaggccacatttgcctctctgtgtcttagggccaagtataacctgagcctcatttcagggatgaatggaaggattattagacctctatattatttttccctgaagtcccaccttagtggcctttcccaacctgttaaataccccacccccggcctgagtcaagcttcctttctgaaggaactgagagcaaacagaatgagtaatggatttaagaagatggggaggttattatcctcctgtgtaacaaaaggcatggcctgctcatgcactttaggctattcattggaagggaaaatattctggaaataattacagctgataacctgcaggtgtgactcacattttgacgtgtgatcttagactcataaaacagcaaagttgctcttccctatttcattctgatgactggacatgtgggtatattccacttctccaagctcagaatttgacttcaacgtgaatggtgagctaggtcttcttccttctatcaccagagtcctgcttaccttagttgtctttacactataaaaataacttctgtcaagagcactgaaaaggcttcagggtgggtattcatcacggctgcagtggtccccaaacttgtaattctcctacttcagcctcacgccccccccccccccccgcaatgccaggatttcaggtgcctaccaccatgtctggcttttgctgttctattctttttgttgaagacatttatttttattttcactacaaggttaatatcctgaagtagttgttttcatcataagtttacacttgacttctctgccctcccttacccacctccactacctgaagaacagtgcccacgttctgcttcaaggtcaagttctcagtcttctcaccttctgccaggatcctcccacactcctgtgtattctttacactgtttcccctgactcatccctctggcatgcctccatttcctgcctgcatgtttcttcatgtcaagacctccatggaatgtcctccctaatgctgctgtattcctttcaagccctacacattttgtttgtggagcttttacatcagcactttgaacctgaagtgaatatggcccttcatatttccattataccaaattacaatgtttcatccacagtgcacctggttacctatagaatttatattcttttgtcttcgcaaggcttcattttttaattacagtaaaaaatctatagttttgcattggtagttaaatacacactctggcctttccttacaaacacaggactacagtataaaaagtatcatgtggcaattctgttttctatttttatttgtttgcttgtagctcgggctggccacagactcataatcttttctcttaaactcttgagttctgggatcacagatgtgtaccacccatgcctgagtcactctttttttaaatgttttatttatttttattggatatttaatttatttacatttcaaatgttatctcctttcctgtttttttccttctaaaaaccactatcccatcctccctctccctgcttctatgagggtgctcccccacccaaccacccattcccgcatccctgccatgacattcctctacactgtggcatcgagccttcccaggaccaagaacctctcctcccattgatgtctgacaaggccatcctctgctgcatatgtggctggagccatggggtccctccatgtaatctttggttgtggtttagttcctgggagctctgggtttatgccagagcctgacaaatacagaggtggttgcttatagccaaccattggactggctcattattccttgaaaattggtgccaaatttaagttggttgtctagtacaagcatgaataattaagtccaacttgagatagcatatgggtttagtatagaatggaaattcataaaacattttcttttaaaaaattatatatcattttcttatactggtctggaaaaagatgtcattctgttttgtacaaagtgagtagcagtattcacatagcagggccaagcaactgaacctgatttatgaggcatgatgaaatactgtgtgttagatgttgtcaaggatcatttcactgctacaaaacaaagcagaaaatacacaacaggatggactcctggtcctttgaggccaaggaatttatccaaatttggtggagggaatggttgatttgtctgttgagcacatacatgtaggactatttcagctaccaatagaaaaccttagaaggggttttgtatatcattaaatatagcacataagcttgattcaggattgattccagccttctagaaccagatcctttagggccagggagggaattgttttttttttttaatcactatgcagggcacatttatctttcacatgaacgaccactcttccagttacccaactgaagtacaacatagtgaatgaaaaatggggacatgatggctccaaggtatggtggagaaggtttattgtctaaagaactgccagaggaatatggaagagtccagactgaacattgccagcagactaaacaggactatgagaggagagaggaagagaagagaagagagaggaggaggccaagagaggatttcctctcttggacccaagaaagtctgtgggaagcaagaggattcatagctgaaatggttaggctttataggaaaagagaaactggggacaagaaagtgaaagctcagggcttggggaggtttagagtagtgggcagggtttgccagccagggcaactttgtaactggtgcttgtaaagttgagagattctgggataatccagtggccagtatccactttgatatgttaaatagacagctcagttagccatttgttcaaggtttctttgagacctaacgcataagacaggttccagggacaaaaataggctctagttgctcactgggtattccctatcatggttcttttgtcgtcttcccaagtgggtccttagtaaacaatgcgctaagacaaacttgactctcctggataaaaggagcagcatttcctgggtttggactatggacttgtaccctacaggtggtattctgactagattctgtgaagggttagaagacaaaatactgaaatgaaaatgggagccacataactccatttgaaactaccaattaagatcctgaagatataatcagagtgacaggtgttggagacgtgagatacagaagacctgcacgagaagggaacattttttttttttttggagtagtgcacttgcttgcctttatttcttggccttgccctaaggagccacaattttcacagcttcacatttgggtttcttcatccccaaggaattgcatgagcttgatgggcttaagctattgtctaagtttccttctttaaagagatctcccagatcaaagaggggagacgttgtaaggttaaggtccaccatgatgacctcttaaagaagaccctctagatacttgatgacaccctaaaggctgttatcatgagctataataaagacagtctcttgtgagagtctaaaggactctattgtcttatctgatttgtgatccttactgatgttgtagaagggatgtttaggcaccatcggtggtggtggaacatcataggagcaccttcagatctttacctgtgcccctcaatgcttggcagcagtttctatttaggccagtcagacccccatactcattgagtgctagggcttctctattggcagctgttcagaggatcagattgcttttttttttttttctgcactgaggtgaaacagatgtcaaattcatagtcagcttttcccaatgcttgcccacacagttggtactgaagctgttctctaggtcctaggcacaatcaccatcctggaacagtatcagattgtaggctacagtggcagcaggctagagctacagcaccaggtttttgttttttgattacattcctccttcatatataaatatctcttgtcaagggagcaatagaaaggaaaataccatgctgtctcccaaatgcaaacatgttttccctggaaaatatagatggggcatacttgaaaaaggaaaatgggtgttctgttagtaaataaacacctttgtagacaagaaatgataggtggcaggcatcagccttccttgagaaggtagaagggttcagatgagatcactttgatagaatgtcccagaacttatcaaataagcatttgtgggaacaggacaaaaaactgactcttgaaacccaatcaccatagctgactcagacacacataatacatcattttgaggaaatactccaccaaaaactgtcttggccaggcatagtggcatacttaataattctgacttctagggtagtgtgggatactttatgagacccagtctcagaaaaactgggactggagatatttaggatctattatgaagtgcttgttttatatgcataaagccttgggctcaagtcctagcacaataaccctgttaccacagctttcctatttttaaaattatttttatttttttacagtctagtcattacctacttcccagtccaccctcccacagttcctcatccccttcctcctcttccctgtcttcaagaggatgccccccaccaggcctcccctaaatattttcttaatgttagtacaattaaaagtttgggggtcaaggatgtattttaaagtttcgtccctatcagttttatactggaccaaagtcattttcttcctttcatatattggagagtatacaacattttattgtgtgaaaatatatctaatataaaattgagcatttttaagcatgttgagatgtagattcagtggcactaggtaaattttccattgttgtacagccatcaccagtgtccatgtgttgacagcattccatcctgtcatactgaaactttggccccattaagtgctaactatccatttctccttccattttccagccccttgggaccaccattctgtttctgtctctatagttttgggtacttaggtacctcatataaatggagttatatattttttaatctagtgtatgtcatacagcataatgtcaaaattcatccttattgtaacataagacaaagcatcctttttggccccatgaggatagtgagatggaacctcagatcttatgcatgccctgaaggtaccctaacactgagctacatctcaaagggctggataatattcctttgtacatgtatacattttacttatgtatttaacaatggccatgtgggttgttcctagaaagcataattatttaatagtaaggcccaaattagtttctgtttctcagcccaccaaccagggacccagactcctaccaaacttaaggatatggttgagattctaccagctggcttcaggggagtaataccatctacagtgttgtatttttgcgatttgagttgtcttttcttctaccactattagcagtccgggtcgttctaatttgatcttggtgttcattcttcctccttttcctccatggtctgtattatatctaagttgactccattggtaccctccaagctcacctccaagctttacatatttcctgcttctgttcactccacatgtaggatgcctttcctcgactcctaccctcagacagctacctgtctacatgctcttcacctgggtgctcctgggtcttttacatgagacttgtcaaaacctcatttttttccagatgtctcgtgctatatgtgcagtcttgagacaattataaattatgtctgttatgatattgggatgaaattgtctagacttgttgggtgcattggcaaatatctttatctcaaactcttgagaggcagaggcaggtggtggatttctgtgagtgtgaggccaggcttgtctatacagcaagttccaggccagtcagggctacacagtgagatcctgtctcagaaaatattgtcttgagttttgaagtgagttattattagatggactacttcctgtttttgctaggagtggttccttgaacccagggcctcatacatgaagacaagtgctttcccacagaattatatccccagcccaaatttttatttgttaattcattaattaatttattcagacacccccccccccccgtgtgtctctctgtgtctgtgtgtgtgacacatctgtggaactctggagagctttcaagagtcaattctccccttcccatgaatgaatgttggttctctctttttaccatgtggggtctggagagcaaaatctgttcatcaggcttaccagcaagcaccttatctgctgaactatcttgttgctcccaactccttttgttgctgttgttgttctttgttagttggtttttgtttgcttgtttgtttgtttgggagcacgggctgataagttactgcctaagcctcctgagtagttgagactcaggcttgtaccttcatgataagctaggagtaaaattttaatttttatgtgcaatactgacctacagtgactaaattgccttttttagcataaaacttcagttctcctagggacttggtagagattttttaaaaaaatatgtagctgtgtttatttgtatgtgaaacagggtctcactttgtagctcaggatggcctaaaacttatagcaatctcttgtcttagtctcttgagtgctgttataaaaggtgtgtaccaccacagaatatgagacaaaggcatcctgagtttgagaccaacctgggatatatggtgagaccttgtctcaaaacaaacaagtcagctaacagattgcatattgagcaatatttgattgccactggggttctttgctgcttgtttatttgcaggggttttggggaagcaggggtataatacgcaaagtagaaaatatatttgtctttgtggacctaagagtcaatggtgctttgtggcattatctaaatgtgtggttgtgttctgataaatttttattaaaaactaaggacactaaagacccctggctggattttgtttggccaacaactatttgttagcctaccagttatgcagaagttaagtgtatgtatggatttgtgattaattgctggcctaacaagggtttagtctctattaagtggtataagtaatagatcagataaattggctaaggaagggttcagtgatcactgttttgtttttaaggtaggagatgtagaagataatatcaagctttgtgtatgtgtgccttttttccaatgctgaggatggaacatttccttatatgtttacacagcctgttctttatgggtacctgagcacagctcttccagttttctggtacagcagatagcagtctttagtaactgcttccatataagaataaaaaaatgacaaactactaaaattaaaataattccttacaaagttttgaatttctgtaagtagaacagctctttctaatacctttccaggcattgttatcttcaattcttcagttagaaaaacagagtactaacttttaatatgcttctacatcatctgttaattctctaatcttcatttccttatcctagcaattccatagccccatgcattctccttctaatactatttattcttaaatcatatataatttcctacatttaaaaaaattccaattttttattaggtattttcttcatttatatttcaaatgctatcccgaaagtccctataccctccccctaccctactttttctatccataccttttcttcctgagactactctaactctctatccttggtgtctccaagttcacccttgctaatcaatgcatcagtcattaaaccagatgtgtatatggttcctcatgattccaaaatcaaggccaagtctggcaacgaaccatttccaaaaaggaccatataggcttttatggctcctgtggttatattgtctagaccctaaaggccaagtggacatctattcctcatcttctacagcctccattcctcattcctgaaaacggcatctgtttcaattactatggcattattagctctgagtaatgggggaaagtagattcccagaaagaaagattgaaagtagagtagtaaagacagtagatcaacctcggggcaacagcaaccatcaatgtggagatcatgggatcaactgcctggcaatgctccaggggcaggaactgtgttacaccttcccttatgcagccatgccggacccagtactagagaatttattagaaagctggatgttgtggtggcagtgcagacctgaaatcccagctactccggaagctgactcaggaggatcataggttcaaggctaccacctgggctatataatgagaccgttctcagtgaatgaatgactgatgaatgaatagtcctggggacatagctcagtagggctgggttcattttcccatattagaaggaagaaaggaagaaaagcaaagaagatcattaggaatactagtatcagactgcttaatgtgcatgagatttctcttgggatcaaggtaatgctctgaaatttgatggtgactatggaatgctgaatgaactgaaagttgtacagatgtatgacttttatgagtggttatgtgaaatttgaattatatcacaagtgctactaaaacaaggtgcaggattaatgtatgaaaataattaccaaacagtaaaaatgatccagaattattgtttggatgtaggaattccagaatatgaatctggttttggttatatgaatttctgagtctttccattcatttttcagtgaacttgtgtggggactgacagggatgagggatgctatataagcggcattgtattagtgtaaccctggtcattcagtgggaataaactcagcttgtttgccccaaactttctggatcattttactgctgggttatcctaaagctgtgacctgctttaagcctgcacatactaaattccaatctgcattagaggatcttgctatggctcaggaatgttcacagaacccccttctctgttacagattgaagaaggaagcaaagctgcagcagtggacaagctacttgctggagatgagatagtggccattaatgatgtgagtctctcagggttcagacaagaagcaatttgcctggtgaaaggctcccacaagaccctgaagcttgtggtcaaaaggtaagatgtgtgtcgcttctttattaaccaagacaaacagagagacatagaatgaagcctatgtggcttgtttatatgttagagatttttatatgtgtgtgagcttaaaattacactttttcctcgttagtttctgaagactgttctaagattccccttttgaatatcagaacctgcacatgtttaagacctttctagaaaatgccattgtgtttgtttataatctaggccacatcctcttacatgctttaaataatctctaaacttttaagttgccatgacaaaagtacttgacagtaacaacctcaaggagaaaagattacttttgggctcatgatttcaagagatttctgcccatcacagtagagaaggactgggtttaatagtggtagaagtattttgcagactccttgtcttagtcacggtttctattcctggacaaaacatcatgaccaagaagcaagttggggaggaaagggtttattcagcttacacttccatgctgctgttcatcaccaagggaagtcaggactggaactcaagcaggtcaggaagcaggagctgatgcagaggccatggagggatgttctttactgtcttgcttcccctggcttgctcagcctgctctcttatagaaccaagactaccagcccagagatggcaccacccacaaggggacacactaattgagaaaatgccttgcagctggatctcgtggaggcatttcctcaactgaagctcctttctctgtgataactccagctgtgtcaagttgacacaaaactagccagtacactccttcttcgcagttttgctgaccaagaagcagaagagatgaactggaactagagttgagctcaaactgtcaagggcttgccctcagtaaccttcttccagtagccagaccccacctccctaaggctctactgtcttcaaaacacaagctgttgggggcagtctgctcccaataagggaatatattgttgcctattgttcatagaaggtgaagggcaggtagttttgattacttttgtttgtttgttcatttgttttttaagaaaaagtttctttgtgtagccctgactgtcctggaactcactctgtagaccaggctagtgtcgaactcacagaagtccccaatgcctctgctccccaggtgtggggactaaagacgggtgccatcactgcccccaccccccagcctgtttaactcttaagcatgaaagacaagagtgggtgtgtcacaaatgcaagtaacagatactaggttcatagtattgtgcctcagtttgggggacaaactgcatgttcctataaagattgggggttggcacttagatggtgctaagaaaatgaaattagggacttaatacttttttttttttttttccgagatagggtttctctgtatagccttggctgttctggaactcactctgtagaccaggctggcctcgaactcagaaatccacctgcctctgcctcccaagtgctgggatcaaaggcgtgcgcaaccacgcccggcgggacttgatacttttatgtacaggataaaaacagtaccccttggtaccatgagaaaacttttattttattgttttcagagatttcaggcatgtgcctctgagacttgttgcatgtctgtttttatagaatcagtggagttgttgatttaattaaaaagttaaattgatattgatgcatccagtatatgtgaagcagaagcaggtggatcactgtgagtttgaacatataaaaggctttgaacttataaatatgtatacatgtgcttgtctcaaaagttaagtaaacatttacttcagattttatcacacactgaaaaacatacttctacagagcaacagttctccctttccctccccgcaaccccccttgttttttagctacaagcagaatccagggtagaggctcagagacgagtaaggaggggctggggaggtagttcagtgggtaaaacacacaggtgtgaggactggcgttcaaatccccagcacttgaaaagcagagacaggagccttggagcaagcggcctattagattagccaaatcagtgaactctgtgttcaaccagaggaacatttctctccctcaggatataaagtaaatagggatctagtaagatacaagataacaaattacaagataaaaaatttaatttttacatactatgtgtgcagtccaatgcatgggagcccttgtacaaggcaataaataaataaataaataaggaaagaaaagtgttatcaacccttatttctaagtgggatatgcttatgtcatgagatgcaattagtcttttgaatgccttttgtttatgttttggcagtgctagagatcagacccaggtactgttatgtgctaagcaggtgctctaccattgaactacagcacttccagtcctaaacacccctttaatcagaccttgtagctcagaagatatcatttcagaaggtggaatatgaggtatcattagtgtataattccttggttacctcatgacccctcagaaggaagttgtcttatttaggaatgctattgctatgttgatacaccatgaccgaagcaacttgaggaggacagggtttatttgccttaaacttccatattactgttcatcattgaaggaagtcagaccaagacaggagccaatgcagaggccatggaggaatgcagcttactagcttgctctttcttcctataagaaagctcagcctgctttttaaatagaagccaggaccaccagcccaggagtggcaccacccaaaatgggttgggctctcccctgtaagtcactaattaagaaaatgccttatagctgggtcttaggcatttttacagttgaggtcccctcattacagataactctagtttgtggcaggttgacataaaactatccagtacagaagtcctttgttgtcatgagatgcaattagtcttagtcaagtgatggtcatgggaggatgctaatcctagaggtaagactaggagtgacacattgcctctgggaattgttactgcctcttaaacctcattctttggttgtgaggggctagaactcccactctttgactaacttgacttttgaatagggaagatacaaatttcaaatcccttcaactgggcatatgaattcttagcataggattttgttttcttttgaaacagagtctcactgtatagtcttggctagccttgaacttgtagaccctcaaaaagatcacctacctctacctttaacatgctggaattgaaggtaccaccacaccaaatgtagcagtggaaaatttttttccatcagaaggtagtatgtacagaaacatggaacaggtttcataagttcacttctttttagtgtcaaatctggtgttataagagtgtgtgtgtgtgtccatgggtttagtgggagaaaaatagttttattgtttactttgcatttctataattataaggtaaagtgggcattgctacatatatttctttttcttttttgtttgtttgtttgtttgtttgttttttgagacagggtttctctgtatagctctggctgtcctggaactcactttgtagaccaggttggcctcaaactcagaaattcgcctgcctctgcctcccaagtgctgggcttaaaggctgctacatatatttcttaatgtgcttgatataattgttttgagtcttgaattatatatctaaaaaggatatcaatagataaactaaagcctatttaaaatatgtcagtgccacctaggaagcaaagagaggagaccatagagcttttactggctggtatagccaaaaagatgtgtaaacatttcaggaagaagaattaaactttgctcctgaaggcttgatggaagccattatggagaactccttttttgtattctacatgctgtttcctttaaatacggagtatagacaattatgtgctttaagtaaataaaagtgaatagtttaagtaggaagattttaaaaacaaagcagtttattcaaatttatctgaaacattttaacaatatacttagtgttttaaatttttgtaaatatttttgtatgaattgtaagtaataagggtaggtattattcaaatttgacatggttctgtttagagatgtgaagacatttcccaagctggtaaattagttaatattaggacttttgtgtgtttcttagtgcatggtgaataattattgttaatcttaaagataaacatagtaaagccatgcaacactccagaataacaggcttcatttcaaataaaccagttgttttaaaaaattcagcatgtattcattcacttttttctccatgctcctgacaaccactcaatctgctttctgtaccgtgtattagttagcatttactagtattttgtattttatattgagttccaaggtggaacagtccttctcagaaaaacttcaagacctggggtggccccatagtaaacatgtgctcagcacctaaggcccaggttgattctgagcacacaaagaagagtctagctcacaaaaaatcactctgaaagtgactcatagcttgtagctgttaacatttgaattgttgtccctgcatagactccgctccccttaatgacagctgctccctgcttttatttcctgtgtttcttttatcttagtttgtgaggtaaccaggggaacagccaactggaatgagatttcaatagggcagtttgacaaagcagtggtatcttgtttcacaaggccccagcaatcttgtcctctttgagaagcagtgtcctgactttaatgcctgaagggacatggtgatatctgtattcccagtgaagattcttccacagacaaaagagagtggttacttttcgcagggttagctggggaagaaaaaaacttcaactatcatctccagaaagagcacatgttcttcatgatgtccaggtggcattcggggctcttgagcagtagggtgggggactctataagagccagatctgtggggctgtgacaagttgagtcagcatgcctaccttgttctttggtttccaaggtgtttgatgtttcagtgtgtccctttgcagtgctatgtagtttttagtatatatttgtttgtctctatagagttgtcacctgctttgtcctcctcagtgcacagttctgcacctggtgatttcatggataagggctggcatggatctgggctctaaggttttcacggaaggctacagactttttgttggggaccagtgttgcggtaaatcttcaacccaaatatgccccaacaatgaaaacacgactcagttattatgaatccatgctgtgtgcctagattgggcagctctactactacattatctttcacatcaatgagaccccttagaacttgcagtttctccaggccatgtgtttctgctctgcttttcttcttcctcctcctctgcgtcctctccctcttccattttctcctccttctctctcttcaccttctgctccaccttccctttatctgcccaatcatcagctctcgtttattatacaaattaaggatgggaagcaggtttacaggaaatcacctgagtgctgactctttccttgtttgcaacccctccccgaagaacggaattaacattaaacataattagccccagggcaacccacaatttagcagtgttggtttggccactcagttggattaaaaacagaaggaggcagagacacaaggacttagagagttcagcctggtctagaatgagtttaacgacactttgggtagtttttgagatgctgtctcaaaataataaccataaagaaagtctgggggatacagctcagtaattggaatacttaactagcatatgtaccaaaacacatcaaaatgtacacatgaaccctagggaaaatttcttttaaatattatgccataaattatttttataaggctgatctattttcaatcttttttttctttacgatgaagtataactgccttattttaaatcttactctggtagttccttgtaatcctgtcctagattacgtgccattttgttggggacaagccagggtagggttgattcatgttacttgtgtctttgctggtagccataaaccgtcttgtgaatctaattatatctcctaagctttcactcagtagcagcttaacaacaaagaggaggcttttctttcctggaagctgcaagggttaggcagcctgcatcagatggttacacatttttcagaaagcagacttcaaaagctggggagtagacttgcttgctgggagcaagtttcttgcagcaaatatcattctctaatgttgcagagtttcattgccatcaacttcagactagtactttattgtgctctcctctgccctggcctctgccatggctttgagagcgtagctggagttcctcggtgctaattattagcacagacgttcctgtgagtagcaactttcagtgagtggtatggcaggagtgatcgttttgagacagcaacagatcctttgtctccttctatttcctctcctctcctcttttctcctttccagtgagcctttccttggtggaattctcccagaatagggactcttggggtgtggggtttctatgggtatcaagtgaaagccatactttacagtagcttgctcttctttgctaatggcttagggtattatttctattctgtgagcttttgggggcatgctactgtgcttctttacttgtggaagcagagatgttgaactttatagcctgattggtttgcccttctttcagtattttctttatgaaagtcaagaaaagaaataaaaccacatagttcataagagttttatcttgaatttggacatagatgtagcttaagaaatttaatcagatgagtctctgaaacatttcattttctaggtcaaagttaagacttttgtttttccttctttcttcattgtgaaaaataaagaactagatctttatgaaggttgtatgcatactgtaactaagacatgcaaatgatgtttataaagttcaatttggcagaagtattgtctaatgagtcctaatgagtaaaagagacaatactttgaaaccattgatggcttttagttttcattagttatacaatttttgttaattttttggtaatacattttccttgtatattattatcactatactttgccttttgttttcctctggtgctgaggactgaacccagggcctcgctgatgctaggtaagcattttattattgagttccattccaatcacattgatggtttttaatatattaagagacacatatttactatatcaaaagagacattaagagaaactgttatttttgtttatttcaagtttctaaaggaacttggttttgtttgtttgttttttttgttttgttttttgtttttttgttttttgtttttttttttgagacagggtttctttgtgtagccctggctgtcctggaactcactttgtagaccaggctggccttgaactcagaaatccgcctgcctctgcctcccaagtgctgggattgaaggtgtgcgccaccaacacacggtaggaacttgtttctttttgtttagtttttgagacaaagtttcactaggcccaggttggcctcaaacatgagatctttctacttcaggtttcaaaatctgggattacagtgtgtgccatggcactcatctcagaggaactataaattgtataattagctttatatgttacagattatctcattttgagatctaaggaattaagttgtaaattgtagcattaacaatgcagcttatatttgtggttctataccatagattcatattctatacctatattctgctctcaatttatattctttttaaaattattattagatattttctttctatacatttcaaatttcaaatgctatcccaaaagttccctataccctccccccgccctgctcccctacccacccactcccgctttttggccctggcattcccctatactggggcatataaactatgcaatatgaaggggcctctcttcctagtgatggccaactaggccatcttctgctacatatgcagctacagacacgagctctgggggtactggttagttcatattgttgttgacctatagggttgcagacccttcagctccttgggtgcattcgctagcttctccattgggggccctgtgttccatcctatagctgactgtgagcatccacttctgtatttgccaggcactggcatagcctcataagagacagctataccagggtcccttcagcaaaatctttatggcatatgcaatagtgtctgggtttggtggctgattatgggatagatccccgggtgggatagtctctggatggtccatcctttcgtcttagcttcaaactttgtctctgtaactcctttcatgggtattttgttccctattctaaggaggaatgaagtatccacccattagtcttctctcttcttgattttcttgtgttttacatattttatgttcggtgttctatgtttctgggctaatatccacttatcagtgagtgcatatctaatgacttcttttgtgattggattacctccctcacgatgatgccctccaggtccatccatttggctaggaatttcataaattcattgtttttaatagctgagtagtactccattgtgtaaatgtaccacattttttttatccattcctctgttgaggggcatctaggttctttccagcttctggctattataaataaggctgctatgaacatagtggagcatgtacccttcttaccagttggggcatcttctggatatatgcccaggagaggtattgcgggatcctccggtagtactatgtccaattttctgaggaaccgccagacggatttccagagtggttgtacaagcctgcaatcccaccaacaatggaggagtgttcctctttttccacatccttgccagcatctgctatcacctgaatttttgatcttagccattttggctggtgtgaggtggaatctcagggttgttttgatttgcatttccctgatgattaaggatgttgaacattttttcaggtgcttctctgccattcggtattcctcagatgagaattctttgttcagctctgagccccattttttaatggggttatttgattttctggagtccaccttcttgagttctttatatatgttggatattagtcccctatctgatttaggataggtaaagatcctttcccaatctgttggtggcctttttgtcttattgacggtgtcctttgccttgcagaagctcggtttctgttagtaagatcctttcctttgcctttccccatctggtaatctctggagttagttgttatagttgtctctggttggatcttgttcctcctgtgattctgttagcttctatcagccgacctgggagtctctctctctcctgagtctcagtggtcagggaactctctgaaggtaagctctcctcttgcagggaaggtgcacagatatctggcattcagacctccctcctggctgaagaaaaaggcctgaaacagggcctgtcccagaagatgtgttgtctctgcagtctgcatgcttacgtgcacagactggtctccgagggactcaggatacaagatggctctctcagctgctctggtggccagagccctccagggcagacacctctcctctgctgaggaaggtgcccggatgtctggagcctgaaacggggtctgtcctagaagctgtgtcgcttttacctgtcccagaagctgtgtagcttctacagtccacttgttcatccttcgcagtctgtgacctgacctgtgcagactggtctctgagggatccgggacccatgatggctccctgacctgctctgaaagagtcctcctggatggacacctctcttctggtggggaaggtgcccggatgtctggagcttgaaatggggtctctcctagaagctgtgtcgcttctgtagtccgcactgtcacctctgcagactagtttctcaacttatattctttttaaaatgattactagtgatgagatctacctaacataagatactttactttaggaagaaagatttccctatatacagttgaattgtaaagagaagtatgctcatgagattagggagtattctcccttgatatatgggagaagtgccaggacctgcagcccagcaggcaccagggattctggtaagttctcaatggttttgcctgggcaggaggcccatgttctggttatgtccatcatgttgctcacctttgttattacttgtagaagacctgtgactctcagaggtgtctgtcctacccttggctatgttttgaggatgccctgtttatcagggctgactacttgacctaggaaaatatacttttggtttctcaccaaagggcagggagaggttatatcggtagaactatagatggctgcccagtagatcacagagagtgaataaatgtcattttttcttacacttgtctcatcaagtttgctagtactaatctcttgattgtcttttgggaaggaaacaaacacacttcttaccatataaaacctctgttttctaaaaaaaagtttcactttgcattttgtttgttttgcatcatctgcttcatttatgcaaggaaagtgttcatgttatgagaactgcctagtgtgtctccctcctactctcttgatatttgctcttcccccagtgcttaaatattttcctgtctttgccactcaagatacttgtataacccaacccttacaaaaaactctttagaatagattccagtgaagtgaattttatatagccttttcattgtagttaaattcaaaactttttaatttaatgaagttgtattgttaatgcttttattagtgtgattatgaaatgtctgactaactcagttgtggcacatgcctgtaattccagttctcagaggcaagaagagcaagagttccaggctagcatagagtgcataaggtgacactttgaaaaatacaaactaactaaactaactaaataaataacttaggcccttttgcctatgagacttctagtattctttcaggtagaatagttgttatcatggtttggataaagggatggcaagtatctggcctccattatggaaaatggctgtattactttgttggtatatatttgcttgtctgtagctgtagtgaaatgacagaaacacaatgacaacaaaatccataaaaacaaagtatacagttgtttcttgagcatcttctctagcttcagtttctaagcacaatcaaatataaatgttcatctattgtcattattactattttcagtttctagaactgagtggaattgggggcttcctgaatactaggcaagcactctactcctgagccacatctcaggtcttcaggtttataaaagttaaggataggggctggagagatagctcagtggttaagagcactgactgctcttccagaggtcctgagttcaattccctgcaaccacatggtggctcacaaccatccgtaatgagatctggcgccctcttctggagtgtctgaaggcagctacagtgtacttacatataataataataataataataataataataataataataataataataatagctaaggatagagagggtgtttttgtagtttggtgcttttccaaagaaaaggaccatccatcctcattgatctgatgtataataaaacaggtggcaatttccccacagctacttagcacttatggatgtagagtgaccaaatatgtgagatattatttaatagttctccaactatggaaaacattggaaagagtgtaaatcaacagatttactttgaaaatgccatctaattaattttttttcattttaagacagggtctcaggtgtcccacattggctataaagtcagtatgtacagcctaaggatgaccttgtactcctagtcctcctgcctctatttaagtgttgcgattgcacatttgtgccaccagaacttgttgacaagtgttatttaatcagaatagcatttgactattcacattcatcctgcagcagttggctgtttcctccacctccagacagagtcttgttttattgtccaggctgcccgtaaccatgctgtcctcctgccttaacctctcaggtgcatcaattataggtgtataccaccataaacagtatgcctactattctttgtagtcaacagacttagtgatagatttcatgaaagtcatttatttttattttataatagagttcttatcccaaggccaaggttcaattcaacatttttttgctacatgatgatgctaatatcagtctcttaggttgcctttctatgtgttatgtatcttttgtatatatcatatctatttcttggtccttttttagaaccttctgaattctcaacgttttatctgtggatactgaacattaccagaagctctaaaaaggagatttctgttttgagacagaatggatgaacgtgctcttattttttattttatttttattttttggatattttctttatttacattttaaatgttttcccctttccaggtctcttcttcagaagccccctatatcatcccccctcccgcttcctctatgagggtactcccccccaccccactgcagtcttccagccctggcattacagtacactggggcatcaaacaacctcaggcccaagggcctctcctcccactgatgtccaacaaggtcatcctctgccacatatgcagccagagccatgagtctctccatgtgtattctttggttggtggtccagtccccaggagctcctgggggtcgcgcctattgacacggttgctccatccatggggctgcaaaccccctcagctccttcagtaccttctccaacccctccattggggaccccgagctctggtagggaacacccaccactgtatttgtcgtgctctggcagagcccctcaggagacagccatatcaggcttctgtcagcaagcactttctggcatccacagtagtatccaggtttggttactgtatatgggatggatccccaggtggggcattatctggatggccttcccttcagtctctgccccacactttgtctctgtatatcctctcatgggtattttgttcacccttctatgaagcactcaatgaagcattcacattttggtcttccttcttgggcttcatgtggtctgtgaattgaatcttgggtattttgaactttggggctaatatccacttatcagtgagtgtataccatgtgtgttcttttgtgactgagttacctcactcaggatgatattttcaagttccatccatttgcctaagaatttcatgaagtcattgtttttaatagctgagtagtactccattgtgtaaatgtaccacattttctgtatccattcctctgttgaggaacatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccatcaacaatggaggagtgttcctctttctccacatcctcgccagcatctgctgtaccctgaatttttgatcttagccattctgactggtgtgagatggaatctcagggttgttttgatttgcatttctctgatgattaaggatgctgagcatttctttagatgcttctcagtcattcaagtttcttcagttgagaattctgttttgctctgtaccccattttttaaaagggttatttggttctctggagtctaaattcttgagttctatatatatatatatattggatattagtcctctttcatatgtgagattggtaaagatcttttcccaatctgttggttgctgttttgtcttattgacagtgtcctttgctttatagaagctttgcgattttacgaggttccatttgttgattcttgatcttacagcacaagccattggtgttctgttcaggaacttttcccctgtgcccatgtgtttgagacatgtccccactttctcttctattagattcagtgcatctggttttatgtggaggtccttgatccacttggacttgagctttgtacaaggagataagaatggatcaattttcattcttctaaatgttgaacgccagttgaatcagcaccatttgttgaaaatgctgtcttttttctactggatggttttagctcctttgtcaaagatcaagtgaccataggtgtgtgggttcatttctgggtcttcaattctattccattgatctacctgcctgtctctgtaccaataccatgcagtttttatcactattgctctgtaatacggcttgatgtcagggatggtgattcttccagaagttcttttattgttgagaatagttttccctaccctgggttttttgtttttcccaatgaatttgagaattgttctttccaactctatgaggaattgagttggaattttgatggggattgcattgaatctgtagattgctttcagcaggatagccattttcactatattaatcctgccaatccatgagcatgggagatctttccatcttctgagatcttcaatttctttcttcagaaacttgaagttcttgtcatacagatccttgacttatattgtttgtgattgttgtgaaggatgtcatttccctaatttttttgtttttgtttttggtttttgtttttgtttttggagacagggtttctctgtatagccctggctgtcctggaactcactctgtagaccaggctggcctggaactcagaaatccacctgcctctgtctccctagtgctgggatcgaaggtgtgcgccaccactgcccagcttcctaatttctttctcagcctgtttatcctttgtgtagaggaaggctactgatttgtttgcgctaaatttatattcggccactttgctgaagttgtttatcagatgtaggagttctctggtgaagtataggatcatatcatctgcaaatagtgatattttgacttcttcctttccaatttgtatccctttgacctccttttgttctctaatttctctagctataacttcaagtactatgttgaatagatatggagagagggtgctttctattgtttgtgaagaattaggagtatgtgcaattgcaaaaggccagctcaattctactcttctcctaccttgggctttccagaagcatcctgctcagttgtgctgtaagacttgtccctttgggatctttttacagccacccccagccctggccccctgaccagaaggtttcccactggctcgtctctagtcactgagactaccacggtattttcagtgcattttccttttgccctttgcagggattttccaacctctacctccttttctctttgctgacaggaactaggtaagattccttttgtaaaggtcctggattggggtgggggtgggggtggggcaccgtttccctaagactccttccctctaaccttggaggacccatcatacatccatcctcatgggtttcttgggaaatgatctccataatcagctgtagctcagacatgctgattctgtggctactttttttttttttttgaagaaaggggtcttgctctgtagaaaaggctcacctcaaacttgtgggaatccttctgccttcactacctcaggactaggatcatagatgtgaatcactataccttattttgtgtctttgttcttatatataagactcattcgccctgctgttactccttagggctatttatagtagttacattaatggctgcacatttgaatgtcttttgtttcttagccaacattatctgttcattgaagtgaggccagggagttgtactggagtccttttaaatgctgcttgatgtgttaggcagctgaaatatcatgtgttattgatcgcaagtggtttgggtatggagtggagaggataaagagctagcctttcttttctttccagtactagtaaaaggttgtgacaaaagataagaaaaatgatagtttatttgggtctgcttcaaaagtgggtatggtgtgagtttattctgtgacattctttcagcagtgggaagagtgacactagaagcagcttccttgctctggccagggctgagataagagactgtactggctgggaaaagagcaactgtgaagctttcatcctttgactgcatctgttattgctgaagattggcctttgatggcttctatcattttcatctgctgagtgtatcaagacatttgtatctttcctgaattcttctaatgtataaaagcaggggctctcactctggtcccaaaggaccagatcttatcaggcaccatgctctcattcacagcatgacatctctgcagcactgcctaggaaagaatgtactgttctgttaacttcccacagtgccgttaaacagtcaacatttctttcttttcctttcttctatttattgttttgtatagcttgtagctgcctttgtctcacctatgttcccataagtagccccagtaaactcactggtgcactaagctggacttgggtagaattatttttggtttgtcatcagtgtcctggggtgaatagatatttgctcatgtattcccagaaaccgtcaatcacaaacacgctttctcttgcttttccactgccactctaggattcacagctgtgttccatctcaggtgcacttggtatgactgacttaggttggtattttcatctaacagctggctcagcaattgaagtacagctccacggctttgtcttcaggacagacagcattttccctcttgaagttaccactcactaattagagcatctgtggcccatgttttatgagcccattcagttgagagcatcccggaaagcagaacttactggaatgatgttaaccacttggctggtgtgttgcttgcaagttaagtgaccatatattataaaagatatgttagagcatttttgatgataacattgttgaatctactaaaaagtagttaggtctgagagtacaggcatgtaaccccaccactcaggaaaatctagaatttgtagccagcctgggatacatggcaagttccaagacccagtctgggatacacagtatggccctttctcaaaaaaatagaaaaataaaaagataaggcgttgctcctaagaacctttctaaacagattcactttccccttatcctttcttttctactacctctggagggtggtgggctaaaagggaggttaaagtgtttaagaaccaccattaacaataggttttgaaaaaattaagttacaaggtagaaactgactcagagagagagagagagagagagagttattttagaggcttaataagaaaaggaaggaagtgcacaggtgagagccagtgtccactctgcatgaaggtacttcttaacttgtttgaaaaactggaagtgtgggtaaattgccaggatccagctaaattccatctcccttaccctggaccttctgaaagcatcctgccttctgtgagtcttgccaggggtgggatgtgttggctttgtatatctctccaaaggctgtgggctctcccactgctgcttttgaagtcactgaggcccaagtatttctagcacatttctacgttgcccatttaatgaagtaaggcctttgtaaactttgcgtcttatgtcatagatgctctaaaacaccaagcatccttcttccttcactctcaatatgtggaaacagcctcctaacctccttggtcactttcaaggtaagggaatgttctgagctatttcctcaggcatccaggaatttgaacagccacttactccttaccacttgcagaactaattggggcaggaccaccagacacagcttgtatttggggaggaggtacagcctcactatcttctaaatagttacaaaaataacccaattcacatatgattgtttattttttgaggagagtgaaggattctgtatttcctgtgaataaagaaaaattcattaaaatactcatgctaataattaaaagaatataacagaagctgggaattctggtgttcaatcacaattttgattgtaggttgcacagcaaattccagtttatcccaggctatgagagactgtcctcctccccctcctcatttttttttatcactctatgccagtttttgtactggtaagataaaacccattctttcaaaagaaatgtatccagtattgggctggggacttggtttagtgtgtaatacacttgccatacaagcatgaacacctgtgtttggttctccaggatctatgtaaacccagatgcaatagcacatccttataatacaagtgctcctacagcaaaatggtaggttgagactggagaattcctagaagctcacgggccagctagcatatcatatggggagacaattaaaagaccctgtctcaaacaagaaggcaagtaagctctgatatccaaggttgtctctgaactatacacatatattgactgcagcatgtgtgcctgcatgtatatacacaaacctgtactcacatgccaacacataggtgcatgcacacacacaaagaccgtttccaagttggacatgaatttttttttaatgaagtaaaatcagtttgttttgtacatttaaggcagttgatttcaggaaaagttactagagtatcaacagtaatatctttcttgttctttgcatgacctagactctgggaacaaactcgttactattaggcacttcaggctgtttgtttcttctgctgtggcatacactgggttatatctgtgtcctatacccatattactagagacgactggttttaagtccatgcatgggggggaaacaggagagcctaatttctaagtggatttcaaacgttcttatcacctgagaatgggtagaactagtgggggccagtaggtggcatcagagaacacaccatctcttcagaattgtgaatgacaagccaactagcctctagatgctatctgtttcttattaatacaaccccagctgtttctcagcatctgaaatgctaacaagcctgatgtccttgattctaaaatgtggtcatggtgtactagtaaatttagaggatatggaagcaatcactcgcactttaggaaatgttactgtccctggtaggcattggaaccttcagtgattgcatataggagtataactcttttctctatatcttcgtttgtttattttttaaaaacagccccagtaaacataggaaccttaagtctccttgacacgcccactattctagtaatcttcagttacccttcttactctttgtcttcattggtttatttaagagtcccagtaagatctcagctgccgactatatatcgaaatcgatgcatctatctgtgcattggcttttaaatatcaatagtgtattatcagtgtgtgtgtgtttgcatgtatgatgtgtatgtgaactgtgtagttgtggaggccgaaggaaaaccttgagacatcagtgttcttccatcttaatgtggcttctggggatggaactcagggtctcaggcttgtgtggcaagtgcctttttccagttgagccacattgctagccctgtgtattttctttttaagaaccttcagaggctgacgagatggctcagtggttaagagcactgactgttcttccaaaggttctgagttcaaatcccagcaaccacatggtgtctcacaaccacccataatgaaatctgatgtccttgtctagtgtgtctgaagacagatacagtgtacctatttataataataaataaatcttttaaaaaaagaaagaaaaataataacctttgggatttttcatggcctcacagaacatagtgcattatttgtacacacttttcaaagatatatttctgtcttacttttcttagtctagtccatctgccttggagaacttctagctaccttgcacacaaacatcctcctagatgtggtggagagccctcttccatagtatcaggctctggtccttttatgctaactaatggctcttactaggctttcttcagaggaaacattctaaaacagccaggaagaagttacaggcttcccacaaccatgctcaaattccctagaatgttatttcttcccattctgctacctttattaaatcaaaaagtggggtctaatacagtgaactcaggcttgctgagaacttactatgtagcccacgctaggttcctacttataccagtcctcctgcctcagcttcctgagcgctggtttgtaggcaagagttcatacacctgactccattttgttgcttgctggttaccctaatcaggctcacactaaaggggaaggagcacaactaatgggaaggtagcagagatggtacagccactttaaatctattacacattttgtttaaaaaaagctactattttagaatttgcttactaatagtagttgtcctagacattgctttcccatggcctcagctagtatctcaaggcattctagtatggaggtgcaaatagtgttatcatagttgaggcattttctttccttagccatatttttccttccctctgccctcatgttctgtcaatctagttcctttttcttaccagttaactgaaaagagagatgaaaaaaagctacagatactataccataggaaaaccctgcagaataaagtgtacgtggttagagccttacttctgaaggttttgagaaattctatgaggtacattcctgattttgtaattctttacatctgaggtgtgatagttattatcttctttctctagtacctgtaaaatgaacatgaagtcaacattttttggcgctttgcatacttattaagactattggtcttgcaaactctatatgcctcagtacaggggaatgccagggccaagaagtggggtttgggggacttttggggtagcatcggaaatgtaaatgaagaaaatacctaattttaaaaaataataaaattaaaaaaaaagactatacaagtcattagaaggtttgtgttatagtgatttttggttttatcttagaaagtattctttattatataacactcttcaatatttttgcctgtgggaaaaaatgtctagtctgttatttacctaaagctgttctgtgtgatcttttgacacccttgactggctcaaaaactgtctttaattggagctttgagaggtaagggtagcttcatgcagtgactttggagttgaagggacttgggttggatctccatgtttgtgatattctgctgcaggtatttttgttgttcttttgggggtactggggatcagtcccaaggcctcatacataatctgtctttaaaaaacacagagaacagtaacaacaaaacaaaataagagctggagatgcagctcagttggtagaatgtttgcctagtatatagaaaagtcttgagttctatcaccaacactgcataaaactgggcgtagaggtgctcctgagaattcaggggggagaggcaggaggatcagaagttcaaggctagccctgggtatattagacattgtttcaaaaatgcttataacatttctaactgacaacaaccttatccatttatggaggaataaattaaaaagactaagggtggttttagagcctatgattcccactctgtatcatggcagtttggtcattagcagccatctgaagtaatgtgcatgcccatatatagtagaaagcagctgtaagccatgtgttttgggtggcagcagataccattagttccctttgttgggtcctgctgttgtcctggacaggaagaagtgtgtgaagtccctttctttgtattcttttccaggaaaagtgatccaagttggaggccccactcctggcacgctaccaagtactttgatgtccaccctgagccagcagcctcactgtttctgaacaccagcggttccccttcctggaagagccagcaccaggctaggtaggtactctttcccggagaccaaacaccatgtaagtatgacattctgtgagtactcagaaattcccttaagttttgggatttgacttcagaacagtcaaggctactgatcctcaattagggtttgaactgaatatttcactgagcacagaaacatctgataatagaaaacaaacaaacaaataaataaataaataaataaataaagtggtaagacaaagaacgaacaagcttttctctctctcttgtgtttcttgaggaagcttcagtttttattcttgtggaatcctttgagactgtcaagtgtgatatcacggagttggattctgaatctagcaggtggggttcccgttataactctgtcttctcagccatcatcttctttcaaagatattttgatggattggcaagcaggtgatgtttatggggagggtttactatgtctacatctagtcttcagtactctacaaatgttattgattagatgtctcacgtattctgatggaaggatgacagtaatgatggctggtatggttttggcatgtgtttattgtgcatgagtatatcatcatggctgtatgaattgtttttcccctgtatgcatttgtgcctgtgtatggctgtgtgtgtgtggctaaatgtatttgtgcacgtatgcatctgtgttatgtatgtatgtatatatgtatatatgcacatgcagtccagtatgcatatataatatacaagtatgagtgtacaagtataatttatatatatgtttatatacacatgtggatatctatgtgtgtttggaaataatattagtttcttatacatttctattacattttgttatatattagttttacttttttaaaaaaaactttagttttaatctttttttttaaagatttattttatttatatgagcacaccgtagctgtttccaggcacaccagaagagggcatcagatcagatggttgtgagccaccatgtggttggtgggatttgaactcaggacctttggaagaacagtcagtgctcttaaccactgaaccatctctccagccctgcaccccccctttaaagatttatttatttatttatttatttatttatttatttattatatctgagaacactgtagctgtcttcagacaccccagaagagggcatcagatttcattatggatgattgtaagccaccatgtggttgctgggatttgaatgcaggaccttcagaagagcagtcagtgctcttaactgctgagccatctttccagtcctagttttactttttgaggcagggtctcatacggatcagactggacacaaactatgcagtttagactagccttggacttgatcttcctgtctctttaactcccaagtactaggattataggcatgagctatcacattgtttccaaattttctcttaatttttaaaaattatttatttacttttagaaaacattttatttttatcactttctaacaatgtgtctctgtgtgtgagagtgtgattttggtatataagtgtggtacctgcagaagcttgaaggttttagaaccttggaggtaaagatacagacatttgtaaaagttcctctgtaagagtagtaagtgtcttaagtgccaacccacttctctagccagccctctgattatattttctagcatacaaaataatagtatgctttatggcattttagtacacatatagttttgtactttgctcatattgagttttagttactacccattttttccatcccagtagccctttctccgccccacccctacactttcattctgcataggagaaaacatgtacctcccactcctcctcatctttctaacttgctcatcctccttatttctgagatgaggtctcactatatatgttctggttagtcttgtaattgctaaatagacttgactgtcgaactacaggccatcttcctgcctaagcctttcaggtactaggatcacaggtgtccaccaccacatctagttcccttctctccatccccaaatagggatggaacccagagctgtttgcatactaggcacatgttctaccaatgttatatcctcagctcagcaactcttcttcttctaaccatctcagatttcattgaggctgttagttaacgcctctctgataacagattgcagagtaagcacttatgtgacgtgaaggaagtacttctcaaatgcataatatttacagcaacaagactggatagtatttattttgaaaaaccacagattctaaactgagcaaaaaaagggtgaaaatgtgtttcatatttcctcattggagtgccttgaacgtaatagaatcttccacttaccagcttaaccagtcaccccattagagaagcatctatgctagccacatctatgtataaactgggctttgtgctatttgtatctggatgaatttatggtaatgaataatctggaacatattctattcattaaggattcagtctgtccttaaagaaaatgctatcaaagccaagtggttatctgtcaccctcaggcgacttagccaggtctgtctcctatctttaccctgcttgccattttctctcttatccttactctcccctaacataatatagccacacttttctttcttgaagcatggaaagtcaagctttaaggaaaacatttagcatcctgtaagtagttttgccagtaagagacttacagtcatatatgcacagtgactgttctgtggaataattacttactcagccaattacttactctgttttagacacagtactgactaagaatgtgtggtttgagtgtgcatgtgcagccaaaatgagactgaaaagtttaaatccttcatctggacagagaagcacatgattctgctgctaaagcctattgcttcttgtctcagtcagaatttacgaatgaactgttgataattaaatatttgagaatggaaatttcctgaaatttctcttgtaattctaaagcatctcatttgatgcttccttaagatgaactgtgtgcactacagcctgtgttataaggagctattttccctggctctgttagtgttcaacttggctattgtaacacaagatgtagaaagaagagcatggctgtgttgctataaaactttatacattgaaatttgaactttatataattatcttatgtaagtcaagagaaatattcctgttttcttttccttcagctattcaaaaatatataaatgggttcatgcatagtccctactttctcctctagcagatttagggtattagggcttattgttgaggttcttggtccatttagaattgagttttatgtagggtaagaaataagactctagtttcattcttctagctatccagcagtactctttggtgaagatacaatcttttctccattagatttgttggccttttttctcactaattaggtggctgttgtagtatgagtagatatgtgggtccttggtcctattccattgataaatgtgtctgcttttatatcagtattgtggtgtgttttggttactatatctctgttccacaagttgaaagctgggatagtgatgacctcaacatttttgttgttcaagattattttaactatcctgggtgtttgtattttcctgtgaaacttaagattgttttttcaatttctgtgaagaattgtgttggaatttgtgtgggggtttgtaaattgctgttggcagactgaccattttcagtattcatcctaccaatccgtgagcataggcagccatcgcatcttctgatgcccttttcaatttcattctgcattgtcttaaagttcttatggtacaagtcttccagttcttagatttattttaagggtttttattttttttaattagatactttctttatttacatttcaaatgttaccccctttcctggtttcccctcagaaaacccactattccctccaacctccccctactcacgaacccacccactctcttttcctggtcctggcattcaactacactgggtcattgagccttcacaggaccaagggtctctcctcccattgatgacctacaaggccatcctctgctacatatgaggctggagccatgggtccctccatgtgtactctttggttggtggcttagtccctggaagctctggggatattggttggttcatattgttgttcctcctatgggactgcaaactccttcagctccttgggtcctttctctagctcctccattggggtcccagtgctcagtccaatggcgggctgagagcacccacccctgtatttgtcaggtactggcagagcttctcaggagatagctatatcaggctcctgtcagcaagcacttgttgacatccacaatagtgtctgggtttggggacagtatatgggatggatctccaggaggtgcagtctctggatgtcctttccttcagtctctgcgccacactttgactccatgcttcctcctgagggtattttgttctccattctaagaagcactgaagcatcctcattttggtcttccttcttcttgagctttgtgtggtctgtgaattgtatcttgggtactccaagcttctaggctaatatctacttatcagtgagtgcataccatgtgtgttattttgtgattgggttaccacactcaggatgatattttctagttccatctatttgcctaagaatttcataaattcattatttttaacagtactccattgtgtaaatgtgccacattttctgtatccattcctctgttgagggacatctgggttctttccagcttctggctattataaataaggctgctatgaacatagtggagcatgtgtccttattacatgatggagcatcttctgtgtatatgcccaggagtggtattgcgggatcctcaggtagtactatgcccaattttttgaggaaccaccaagctggtttccagagtggttgtaccagcttgcaatcctaccagcaatggaggagtgttcctctttttcagacatccttggcagcatcagccattctgactggtgtgaggtcacggcagttttgatttgcatttcactgctgactaaggatgttgaacatttctttaggtgcttctcagccatttgatattcctcagttgagaattctttgtttagctctgtactctatttttaaaagagttatttggttctcttttctatttttaaaagagttatttggttctctgaagtctaaattcttgcatttttttttatattggatattagccgcctatcagatttaggattggtaaagatcttttcccaatctgttggttgctgttttgtcctattgacaatgtcctttgccttatagaagcttagcaattttatgaggtcctattggtcaattcttgatcttacagtacaagccattggtgttctgttcaggaacttttcccctgtgcccatgtgtttgagacattttcccactttctcttctattaggttcagtgcatctggttttatgtggaggtccttgatccaattggacttgaactttgtacaaggagataagaatggatcaatttgcattcttctacaggttgaccaccagttgtgccagcaccatttgttgaaaatgctgtcttttttctactggattgttttagctcccttgtcaaagatcaagtgaccataggtgtgtggattcatttctgggtcttcaattctattccattgatctacctgcctgtcactgtaccagtaccatgcagtttttatcactattgctctgtaatacggcttgatgtcagggatggtgattcttccagaagttcttttattgttgtgaatagtttttcctatcctgggtttttcgttattccaaatgaatctgagaattgctctttctaactctatgaggaattgagttggaattttgacggggattgcattgaatctgtagattgcttttggcaggatagccatttttactatattaatcctgccaatccatgagcatgggagatctttccatctcctgagatcttctctttctttcttcagagacttgaagttcttgtcatacagatctgttacttgcttagagtcacaccaaggaattttatattatttgtgactattgtgaagggtggtgtttccctaattttttttcagcctgtttatcctttgtgtagaggaagaccactgatttgtttgatttaattttatatccagccactttgctgaagttgtttatcacctgtagagttgtctggtgattttggggtcacttaagtaactatcttatcatctgcaaatacttatattttgacttcttcctttccaacttgtatccctttggcctcctcttgttgtctaaatgctttggctaggatttcgagtactacattgaatagttagggagacagtgtgcagccttgtctagtccctgattttagtgggattgcttcaagtttcactccatttagtttgatgttaactccgggtttgctgtagattgcttttactatgtttaggtattggccttgaattcctgatctttctaagacttttatcatgaaggggtgttggattttgtcaaatgctttctcagcatctaacaagatgatcatgtgatttttttccctttgagtttgtttatataatgtattacattgatggatttccgtatattgaatcaaacctgcgtccctgggatgcagcctacttgatcatgatggatgctcattttgatgtgttcttgtgaggattttattgagtatttttgcattggtattcaaagggaaattggtctgaagttctctttctttgttggttcttttgtggtttaggtatcagagaaattgtggcttcatagaatgaattggctagtgttccttctgcctctattttctggaatagtttgaagagtatttgtattaggtcttctttgaaggtctgatagaactctgcacgaaacccatcagatcctgtgcttttattgtttgggagactattaatgagtgtttctatttctttagggtaatgagactgtttagatcattaatctgatcctgatttaactttggtacctggtatttgtctagaaaattgtccatttcatccaggttttccagttttgttgagtataaactttttgtagtacgatctgatgattttttttttatttcctcagtttcttttgttatgtctccattttcatttctgcttttgtgaattagaatactgtctctgtgccttctggttagtctggctaaaggtttatctatcgtgttggttttctcaaagaaccagctcctggtttggttgattctttgtatagttctttttgtttccacttgattgatttcagccctgagtttaattatttcctgctgtctactcctcttgggtgtatttgcttctttttgttctagagctttcagatgtgctgtcaagctgctagtataagctctctccattttcttttgggggcactcagagctataagttttcctcttagcactgctttcattgtgtcccgtaagtttgggcatgttgtatcttcattttcattaaactctaaaaagtctttatttcttccttgaccaggttatcattaggttgagcattgttcagcttccaagtgtatgtatgtattccattgtttttattggtattgaagaccagccttagtccatggtgatctgataggatgcataggattatttcactcgtcttgtatctgttgaagcctgttcgatgactgactatatggccagttttggaaaaggtaccgtgaggtgttgtgaagaaggtacattcttttgttttaggataaaatgttctgtagatatttgttaaatcatttggtttataacttctcttaccttcactgtgtccctgtttagtttctgtttccatgatttgtccaatgatgagagtggggtgttgaagtctcccactattattgtgtgaggtgcaatgtgtgctttgagctttactaaagtttctttaatgaatgtggctgcccttgcatttggagcatgttcagaattgagagttgatcttggtaggtttgacctttgatgtgtataaaaggaggattccttgtcattgaggtccaatgtgtagtttgagctttggtaaaatttcttttatgaatgtgggtgcccttgcattaggagcatagatgtttgaaattgagagttcatcttggtagatttttccttttacagtatgaagtgccccaccttgtcttttttgataactttgcgttggaagttgattttgttcgatattagaatggctactccagcttgtttattggaccatttgcttggagaattgttttccagcattttacaccaaggtagtgtctctttgtcactgaggtgcatttcctgtatgcaacaaaatgctgggtccagtttatgtattcagtgtgttagtctatgtctttttattggggagttgagtccattgatattaagagatattaagggaaagtgattgttgcttcctgatatttttgctgttagaagtaggattatgtttatgtgactatcttctttttggtttgttaaaagaagattattttattctttttctagggtatagtttccgtccttgtgttggagttttctatttattatcctttgtagggctggatttgtggaaagatattgtgtaaatttggttttgtcatggaatattttggtttttccatgtatggtaattgagagttttgttgggtagagtagccttggcggacatttgtgttctcttagagtctgtatgacatctgcccaggatcttctggctttcatagtctctagcgagaagtctgttataattctgataattctaccttcatatgttacttgacctttttccctgactgcttttaatattctttctttgttttgtgtattcggtgttttgattattatgttacaggagaaatttctttactggtccattttatttggtgttctatcggcttcttgtatgttcatgggcatctctttctttaggttagcgaagttttcatgtatagttttgttgacgagagttatgggccttttgagttaggaatcttcactctcttctatacctattatccttaggtttggtcttctccttgtgtcctggatttcctggatggtttgccttaggatctttttgcatttttttttactgttgtgtcaatgttttctatggtatcttctgcacctgagattctctcttctatctcttgtattctgttggtgatgcttgcatctatgactcctgatttctttcctaggttttctatctccagagttatctccctttgtgatttctttattgtttctacttctatttttagattatgaatggttttgttcaattccttcacctgtttggttgtattttcctgtaattctttaagggatttttgtgtttccactttaagggttcctacctgtttacctgtgttcttctgtatttctttaagggagttattcatgtccttcttaaagtcctctatcatcatcatgatagagtatgattttaagtcagaatcttgttttttccggtgtattggtgtatccaggatttgcttttgtgggagacctgttttttgatgatgccaagtatccatggtttctgtcggtatggttcttgcgcttgcctttcgccatctgtttatctctgatgttaggtgttcttgctttctctggctggagtttgtccctcctgtgggcctttatgcctgtatcagcattcctaggagaccagctctctcccggctgaacttgtgtatggagggctgtggaacagccctagctctgagtgcagatggtgacctgaaggatcctgtcccagtcgctccactgttcctgtgcaatgtgtgctccttgctggtcctgccttggacagttattggagagaaagtggctatctaacctctgagccctggagtgaaagtactcctgggagataagctctctccttgctgtggaacagcccaagctcagggtgcagatggtgacttgaaggatgttacccagcccagctgctccacagttcccgggccctgtgagctcctggcgggcccctgctccagacagttattggagagaaagtcgagatctcacctcttggtccaggagtaagagcactcctgggagaacagctctcttctggcaagacctgtacacagcgggctgtggaacagcttcagctccccatttaaggtttttttgtttgtttgtttgttttgttttgttttgctttgttttgaatactgttataaatggaattatttctccaatttcttagtacatgttagctgtttgtatatgggaaggctattgatttttatatgttaattttatattttgatacttagtaaagcacatatcaactataggagtttttgtggagtctttagggtctttatgtataaagtcatctgcacataaggttactttgacttcttcctttcttatttgtatcccttatatctccttctagctaaggctttaagtgctagactggacagagtagggcaaagtagatgccctgtcttattcctgagtttttctctgtttgggaagatgttggctatgggcttgcctttattatatatcccctgtgttcccagactctccaagacttttgtcaagaatgaatgttgaattttgtcaaagatctctgcatctaatgagagagagagatgtcatgtggtctctatttttgagtcggtctatgtagtggattatgtttaataaattatgcatgttgaaccatccctgcatctttgggatgaaggtgacatggtcatggtagataatctttttattgttaggttttttttttaatttggtttgtaagtatttttattgaacttttccatcatgttcctgcagaaataattttcttcttttgttgagtctttgtccagttttagtatcagggtaatactggcttcataaaaataatttgagaatatctttgctatggaacaatttgaggaatattgatgtttcttctttgaagttttgatagaattctgtactgaatccttctagccctggatttttaagttagattttgtggttgtttttgtttttcaagatagggtctcactacacagtcccggctgtcctgaaacttgctcatgagactaggctggcctcaacctcacatcctcctacctctgccacatgttgagattaaaggtatgtgctatcatgcccagctaagttggaagagttttaattgtgtcaacattatcaggtgttatttctgtttaaattatttcatgagatggctcagtgggtaaaagtgcctgcagtgcaaggtgacttgagctcaattcctagaatccagagaaaggcagaaggaaagaaacaagtccataaacattgttctctgacattctacacatgtgccatgacacatgcttgcatgcacacacatcatgtatatatgcacacataataaaaaataactgtaagaaccattcttagtttatgagctgtcattttccagtctctgctcttaaccaatgaaggaccgtggaaatgttatttcaggcactgcctgcatcactgtgggcattagtttaagaaaatgtggtagcattgaaaaggatttttaaaagtcactcagtagtttgacagcctttttagtgtgccctcagaaatgccctcttctcccagttcccagtcagttactgttaagtgtcctcctcctcagaagaggaccagctgtactcacaatgctattatcttcagaccttgctctttgcaaacctttctttgtgctttttctccttgtagttcttcctctcatgatttatctggctcatgggagcatacaagcctacagcgcacttctgaccacttcagctccatgggcagcatagacagcctcgaccacagctcccaactctacccatctggacacctctcatctgccaagtccaatagcagcattgaccacctgggaggccacagcaagcgagactcagcttacggctccttttccacatgctccagcacccctgaccacaccttgcccaaggctgatgcctcttccactgagaacattctctataaagttggcctttgggaggcctccagaccaggcagcagccgacaaagccagtctacaggtgatcctcagggactgcaggacaggccatcatgtttcatacctagggttcctggtaacagtagtaaaagtccaaggccggaggataatgttgaacccaaaatagccactcatgggagatccaattttgggcctgtgtggtatgttcctgacaagaaaaaagccccttctcccccacctcttggacttcctttgcgcagtgatagcttttctgtggcagccaggggccatgaaaaagcccggggccctccattctcagacttggccagtatgcagcactttatcaccctgccccatgtgcaaccccggggggaccatagaatggaaactacagatcgtcagtggaagctcacacacctaagcagtggaaaagaaataggaaatgtgggttaccagtcagaaggccacctggattgccgttggctatgctctgatgatagagcaggtaggccctcagggcctccgggcaggctccagttctccgatgtgcactttctgaagtcttaccacgggagccagcaccaacagcagtgcagtgacgagagcccaagggccccctcatcaccaagggaactgcttcatataactcctggtggcggtctgcaagagcctcctgaaccatctcaggatgacaaccctactcaggtgaggtggcctggttctgctcaccagaagctagatgacagagggcggagccactattttcctgggtccctcaggcagcctgtacaggggagtgcccaggttgtgataccccgaggtgactattggcattcagatacaactcctgtggaccttgaatatcctctcttacgcccagtaggacagaggacctacctacagcagcatgaggagactccggcctctcatgaaaaagaggggtatcaccagctaaatgcagggattgaaggctgctgctctggaatccaagagcctcctagagccagccgcactgtgagaactggtctgcagtgtcctagcaatgacttcaaattagtggatggagagagtgggagaatttctcgtcagaggacacccatgctgcattctctgacccaagatggtacatggagacccgggaacagcaaggattgtggaaatgataagccaccactgtttgatgcccaggtgggtaaacccacacggaggagtgaccgttttgccacaacactgaggaatgagatccaaatgcgtagagcaaagctgcagaagagcaaaagtacagtgacactagctggagacagtgaagctgaagattgtgctggagactggagagctgatgtgggggctgtcccagaaggttccttccccagcacctataaagagcacctgaaggaggcccagacacgtgttctgaaggccacctctttccaacgccgagatttagatcccaccccagcagatcagtattcaggaccatcagaacacaggacttttgaccacagtgcctcatcttctttatcttctttccctggggagccagactctgccccacgcttctgtgagacaggtctggccaaggcaccctcttctggagttggtgtaccccacgttcttcgaattggaggccggaaacggttcacagcagagcagaaactaaagtcctattctgagccagagaaaataaatgaagtggggctctcaggggaccaccgtcctcatcctactgtcaggacacctgaggatacagtgggtacatttgctgacaggtggaagttttttgaggaaacaagcaaatctcttctccagaaggcaggccataggcaagttcactgtgggctccctagagagaaggctgagaggccacagacagggcaccatgaatgtgagagtacagagccctggttccagaagaggtcactggccacctcctgcggagagatcctcagtgatagaaaagtagaaaaggcctcagagaaattgaacccacccagaaggcttggaaccttcgcagaatatcaagcatcttggaaggaacagaagaaacctctggaagccaggagttctggacgataccattcagcagatgatattctggatgctggtctagatcagcagcagaggccacagtacattcatgagcggtctcgttcatcaccgtccacagatcactactcacaggtatgcagtgtataataagccactacttagcttgcactgagcaccactttaagattcttagggcatatacaacatatatgatggctcactaagatgcgagagtatcatttctagtttgaaagatgaggggatgaaatggcatccagcactatcattttaagtgccatatttgtgcagaaacatctctttatttccagctctctcttccctaacttatacttcatcatctttgtacctaattagtttgtatctagtctcatgttcagcaaataactctaggtgctgggagactataggaagcagtcactttatctagtgacatgaaaatgggtgatttgtgtaaacatatactagccatttctttaaagattttattttcatgtatatgtatgcttgtatgccacatgtgtgctagtgtcatggatatcagatggattccttagagctggagttacaggaaattttaagctgcctaatgtgggtgctaagaactgaactccagtcctctccaagagcagcaaggattctgctgaaccatttttctagcaaaccccacccatctacttttaaatattgatatggggtggggtggggttaaaaataataaaattgatgtcatttactatctagtatttattgtatttatacccgccactcagttcctagggttgaaatttatactttctagacaatcagtctactatggatctataaccacagttgtctttttcctttacttttctttttgagacaggatcattttgcagttcagacaaatcttgaacttgtggtcctcttttctcagccttttgagtacttaagattatagaattttgctctggtaaaatgcatttagtgatgcattaatctaatccactgtttctcccctcatagtactgggagtagaacctagggcttcatgattattaggctatatcatcttacttgaactatgcccacataccaggccctcttgcactgttttaagtttgatgtttgagttaactttgggctttttagaaaactatatattcttatcagtattttagtgttcaaagtcagtcacttctcctgtgcttctcttcttcctctgtttctctctgtgttttttctatgtatctgacctgtggggagaaatgtaacaatatagtattaacagtctcattttcttataaaaggaggagtagtaactttcttagaagatacccatcatgttgtacatgaaaggatagttgtctgttggctttggcatttggtactgaaactccatgcagagctagggaaagcttgtttctgctgtttctagaactctgatttatccacagttcagtatgatctccgagaactctgtgccttctcagttaggattaggagcccagcccccacaagtcctagactgtgaggtttcacagtaatgacttgtgaccagctgtcttttattgtgtttcttttagccaattgtgtcacatggtaacagctctcacataggagttctgtttcctgcttagaaccgaagtggatgcaggggtcctaggtcagtggtctcaataaggtgccttgcagaaatgaacagccatgtcctgtgaccaggtctcaagtctgaaacaacgggtctaaccacaggcattgtgagacaggcacacaaagtgaacccacaaatgaagggtttcataataacagctgtcttaggcatgcaggcagtttgatgactccgtgtcttacagtgttgttcttcacaggaagtgcctgttgaaccaaacaggcaggcagaggactctggtgaccacaaagaagcaattctctgtacactacaagctgaggagggatgctctgctccaaggtaggtaaatggtggatttgggattgctgaaagttgttttaagggtgaacaactttatggaaggtgaatgctaggttaacagaataagtctgggttttgctaattgagtatgatttccatcactgagatcttaaagtttggaggagagaaaacctgtgggttctgcagccctgcccagagaagcagggcagtaatagcctttagtgttctaaaaatggctgttgtaattttctttagtgaagtgctttatggggacaaaataaatgtccagtttaaaatccttgaacaaagtacttaactgaagggatacttttactgtctggcacacagctgtgtttgtaggccatggtctcagaattgtcacaaaggattttggccaagttttctaaattgggcttatttaatgagttaacctgagctttaaaatagaagtcaattgactctccagagagaggcaagatccatgttgttacagtgtggcctgaaacaatcaattccagattgttggagtggatagctattgagctctgcgtaggataaatttgattagatgtgtacacattgtgatcttgccctttctgtggaaggggcgaaagtgaagagtgtatatttgcagatgtaatataaccctgtgttacaagggctggtggaaggatggaaatcagcatgcaccacaatcttcttgagtgatagtttttctaatgccttgtacatcctatgtggctgatgtgatatgcaaatgaaacactgacttcaaagctcaaggttccattgcagaaataaccaatttacatgaatgctctcaagagctttatgttggggtcttatttcacatgtttcccactaactgttgttagccctattcaaaagtgtcacatgtttatgtgactctgaggtgaccagattgatactctgtgtgcctccctcagaaatgcctgccattacttaacagtctgcacagctaaaccgatgcacccatgggtaagaaaggctgctgaataatccgcctacagaatttagcagtgtctgaggaggacaattagagctttattcctggattctgagtcagtcacgtgctgagcaccagctgtgcagggtagtggggtgcagcacacggctatgtatagagaatgtcaccatggacagctataatgtgcatgtggtgtgtgtgcacatgtgattatgtatgtcagtggcactgtcagagcttacagggatacgaggaagggaggaggggccctctgctttatttatcatggctgtgcctctcagctgactgcttaactactctgaagaaattagttccagtagcaatctgcttttgagttacaaacttagccgttttcagaattgcgatctcgtgatctctttctccctctccctctctccctctctctccctctctctctctccctccctcctcccctcccttcctccctccctccctctccttccctatctccctcttccacctctgtttgtgtgtgtgtgtgtgtgtaagagtggcaagccaatgaaatgtaataggaatgttaaaaattcattttcagttttttccagagattatttatacatttctggagggtcagcaagaaataatatgcttgagacattaaagaataataaaaataagggtcttacagaggtgactcattggaaccaggttcagatcctagcacccatatggcagctcacaactgtcttctgatgccctcatatagaaacacacgcaggcaaaatatcaatgaacttaaaaaaaagaataataaaagtaaaagtttataatgcagagatgtaaagatacctagtgtccctgcacaggtttaaataaacataaacatgtctctataagaaattcattattgatctgctagttgatgcttggaaataagtggttttgttgtgttttgtttagacaacacaaaaacgttgaaatagacattttctgtttactggttattcatccaaatcaagtagaaataatttttttaatttaaaattttcttaatttttgagatacaatgtcacttcacacccagaaactccctgcatagtgtagcacatgttgtcatcaccaaattcatgctgatcttcctatcttagaacttgctggggtttcagggatgaggtattacatgcagctagtaacatcttttttgtacatgtgtataagatcctgtaggacattactgtatagcaaggaaaaaaattacaagtatttatagctaaacagaaagtacataattgtacatgtttttggtggttgggggagctgcccattcagcatatgcctgtaatcccagcactcaggctgaggatggagctcataagttcaagatcaactataggctgtagagcaagaccttctctagtataaacaaacagacaaacaaaaagttacatgaaacatcagaaatcagtggaggttaaggggaaaacaaagcactgggtagccgggaaggccgatcacaaaatggtagatccagtggcatttttctcccctacatcacactcggtcttgagcagcccacctcacttgttctgactgtcttccctgttctggggatattttcctagtgattttcactgctctcagggatttcagactgaatattcaagcttattacaaccagcagggtctgtttcttgcaaatgcattcaatcactgacttgggagtcacttaaatgttcagtatgtgacttctaaaggcctatctatcgttaaaaaaagaaaaatatgttctcacaggggctagtgagatggttcacctagtaaaggaccctgccaccaagcctgtggacttgagttccatccttggaatacatatagtgaaaggagcaaccagctcctctgttgtcctctgattgtctttcatgtagactccatctacttgctatgtcctcatttgtttacattgtgggtctctctgttcctaatctctagttcttacaaggacaccaaacagattagttttgagccaccctagcgacctcatttctccttaatcaccactttaaatgtcttgtttgcttacatagttatactctgagatactgaagatataggacttcaacacattaatttgggagaggtctcaattcagttccttacagtaggagagatgcccctgctttttccatacacctttatgctagtgagttctgttcttctgcaagctttctcacactcacacgtgaagggaaagcacttacaatggagagtaataaaggagcttctgtcttatatgtggctaatggggcagcaagatggtagtcggggccttcggaaccctgtatactgcagccttattggatagctcccaactctgttctgtcattctgctttcagagttcggctttgtaagacatttttcttcttaacatcaggttaagaacatgatggctccttccttttctgtcctttcctcgaccagaaccccttttctcagtcctttggtagaaaattttgtttgaccaggtgtaattggctttctggaattcctaaaatgcttaaattctaccctttctatttttccatttcatgccacggctttctaaattagccagtcattagtagacactaaggttaaacccagccaataaggaacaggcaacccgactcccgtaccttagggagaaaagactgaaaccatctaggtgatgtgtgctgctgctattccactagctttatcctggggcagagcataccctttttgcaaaaagcaattgccatactgagttactttcattttgttcatgtattactttttgtaacataaaaattagtttttccttataccctcaaagtagatgcccattatattgtgaacaatgatgtcttctgccgattgggatagtggggagagaatgatgtcatgaatatattttcaccccattgtcctgttctctggactctccctcctcatttctgataggcaatttggaagaacaggattttaatttttcactgtttgtcagacatagtttctatatagattaggtgccaaataaatggttggtgaatgaatacactggtgaattgatagatgggtgagggaacagacagataaaccagtccttgggtagatggatacagagaagggtaggtagatggatgaatggttggacgcctgaatagatgaataggcagatagataggatgaatgagttgattatggatggatatgtcgttatgaatatagtctagggctcttcaattagattcattttccctgccagtcaaagacgtaaaatgcaagaacaatcgtgagcatgacaggtagcaacaaacgaacacaaacagaatcagcagttgaaaggcatttatttattggggatgagaaaacatgtttatgcaacagacgcacagagaaaaatgaccctttctaaagcccgggggaggagaggaatcaggaagctaaaaatccagtctgttcacaaaagagctggggatttttaaagtctctgaagagttttcctgaatgatttaaggtttgaaaacaggatagttaattggcccaattgttatgtagaatgtcctgatgctgctgtgaacttgttgaatcagtccatcagcagccaccctactggaaggaagaaagcccacaaggtcttgaaggtcaggcttttgactcaggtttggagggtgaggaggaaaccagacatcttagaagctcaccagttttaggaagtagccagggcatctctctgatggcctaccaaagagtttgtctaactcattatccctcagttaggtaaatggttgtttggattgataaatgaggggttgttgaaggcatgggtaggggatactaaacagtgaatgagcagacagaaggaagaataggtgagtagatgagtagatggcttgctgttcaatcttccttgagtccttgatcagcattccatggtagtacatgctctgtattgaaattttactaaatattactaacgtttagttaaatattagtaagtgaaatgggctttactatctgcacttgttccagagttaagacataagcatctcagaagaaatcattaaactgacttgttttctacaatcatattttaacctctataagaaaattaacatactacatttgggttttgctccttacatatgagcttctcctggaatgtgctacaaaattgggctgagatgagatctgggggtgaccaccacagctgatttgtcattgacttcaagattgtattttattgggatgggggagaaggaaagaacttactcctatagaggaacaaaactgaattcatgcgagggaaaattctttagagacattttgctgtaatataaaatgcattaaccaacaaagcaaactcactttatgttgtttgctcttgagagagaacttggtgtgtagaaattatgtgaagaccaatttcctctttagaaaaccagcttctgccaagtggattttggaagtaacagagattgattatgggagagctctaccctgtgttcatggctctagggcagatgtttattgtctctggccctcaattagctgtctggcaattgcagcctgccttttctaaaggactgtgctaggtaattatgcatccagtgctggatgggtcaggctaaaaaggtgaaacttaagcttggatgtagagggataggggagggtggacagggatgaggaagcagagcttccatttcataagaccaggcagaattctgaactgaagcactctttctgtatatgcaaacataagaccatcatcccaaaaatgaaaaacagtaactgccagaaaaagacagaggcataagactagttggttggttggttggttggttggttggttggttggtttttcggtccctccatgtagccctggctgtcctggagcttactctgtagaccaggctggactcaaattcatagagaaccacctgagattaaagatgtgtgccaccacacagggacagactttgttttcatgtctattattagtttctcttatcattgttgggacaaaatacttgaaaaagtagcttaagggagggtgtattttggttcatagttggagggtattattctcaatggtaggaaactcatgacagcaggagtgtgaggcagcttcaatttgcatccttaatcaggaatcaggagaaatgaatgctgctgcttagcttactttctccttttattctgcccatgggatggtattgcccatacatagggtggatcttctcacctcaattaacccaagctagaaatgcccttgtagacatttagttttcagagtactaaaaagtaggttctagaagcaggcagcctcttatgagtataggcaagaaagcttgactgacttttccctttgctactttctctgtatgttagctcttgtatattagaactatggaactataacgctccttaggaaagcaaaggcctgttgaggttaagctatctaataagcagctacaggaattggaactcttttttttttctttttttttttaaacagagtttctgtagaccaggctggcctcaaactgagaaatccacctgcctctgcctcccaagttctaggattaaaggcatgtgccaccactgcccagctattagttttctgttgctgtaatacaacatcatgaccaacagaaacttagaaaagaaagagttagctttggcttatggtcagagagagagaaagagagagagagagagagagagaccgagacctgaatgtctggaaacgtatggttttatggcagggccatggagctgactgaccacatctttatctaaataaggacaacagagtgaggaggaggagggagaataggatgtgggagtaaaagctgcacattgtacatcatcaaggcccaccctaggtggtttcttcttccagcaagggactaccttctaaagtaaccatcacttctcccaaatgccactaactagggatcaagtattcaaatatggagggcattttgcaaggaattggaactcttgactttccttaacacatgtaggcttggaaggtacatacatgggggcggggcatcctggatgttattatttgtttgtaagcttaccttaaatcccagtttcttaagctgtgggtcataacctcaggttgtgttacctaactgaatgtgagtcacaagactttgataagaataaaagatttctaaatatataaggaccaaaaccatattaaaagtcaaatgggtaagaaatctgaaatgtttatagcagtgttgacccatggtgtatgtatctcatgactgtgctgcagccttggttctgaacacacagcagggtatacttttcattgcacattctgtcacagtgtgcattgccagcaggctttgcttgaaataccttgactccaatttgaaagtgctacatgttatatatttgggaaggaaaacaaaggacaaagagagatgatatatgaatagggaccacggtagcctgagaagtgtctctgtcagcttttctcaagtacaaccctcagtgcttttgttttgtttttgttttgctacattgagataaagtcttgctatgtagtccatctggcttggaattcaccatgtaatcctagctagctatgagcttatagtcttcctgcctcaaccatccaaatagtggaatcccaggtacacacatcattctatctagtagaaaatgagcccttttagcctgctgggcctattactctccatattaagctgacatagattttgcagtttgtttgcatacaaacttgccaaattgttcagtggttatagactagcatacaaacagaaaataaaacaggttttaaatattctttcagattatttaattacaattaacactaaaaggtagctttacagtgatgctagtttaagaatattacttctgttcatttatcttatccatcaaatctgtcttcctacatagacacagctaatgtgaattgatgctgtgatgtttatctaatactaataattcaatcagctataaatggggagaaagaaggagagagagagaaagagaaatagagagagagaatgaatgaatatgaatgaatgaatgaataaataaataaatatttctgaagtgcagccctcacctaagtcttaatcccgtaggatggaccagggctaccttgaagactggttaggaagtatcaaaggtgggtaagcctggaagagattggaaaggaaggatatcagatacacacacacacacacaatgaggacacatttcagagtccctgaatcctataatgaataaagctggaacatttgaagcaacaaaataaaatagtgatagatatcagccaacatttagaataaattcatggtgtttacaaaactgaatgagtaaattaatacatgggcagtagacaagtctatcatgcagacaaaatgtgagtatactctactctcatgattttgatctaaagtatctcccagagttgctacactaaaaggcttggtagcaagctgatggcttttgagaagtaactagatattgagagctttaagcaagtgagttgagtactgggggatggtagaatcttttggagctgggtgtgattggtggaagcgtgtcacctgagtctatccttggctatcttatcctcagtctccctcctcctttctgcttcctgaatgctatacagtgatagcaccatttttactagaggtgctgtgatattttgaccttacttcatgtaattggccactgtgataccttgcctcactcaggctcaaagcaaagcaatggaatcagggtaatctttgattgaatctttaaaaccttgaaccaaaataaagcctttatcctttaagttaattttgtcagatattttgttacagaggggaaagtttagtatgtctatcctcaaggaggtggagcataactctgggccttcagtaatctaataacattctacagaagtatgcagactgaagagtatggagaaagcttacaaattaaccacatgtttggattgataccatagaaataagacatgttagcagtatgtaccctttgtatggtgataacaaatgataattcacctctgtagtctttacccagaaactcatagacataatctaattataaaaggagggaaaatcaaatgaataacatgttacaggtgcctgaaaaatccttagaagtataacaaataccaaaacaaagggaagtctaattatttatctcctactccattcaggacgatggagcaaaatatcttagactagaagatcaaagcttctcaccttataccatcaagaagcagaaagggaaagggtggacttaggataagatagtgtcttcaagggcacacaccccagtgtgtctagtcacagccaaaaggttctactaccgagtatttctattgttgtttgaggtgtggtctcactatgtagtcctggatggcttggatctcattctgtagaccgggctggcctcactcagaaagatcctcctgcctctgcctcctggctgtcaggattaaaaccatgtagtaccatgcagacaccactaggtatttcaaaccattctggaggctgaagcccaaggttaaggcataagcagatttggtgccttgtgagatctcattttctggcctaaagataaacattttttctctgtgttcacacataaagacactagtctgactattgagatagacacttgcatgaacttttattccccaagtgctctacctcatagttcttaagaggttaaagtcacttggttggttggttggtttttaagaaaggatttgactatagcttagattatctatgaatttacaatcttcctgcctcaacctcctctgtgtgacattgttccttgagagatgtgaacaaatgtcactcatcccagatagggatctgatgacaaaccaaagtacagatagtgccaaagtccagcttggtgaacaagtgagttttaatggggttatttacaggaacaggaaggtctcaaagacagctgcatcaccaaagcccatcgcaacatgggatgtcaacttataacaacttataaaagctggagatctggagcacactatacagtttacagacagcaagttggaaagtgtcattttcaggtagcttagtttttaagtcttttccaggcagctcagtatgtctgagagtcttctaggcagctcaactactctctgcttcttccagtcttgtctgagtcttctcagcagcctttaatgtttttatactcttgagaagaaaagagcccagtgaatgtagtcagttccagggacttcttgaagctattgagtttggtttttcacatcctgttttaacaagcttccctataggatagagtcacttcctcttagaacatgctattgtttcacccccctttttgtattctgcatcttaaagagtttccctctagtggaatgtccttacctagtaaattgctacacaacaccttcatcccgaattctgggattataagaacatatctccatgtctgcatagttatgtttttaacatacacatttgaggggagggagaaactttcagggttatagtatcatcacaaagttactatatacaatgtggtgcctgcctgggatcctggtccaggaaaggaacaataaataatacataataattagtaaaatataaaataatctataaaatataataatatgattattaatacattaatgttgaggtgcttcattagtaagtgtatcagtctcaatgtaccaatattggttgattaactagggtaaatatatatcagactgttttccatcagtacaacaaaatgactgacgtggtcaacttataaagaaaaaaggttgttttagcttatggtttcagaggtttccacctaaggctggttacattgcttttaggcctatgatgaagcagcacatcatggaagaaagacgtgatgggggaaaatccatttaattcatggtagcagagaagcagagtgggaggaagagggaactgatgtactacagtctcctttaagtatataatcctagtgacctaatttcctttctcttgtccctattacctaaagattcttccatttcatagtagtggccctcacgggaccaagcctttaaaacactatctctatgagagatacttaaatactttaaaacattatctctatgagagatacttaagattcgaatgatagtatactatatcatacaaatctgaagcttaataatagagaacacttggtctattatatggaaacttgtttcttttaagttttctgtaatttttttttttcatttgaaaatgaaatgtttttgttagggatatacccagttgatagaatacttgatcaacactttaacatgtacaacaagcctcttgggagaggaaggcaaggatggggatgtcagggaggtgacatcactgtatatgaggacatataaaaaatactatgtggacatgaaaaacactggaaagagtgtgagctttgcaatcaaaaatacaggagcaaatcttcactatgtttgtatcaggtcatccagatttagtaacctcttgtaaccctttctcttaaatttaagcatttagtgggatccaagttagtataccacagagacacccacacatcattgtccactgaagcactgttcacaatagccaagttattaagttggcctgagtatcccataaacacaatagtaaagaaaaatgtaggctggagagtatatgtattttatttggtcacaaactaaaaaatgaaatgtcatttgcagggaattagatgaaactggagatcattgtgtttagtacaataagctagatcaggaaaaacgttttttttttcctcatgtggaagctagattaaatacatatacacgtatatgtatatgacatgaaagtagtagaaaggttagtatttgtgaagattaaggataagaagggggctaaggaagataatataagataataattatatataatatatgtgtgatatattatatataattaatataatatataagataataatgagcaaactgtgatttaaatgtatgaaaatgtaaaagtgaaacccataatgctgtaaaagtgaatatatactaataaaaacgtaaatgcttaatggatataatgataatagattagcagtgtgctatattggaggctgcataataacatgttacttggtaaaatgcgcaggagactgaaataattactgtgtattgagaagagctttatggaaacaagctggaaagcaaaagccctgttggctaagcccaggactcagatgttgagggctgtctaggtgggaaggagctatgaagaaaatttgtgagggggcaatttctgtttaggaccatgccactgaggttgggggtttgtggtcagagtggaggtggggcccggagcctttaaatgcaagtcattgtgatgtgatgaattgagtgagtcgggtcagtctggttgctttgtcttcttgccccagtgcccttgcacacagaaaaagttctaaaacactttgtttgtcagttgatggattacattcctaatgagtgtgtaatcagcgtaagaatatccatcgacataaaataggctattgagtatcttctttaacttcattgtagttgtagagttggactatgtatgcctgtgatagcattgatcagagtttttaagtagaattcatgaatgacattcttgcagtgggttcttctatattttccactttaagaaaatataaaaagaaaggacacccattctccatgcctattaggggttttaaaagtagaagcctcttacagcttagtcatgggaagtgctggtaatattccctgagaccagatatactgggttttggagttgacagaaccttcataaacttgtacatcataaggcagcaggctctgatattccagctgttgccagcatgccttcgtgactccacaatgctgtaggcagcaggattctgcggtggcagaggcgggctttgggtccctgaagcacttagctgcctttgcaggctgaatgagccacagtctacagcagcaatcagggatgcaggtaagagactctagtgctccttctcagggcatcttatccccgaggggaactgttttaaaaatcacttgtgctatttgtgaggagggtgtagttcccaatgcctcttttgttctacagtcttaaagggcaggttgtttgtcagttcacaatggcgtgggtctgatctagcaagatctgcaaacattctcattgtttattgttctgtctaaagatgaaaaatcatgcaaatcagggttcagattctagatggagcactctgcaagcgtgcacacatgtgacagggggcacatttgtccatgctgcatgcatgtttaagggcacaggcagttttttcagcctgggttttttaaagctggataaaaagcacgttggaactgaaagctgtcgtccctaactggtgggactggtagcccttgctgtgtggaaaaatagctctgtgtgagttctgcacatggatgacccaagaacgcaggcaggagggatctgtgaagacttgtctgcgttgccgtttctttttcagtagccataagatgcaggcattctcactcctgagacactgagtgtggacactgaaagaaatggtgagttagccacatccaaactggggggtggtggggttgtaaaaccaggtgtgcatgcttggtcatgcaaatgatccatgtgtacattcacagagcttgctaactgcagtgaaaaaactctataaggagaaaatggaatctctgtggcttttaatattttagttcttataatttattgttttgatcatgataatgttctttctttaaatgtgttagtgtacatgtgcttgcatttttcattcttcctctttcattgtgattaaaaatgcaggttattgttttgggccatgttgctaaatgatgaattgcctttgctgcaggcaaggaagctttttgcatgtgtagaaggaatgccattttcacagggaaactgctgcatagctgtctctgtacacacatacatacactatctgagtctgtattcactgactcatgggagtaggtgtcatcttgaattgcacatttaggcattggttgtgccagtgcagaggcaaaaaaaaaaaaaaaaaaaaaaaaggaggaggaggaaaggcaaattaaggaaaggttttccagaatctggtagcactataactaaatagcttgctgtctaccagctacattttttaaatgattggaaaataattttcaagcataaaatactggaacaaatttgaatggttggcatattttctggttgaagtagatataagtatttttgatgatttttgtcattttgtggtagaaaaagggactagtcaatatattttatatatagtaggaaaatattttatgtgtaaatatacgtgcacatgctcacacatatacacacccacatgtgcctctgtcttaaggagaaagtttacaggggcattcttattcattaacgcatacacaaaggtcttttttctacattatggaaataatcacaagtgtgtgtcaactagatgggttacagaaggcttctgctacccagctgcagtgacaaatgacatagtaaaagcctgttaactgctgcatgctttgcatagactggccactcccccaaagtctgactttggatgctggaggttggggaaggtaataatttatatgcccttttagaatgtatttatatggttcttactattttagatctctgttggggggggggagacggagggaaggaaggaaggaagatagatgtatcatggttggggaaccataggaaaaaaactggcattttatgtctaccttgagctatccatctttccctttcttggacattagaggttttacctggcttctttctgctagagcaagttaacagtcagatcactgatagaattgtagacatttctggatgtctaaagagattcagaatctatttaattacttaccctttttacccccgcccctttaaaataaatgtttagatagggtgggaagatagttcaaattaatataaaaaattaaagagagaaaattaaaatcatccttaatctccttacccagtgattccactgtagaacatgaaagtgtgtgtgctttgaagtcttgttttagcacgaatatatattttatatacccagtcattctccacatggtatatgcagactgcctttaaaaatacaaaaagattttatatgtattatgcatggtattctaagatatgaaaaatctgtcttacagtatagatatttaaagctgcttctggccattcacaattataaataatactttagtagacatattgtactgagagagtcatacccttccatgtgggttgtcttaaggcatgatagatacatatttaggagataccaccttgtggatctatgaagtgtatccttgctatttatgcctcactcaccagccatctaggaagttctgtttttctcacaattttaccaatattaagcattaatttggaattgtggattatttttttccaattttttaattaggtattttttcctttacatttcaaatgatatcccgaaagtcccccataccctcccctgaccccactcccctacccacctactcccacttcttggccctggtgttcccctgtacctgggcatataaagttagcaagaccaagggacctctcttcctaatgatggccgactaggccattttctgctacatatgcagctagagacatgagctctgggggtactggttagttcatattgttgttccacctataagcagaccccttgagctccttgggtactttctctagctcctccattgggggccctgtgttccatccaatagctgactgtgagtatccacttctgtgtttgccaggcaccagcatagcctcacaagagacagctatatcagagtcctttaagcaaaatcttgctggcatatgcaatggtgtctgcgtttggagtctgattatgggatggatccccaagtgcagcagtctttagatggtccatcctttaatctgtctctgcaactcctttcatgggtgttttgttcccaattctaagaaggggcgaagtgtccacactttggtcttcattcttcttgagtttcatgtgctttccaaattgtatcttatgtattctaagtttctgggctaatatccacttatcagtgagtacatatcatgtgagttcttttgtgattgggttacctcactcaggatgataccctccagatccatccatttgcctaggaatttcataatttcatatttttaatagctgggtagtactccattatgtaaatgtaccacattttctgtatccattcttcttttttttgtttttttttttgtttttcaataattttatttttttctaattttgtaattttaatttcccatagcaccttggcaatgttgaaaacaatacaaatacaaagatgctcgttttaacagtttatgcatgaatatgtgtcacacaatttggggggggcagtccattcttcttttgaggggcatctgggttctttccagcttctggctataataaataaggccgctaagaacattgtggagcatgtgttcttattaccagttgggacatcttctggatatatgcccaggagaggtattgtgggatccttgggtagtactatgtccaattttctgaggaaccgccagactgctttccagagtggttgtacaagcttgcaatcccaccaacaatggaggagtatatctctttcttcacatcctcgccagtatcttctgtcacctgaatttttgatcttagccattctgactggtgtgaggtgtgatctcagggttgttttgatttgcatttccctgatgattaagaatgttgaatgttgtttcaggtgcttctcagccattcggtattcctcaggtgagaattctttgtttagctctgagccccattttttgatggggttatttgattttctgtagtccaccttcttgaggtctttatatataatatattagatattagacccctatctaatttaggattggtaaagatcctttcccaatctgttggtggtctttttgtcttattgacagtgtcttttgccttacaaaagctttgcaattttatgtggtcccatttgtggattctcgatcttacagcacaagccacttttgttctattcaggaatttttcccctgtgcccatatcttcaaggtttttcccccactttctcttctgtaagtttcagtgtctctggttttatgtggagttccttgatccacttagacttgaccttagtataaggaaataagaatggatcaattctcattcttctaaatgatactgcaagttgtgctagcaccattggttgaaaatgctgtcttttttccactggatggttttagctcccttgtcaaagatcaagtgaccataggtgtgtgggttcatttctgggtcttcaattctattccattggtctacctgtctgtcgctataccagtaccatgcatgcagtttttatcacaattgctctgtagtacagcttaatgtcaggcatggtgattcctccgagtttatttatcattgagaagagtttttgctatcctaggttttttgttattccagatgaatttgcaatttgccctttctatttccttgaagaattgagttgggattttgatgggggttgcattgaatttgtatattgcttttggcaagatagcaatttttactatattgatcctgccaatccatgagcatgggagatcccaatccatgagcatgggagatctttccatcttctgagatcttctttcatttctttcttcagagacttgaggttcttatcatatagatctttaacttccttagagtcacaccaagatattttatattatttgtgactattgtgaagagtgttgtttccctaatttctttctcagcctgtttatcctttgtgtagagaaaggccattgacttgtttgagttaattttatatccagctacttcattgaagctgtttatcaggcttgggagttctctggtggaatttttagggtcacttatatatactatcacaacatctgcaaatagtgatattttaacttcttcctttccaatttgtatccccttgacctccttttgttgttgaattgctctggctaggacttcaaatactatgttaaataggtagagagaaagtagggagccttgtctagtccctgattttagtgggattgcttccagcttctcaccatttactttgatgttggctactggtttgctgtagatttcttttattatgtttaggtatgggccttgaattcctgatctttccaagacttttatcatgaatggttgttggattttgtcaaatgctttctcagcatgtaacaagatgatcatgtggtttttttctttgagtttgtttatatagtgaattacgttgatggatttctgtatattaaatcatccctgcatccctgggatgaagcctacttggtcaggatggatgattgttttgatgtgttcttcgattcggttagcgagaattttattgagtatttttgcatcaatactcaagggaaattggtctgaagttctctatctttgttgggtttttatgtggtttaggtatcagagtaattgtggcttcataggatgaattgggtagagtaccttctgtttctattttgtggaatagtttgtgaagagttggaatttggtcttctttgaaggtctgatagaactctgcactaaacccatctggtcctgggctttttttggttgggagactattaatgactgcttgtatttctttaggggatataggactgtttagatcattaacctgatcctgattcaactttggtacctggtatctgtctagaaatttgtccatttcatcctgattttccatttttgttgagtatagccttttgtagaaggatctgatggtgttttggatttctttaggacctgttgttatgtctcccttttcatttctgattttgttaattaggatgctgtccctgtgccctctagtgagtctggctaaaggtttatctatcttattgattttctcaaagaaccaactcctcatttggttgattctttgaatagttctttttgtttccacttggttgatttcgcccctgagtttgattgttccctgcagtctactcctcttgggtgaatttgcttcctttttttctagagcttttaggtgtgttgtcaagctgctagtgtgtgctctctctagtttctttttggaggcactcaaagctatgagttttcctcttagaaatgcttttattgtgtcccataggtttgggtatgttgtggcttcattttcattaaactctaaaacgtctttaatttctttctttatttcttccttgaccaaggtatcattgagaagagtgttgttcagtttccaggtgaatgttggctttctattatttatgttgttattgaagatcagccttatttcattgtgatctgataggttgcatgggataatttcaatatttttgtatctgttgaggcctgttttgtgatcaattatatagtcagttttggcgaaggtaccatgaggtgctgagaaggtatatccttttgttttaggataaaatgttctgtacatatctgttaaatccatttgttctaacttctgtttgtttcactgtgtccctattcagtttttgtttgcaggatctgtccattcatgaaagtggggtgttgaagtctcccactattattgtgtgaggtgcaatgtgtgctttgagcttactaaattttctttaatgaatgttgctgcccttgcatttggagcatagatgttcagaattgagagttcctcttggaaggttttacctttgatgtgcatgaagtgtccctcgctgtttttgataactttgtgttagaagttgattttcttcgacattagaatggctactccagcttgtttcttcagaccgtttgcttggaacattgttttccagcctttcactctgaggtagtgtctgtctttttccatgagatgggtttcctgtaagaagcaaaatgttgggtcttgtttgtgtagccagtctgttagtctatgtctttttattggggaattgagtccattgatattaagagatattaaggaaaagtaattgttgcttcctattatttttgttgttagagttggcattctgttcttgtgcctgtcttcttttaggtttgttgaaggattactttcttcctttttctagggcgtagtttccgtccttgtattggtttttttctgttattctttgaagggctggattcatggaaagatattgtgtgaatttgcttttgtcatggagtactttggtttctccatctatggtaattgaaagtttggctgggtatattagcttgggctgacatttgtgttctcttagtgtctgtataacatctgtccaggatcttctggctttcatagtctctggtgaaaagtctgatgtaattctaataggcttgcctttatatgttacttgacctttttcccttactgcttttaatattccatctgtatttagtgcgtttgttgttctgattataatgtgttgggaggaatttcttttctggtccagtctatttggagttttgtaggtttcttgtatatttaatggcatctctttctttaggtttgggaaatttttttctataatgctgttgaagatatttgctagccctttaagttttaaatcttcattctcatctactcctattatccgtaggtttggtcttctcattgtgtcctggatttcctggatgttttgacttaggttctttttgcattttgtattttctttgattgttgtgtgtatgttccctatggaatcttctgcacctgagattctctcttctatctcctgtattctgttgctgattctcgtatctatggttcctgatttctttcctagggtttctatctccagagttgtacccctttgggttttctttattgtttctacttccatttttagatcctggatggttttgttcaattccatcacctgtttggtccatcacctatttgaaagtgttttcctgtaactctctaaggcatttttgtgtttcctctttaaaggcttttagctgtttacctgtgttttcctgtatttccttcttaatgtcctccatcatcatcatcataatcatcatcataagaagtgactctagatccatgtcttgcatttctggtgtgatggtgtatccaggacttgctatggttggagagtttggttctgatgatgcccagtaaccttggtttttgttgtttctgttcttatgcttgcctcctgccatctgattatttcaagtatttgctgtcctctgattggagcctgtccttcctataatcccagttgattcaggactcctcagagtccagctttctctgtgatcctttgcttgtgggctcctgtgaacctgagattatgggtgtgccagagttcttggcagtgaagttcctctgagaccctggaatactggtgtgaccaagctccttttatcctgggatcctgttgtcaaaggtcctgggcgttttacagtgcctggggtgtgttgtcttctttgaggagtgtggagctgtctggtcagtgttcctaagatggcatggagagtcctctagggaccatggggatgtcctccaattccgcgcccaaggtgaccaagtgatggtgttgaccggaagggacttgtgcccctggtcagaccggttttctgcttccctaatgctgtctcaggtcctgcctgcgcgattggattggaacagaagttgcattccacacacaagtggtcctaagatctcgtggagagtcctctagggactgtgggggtgtccgtcgactccctgcccaaggttacccggtactgacgctgaccggaagggcaattctgtggtttattaagtaacccatttttaacatgtatttcttaggggcttgagaaaggcaatgttctttcatatatttactgatttttttttattcattactgttcacattcctattaaaagtggtccttccttaatcatcgtcatgtaggttacaatgcatttgtgtagtatggtgcatacttttcacacatttacagttggtttgggttaaattatttctaatcctaacctcttgttattgaatcctcttgttatggcccacatttggctactctgaattaccagttctgtgttttagcagccaccagcttttagcaactatgtgtttttgttgccagggtttagttaccaattgcatggcattacatgcaaccgtctacagttctgtcaattctgaaatggttttcaatgctttgcaaagaagaaagagtggctaaggatgatgtgttatgttgtattgtaagagaaatggagaactcagaagacagatgtaaatcctagcttaaaacaagttgttgcttctggtagggcttgctgactgtttgtaggagattggagtgctcaagaattagaggacagtgccatgtcctatgtactcagctatgttcttagtctgcaaagtatttggaaattgaattggctattatgaggactttagaaatgtttgtgatcctaacatttgtagttgttaaggtagaaggactctgagttcaatgccagagtgagctacatattaagatgctgtctcaaacaaagaaatgaaaattggaagagtgattcaagcttgatctgaatattatgatcttcactcattacctccatagttgattctggtctgtttgcgtcacatagttacccaatataccgcaaataagctaactggatccttgctccaggcatgctcctgattcttgaatattaaattaagataaacaatatattacatgtaggatgaagtcactagatatatactcctctttctgactcaaatggtaggtctccaactgattttgctataacctatgaccatatttctactagtaaatctctcagtaaattgtattgtgtgcagtcttggattttttcagcctttttttttctttttcctaaaatatatgtaaatgaatgttttgcctgactgtatgcatgcatgcatgcttgtatttttatatatgtatgtgttagattccctagaactctggttacagatgtttgtgaaccaccatgtagaggctggaaatcaaatctaggtcctgtgcaagagcaacaagtactcttcatcactgagccatctttccagcccctgtctgtttttctcccataggtctcacagtattttggggcaggttttcacaggaccaaattctttcagagcagtatattctgaaaaaactcagtttatataccatgtaacacaccagtaatttaatacccatattttttcttaatgaaagtgacatgccaagccaaggattaaaatttgtagtttgctaatccctgttatacataacaaggcatatgctaaatttttaaaatcacaagtggcctgacctagcattgccaagcctttagtctcagctacttgggaagctcaggcaggaaaatctaaatccatgtccaggttgggcaatttatgtgaaaataaaaagtataaggttggaaatgtagctcagtggtagagtggttgttttataggcccgaggcctcagtttttgcagttcccagtattgtcaaaggtgaaataacagtaacaacagagtgtatataagtgctcattttaataaacattgtgaaggatataaggagaatgttaaggctagtgatataccccaattggttggtaaagcctagcatccagtaagccctaggttcaatcccagtactacataaactgggcattatggtgcacacctgaattccaccattcaggagatagaagcaggagaatcagaagtccagggctgtctttggctatatagttagctcaagatcagcttgagacacatgagatcctacctcaagagaagtagggagggaggggacaggtggagagaaggatgaagagagagaaagaatatgtatatgagaatgccaggaaaggagacagaagagtttatgtagtggagggtgtaatgaggttttaaaaacaaagtttcctggcctctttaaatgtgaggcaatgttgctacacctaagtggagctccacagatttcatttcaaagagatatcctggcccagggctcagaaagttgttctgactcttggaatatgggtagattccccctagacctagtgccagggaactttcagtgtcaccatttttatagataatgattattttttttggaagggacattccgagccaagaataaaaatgcctggaatatagcttttgatacccacatacatgtaataggtagaaaagtgggagagaaggaatttgggaagggaagttttgcaaaacagattcttaatgttttcttcacatccaaattgcttggaaggctggttttgaaatagatttagaggcatgtcatccttcactattcaaccctctgccagggccttctgactaactttaagaagagcccagtttcttgctacatcaaatcttgggaccacgtatgaagggatggagccacagaaatgagaaaggccttgccacagattctcagaataaatgttgtaagagcatacatagatccctgggatagttgagcagcagttagagagtatactctctcaagttcaggccactgtgcttgtgtacatgtatttgtgtgcttgtagagtccagaagtctgtatcagtagctttcttgatcattctccaccttattttttgagacagtctcttaacttaaaactcatcaatataattcatctggcaggccaattgagcttcaggacatcctcttgtctccaatacctgccccagcattagggttactatacacacataccactatacccagcttttacatagatgctggtgatccaaactcaagtcctcatgcttgcacagcagacatttccccagcccactcccccatttaaaaattactgaatactattaaaaagtcagtgcctgttaatttgggtttgcatcatctttgagtgaaatttctctttaaatatgtcttctcccctatccacttaaccacaaatgatttatccttttttccaattcaacttcactattacttggcatctgcgtctctgtaagctaaaatgaagtcccaaggaaactgcaaaccttttttatccatctgtgaagacattgaagaaataaaactcatctggttttctaaattgcttttcccacatggcatgaaaaacacagggcggcatagagagaaaagctttagctaggaggaattatagtaaacacatgaccaatgtcaggatgcttctgggcttgtgttctccccaaagtacatccagcaacacacaagactttgacaactgggtatggtagtgtatatttgctatctcaactactcaagttcaagcaggctttcatgggccatgtggaaagtttgagctcaatcttggctgcatagtgagaccttgtcttaagtacatcttccctagatccccaaagaaaaacacaggaagctgttcaataaaaagatccatatgttttaacaaaacttgcagaaatagttctcttccttagcatcataagcataatatgtctgttactttagcaactacaggttaatcattcacaaacctaaaatctgaaattctcttgagtcagaaacggtgcctacatattgccacaaaaagacaaatttctacatttgacctcacattatactctgatgagttgcagccaaaatgcaggtacactaaaaataatatattaaaattatctttcggggctggagagatggctcagtggttaagaacactgactgctcttctgaaggtcctgagttcaaatcccagcaaccacatggtgggctcacaaccatctgtaatgagatctgatgccctcttctggtgcatctgaagacagctacagtgtacttagatataataataaataaatctttaaaaattatctttcatatatatatatgcatatatatatatgaaacatgtaaaatgtaaatgtgtatctataaatataagtacatggcataagttagaattactgcattcgtgcttataattaagttccatataattaggttcattcacacacacacacacacacacacatatatatatatgtatgtatatatataatatgtatatatacatgaaaatagtccaaaaagtcttttaattccaaattcaaatacttcttcccccaaacatttgaaataatagatactcaaccatgttgtttccatccctggaaattggacagtcagaggataatcagacagtccctcttctacagctgcttatgctttaggacgtctgatgattaattggcatttctaaccagtatcattattcttaaatgttcatgctctttaaatgtttctgatgaactctgtgcctttgttgattggtcagttggttaactgattgcctctttggtgctctagtgacatatctcactgtctcatttcccacttcattcgacagttatgagatgctgtgttgatggaagagcttcctgcttgtacttggacaaggaatttatgtgactgctaagaagtatcaggaatgtgggaagggtggttagaaataccaagagctcaccatgaggtctcatgtaccagacttatatatggaatgacttgggtgtcctatctcttagctgtctgacttctatacacagatctagctgatatatccctctgtagggcagattagttatctatgattgataatgaataagtctactctttctcaaatcacttttctctataccaacaaccagaggagatgccacattcaaactgtaaatgtgaaactaaagagaacatgggacttaagtgatgttgacatttccccttcctggaaacgcagctgtttccaaggcagagattctgggttccagtctagttgttctatgagttaattgggcacttcacaaaccaactgggcagctagctctcaagtgtgattctcaggccacagtgcagaactgctcctattcattgattgctctctctctctctccctctccctctccctctctctctctctctctctctctctctctctctctctctgtgtgtgtgtgtgtaggtaggtagagggtgtgtgtttataatagaagtatatgccacatcacatatgtgaaggtcagaagacaaccttagatagtagtcctcacctccttgttgtaagcaggaactcttattgtttcactgttgcacataccaggtaactggcatacaaacttagaaattctcctgttctcggcctcccacctcaacatggaagcaatggaattattggttctcagcacttacactgcaattgccttagtcactgagccacctcttcagcgtatattgctattctcgacaatatataaatatgcgtaaggcatgttagcattttgcatcatgctttaatgaaaggaggaaatatctcagtgtcatagttatttttctattgttgtaccaaaacaccatgaccaaggcaacctattaaaggaggtatttaattatggtttcagggggttagagtccatgatagtgaaacataagcatggcagcaggaacatctcaaaactcacatcttcatctgcaattaggaagcagagagagaacacactgggaatggcacttgtcttttgaaacctcaaagcttgcccccagtgacacaccttcttcaacaaggtcatatctcctaaggcctgggggggcattcttattcaaactaccacactcagtgttatcatctattgaaagtttgttctgtcatagcccagagttctattggtagccttgatgtttataaatcactgagtggctggcttggcctcttgggggaatgcccttcctaattcagaaggcgaggctgttctgcctgagttttttatattctgcctaggttgtgtgatttgtgtcttagcagttgtatggtgattttgtcatggagtacaatggacagaccatctgttgttgaatgtgtcttagatgcatggctcagaggaattccacccaaatcctcccattatgctgtgggatctctgtgcctcgatgcttacagcttcccagctatggtttgaatctgacatgcctcctatagactcatggtttgaattgttcaatcactgctcatagcacaattttgatggttgtggagcctagctggtagaaatagggatgaaggttattcctgccccttatccttattctggcctgctttctctgcttcctgttccactaagatatgaaaaggctccatcatatgttcccactgtcgtcgaactacttcaccatgtcatcttcagctatgatgaagtgcacaggtggcttgcttctgtgctttctcgcagaagttccctcttcctccaccacctgctccttcctactataaccacaaagcttcctccccctttctggccgctcctgagagaacttgaggagccacaggtaccagcttgagtaagatggatgacagcctccctcgcctctgtgacactgaggttagcattcttccctgataactggctgggcacttccaggtgcagctggtgcctgtccttggaaaaaggagattagggtcccacatttgaatcatggaagagaggtgatcagaagccacagacagttgtggccggtcataaaactagtccccataaagacactccttaggtcggaagtatccccctctcagcctcaattccaccctaccaagtggtatcgtgtttgaattatgacttgcctcatccacctcccctaccaagtattcaaagaatctctaactatgctgtatataagcatcaagccttccaagcttgtggttgtactcctgtcctacgctgtgggaaggtctgtgatctgagtctgacttgaaaagacgattgcatcggactctgcagtttttaaactctcctgggtttcctgcagaatcgtggcataataatggactgaaatgcctccgaaaccaggagtccaaagaaagctttctttctatgttttattgggtattttattacagtaacaagaaaagtgagtaatgtacacctatgtgacacagtatagcctgtgatgaccatgaatctgaaaggatataaagcatcctcaggtttgtttactggttagataacaccaggctggttataccatggattatgatttgaagtatctgccagcaaaatccctaggatacatgagactcatattttactaaggcctcatacgctatgccattgatagagcaataactgaccatgaatccgagtcctgttcctgtcattgacaacaaaatccaaaaatggatggaaaagactctatagtgtttgcttattaacacatctaaaagaattggacaatttccccatcatcctctataaaggtgatataaactccattagcaaacagtggtgaattaattagtgacgatagagcagtaaaacaaatgtttatctagattgtccatacataaagttatttcaccaaagacttagctgtttgcatcttgaaaaagtacctaccacccctctgtgtatataacattcttcacattgactaaaagtgagtgatagcaacaagtgtacttatatatataattggttgccttttagacactgaagaaaacaggttataggtctccacacacaggagcacaggctgagtagaaatgaactgtaaggtcactttagagtcccatgctagggtgggacatgaagattgtaatagggttggcatgtagtaagaagacaggtatgcccaagatctgactacagggagcagagaacacaaactgagagcatggaacccagatccctcagctgctgtagtgagcagatagagtctggaagtaaaacagccattcctcatatgcagaaacttcccattgaggtctgaggttgcttgtctccagagcaggatctgatatgtcaatttaaataatagtggagttaacaagatttctagaatttttgtctgttttctcccattggtgttgtgaccatgctataccagaacagacacatctgtacctttctatggtgccaccacaaagtatgtcatcagttttattagcaggaatttgccaagtatcttaatcagcattacgagtgtctgtgggaatgagtatattatgatgagctctgttgaaggtttgctgtgagtcaagctgtagaattcacaggcttgggtggagtttagctgcaaaaatgaggagtgagactgtgaaggccatagaagtaggcctagacagaagaatatatgcacaaatggagggcagatccagacagacaaacaagtagagtgacatgggatatatgtacatgacatagccacttatacacagccacacatatacatgtataacatacaacacagtaaggatgcatagcacagcacacatacacatctgccatacatacaccactggcacacatgtacatttacatatctgcacagatgacatatatagcatatacagtttacatctatttataaatatgcctatattcaaacatatcacagatataccatactagactctgtgtgtattatatatctcttagataccattaaaaacatagatttgaatttggttttgacagaactccaaattgctacattttagtccttttttattgtatatatttgtgacctggtttaatagattcttactaactgcgacagttcaaattagttggtgattctataatgttgattctgaaagcttgagctggaaaaggaccaagagaaaaagaggacagttgtgagtgactaatgtgagtgactaataatgcatacattttagcaacaaattggagttcatttgattctggttatataatacagtgactatttatccaataatactaagtactaggatcttttgactgggagcatggctactacatttcaggaactgcagggtaagcagttcatgtatattccaacttttttgaaatgacacaggtgacgggaatcaaaatgacctttacctaaagccctggtttatctcccagttcccacacagctcaatctacatgtgcatagttcttgtcctttgttttctctttatataaatttggatggtgctatgagcaaggcagagacatactgagaatttctttttccctgaatttggccagaaatgtaatcaattcattttccatatatatattatatataatgaatgatggtgtgtgtatactgattcaggtgaaagttcagaaagaactaagctttatggctaggagtggcactaataggagttttgcaacaaaaacagctgttaaactaggtattgttccctaaactatccactatgctgcttaagatactttggtgaaacttcaaactagaagcttctgtgaacgtctgtatactacaaatagaaaatggcacttctttgagtcttgtttttttgctctggtaagtttagtagttttgttgaagtttgttttctaaacagtctttaatctcctgagcaataacacaagtgtgcctggcctcctaaatggctcatgagaacctaagtggtttgtttttcttggtgatatcagggaaattggggtccccttataataaaagaattaagaatggactcaaacataagcttgaggacaatttcattagagtttaaaagaaccccagggtaggcaagctgtaaacttaagcagctttgcagaagggagagagtggaggagagaaagaagaagcaacactgattgagttaagccagtatagaggttcaaccatatggtggggaacagagctttatagaaagaatgaaaagaggggtgggatgtagcttagttggtttctgcctaaaaagaatgaaaaagtcaaaagtattagggaaagtatatttaggcattggccagcattgaaaagaaaagacaaacagcaaaagaaaaagttaaacctttctaagtcaggccgacgcttgtagggactacactggggagcaggaattcagggaagcaaaagtacattatctaattaaaaagctattctttctatcatttttagcaggatttgaagatgaacccaccctcttgagggatggttccttagctaggtcaataacctgtctaggaatgttaaatctctgcacaggccagagatttcatcctctctaccagaggaaataatttcctctgagcctttattgctgctatgtcattaggatatcagtttctagctccattgctagtggagtttaactacttctatttgcagggatacagggcagcagagaggcattggttctgctctattctggaacatgttaacccaggaagggaccttcccctcccatctccccaggacacaacagggttatccacaagacagggcactgacatgatagccctgcagatcccacctgtaacactgatattatatatcatgtgcaggttgtaacaagtgcagaacctcaagtactctaggtatgaaacagggatgggttcctcttctcaatgactaggatatatcctctcaatgctacttatatatgtgctgtgcttgtctgagtcagtagcaaagttttcttggtagtatgctctacccctacccccactcccaccaaccaacctctgagtcaaacttagggctttgacacgttaggcgagcattcaaccactgagctatatactctatccctcaaaaatcaactgattgttcttgaaacaactcactttgtagcctaggcttgcttttaactaggtgcattcctttcactttggcctcccaaatacagggattatatgaaacaccatgcccagcccagaagtcaatcttagattgagaattgctcttttccttaaatcagaggttcgtttttctccttgggctttgtttggtgtagtatgttggcagaggcactacactctgagttgttttaagtttgctggtagttaatgcataggctttaataatggcatagacaattatacatccacaccagcttctatctgtgtgtcatgggcaggcctatgtgtatatgtgcatgttcatgtgatatgatagtataagggaaaactctgtaactcatagctgcttccaataagcagttgtctttctcattttgcatgtctaattttaaggtttttatgattgaattgattcttggcacatcttagaaaggccctgtgtatatgagcatttcccataagtcatgtaaaaatattacaacttgaagtaaatagtcccaaatatatgtggatctgacaattttcacaaaaacatgatttttctttttaagagagggtatttattttaggtatttattttattttagggggttattaaagaaatgtagttgatatatatacgtgtgtgtgtgtatgtgtgtgtgtgtgtgtgtgtgtgtgtgtaccaggtttgtgtatatgtgtcattaatgcctcatatattccttatataacatgtttcacatatagcctaacatttaacatatgttacagatcacaagtggcagtgagcacaggtgttaaaaaaatatgtagtccttaaagtgatccaagagaaaagatcctaattggaatttttgcctaatttttattccatcatcttctagacaagctgatgccctgtgttaggaagttagtctgagaacactgcaggagctactgaaacaactcaaaggccaatcccatattgcctgaattgtcccactccaagaaagacccagagctccctcctgtggagctctaatctaatctgtggagcctggactaatctgggactctacctcgagagtatacatactcagaggagtacacactggtgactcgggaccccaagtccaggattcccccttcaccccctgcctgctcagaaacacactttgtggctaatgagcatgaccctgtaccctaaagaggccttgattgcctaatcttgagcccaggaagtactagggcctagacagtacatcttcacctgtggctttacttgtggctgtccacaagtccttaccaacatcatttactgagtccgtggatgtatatatgtgatttgactgtccctctctcacagctcctctgtgctcagcagtgcccagccgcaagacagccagcatgtgaatgaagacacaactttccctcaaccagaaacccagctctcttccaagtgtcaacacctacagacgtcagccatggaaacttctcgctccccttcgcctcagtttgccccacagaagctgacagataaacctcccctgcttatccatgaagacaactcagcaaggtattgtcttatgacagcatgctctgtatatatcccatgcaggcttcgagtgtttgttgctggagcattgctgcagcttcaagcactggggtaaaactcagtcacggaaaattgtgtggaggatgaacacagctcaatcgaccagttgtgatttagtg

SEQ ID NO: 116 - DNA, 34495 bp, mus musculus
tcccgccccctggcggcacagccctaccccgggcagcgcagccccgcccttcctgcagtgaggccctccctatcccgggccctcttgtggcgtcacctagaaggtgggaaccaagattcagtccggcgcggttgccggtgtttggaggtgtcctcacgctcacgctcttctgctaccggtttgtctctacccgggaggaccttggttgtccacccgtgggtaggcagtggagtgccatgaagcgggcagcgatacggtaggtggcagggcgtggaagggcgctgccccggagtgcccacgccttcccctttgaggctcggagcctagcggggcggaagaagccgcgggtgggatgggggtggtggatatttggcttgggaggaaaaggcacccagtgccagaccccgtcctccggcctaccctggaaaaatgccaccaccctactttagcgacagctgacacttttaaaagggaagacgttgggtgttcccttgaaattcctatccttttgctcaccaggggtgtggctggaatcttggtgtagccccttttttcaaaagccagtactttcagttctgccttgccttgcgagcacttttctcttaaaaaaaaaaaaaacattttgggggttaagtgcatgacacacttggaatctgtcttaagtatgttatcatacttgtaaagactgtagagaccatttggctctcttaagctgattcatctgtttggtttaattttatttagatctattttttattattttatgtatgaacatttctcttgcatgtgtgtctgtgtcccacatgcctgcctggtgcttgagaaggtggtgagcctccatctgggtgctgggaatcaggtctttttgcaacaagtgctcttaaccactgagccaactctccaaccccttgtttgttaatttactcttttttttttttttctgagacagggtttctctgtgaatctttggctctcctggaattcactgtatgtagacccaactcatctcaaaatcagagatctgcctgcctctgcctccccagtgctgggattaaacacatatcaacatcctgtttgtttttgagatagaatttactgtgtaaccttggctggcctaaagttggctatctatatatatcgatatctatctctttctttatctatatcatcaaccagactggcctcgaactcaccatatatctaccgtcctatgcttctccagtgctggcctgaagagcttgagccaccacttccagctcttatctgtatatttatttattgctttgagatctctagccaagaaaccaggtaatactagcaggcctcggacccatgtcaagtctgtcaggtttcaacttttctagtgctgggatttacagatgtattttctcgtgcccagtttagaacatgcctttgataagcagcaaggccttgtaatgaaagtgcacccttggaccacataggccattttggtagatctaatttccaactggcacagttaaggagcatggtctttaggctgccagtcatgtctggctgtcccacagtatgcaaggtttttttttgttgttgttttttttgtttttgttttgttttgttttgttttgttttttccagcttgcctggttccaagagaatggcacttgctttggattcagaagccatcccactattggtgagcctgactttgacatgggtctcactaattctgtccttggtctgcctttactttttctaggacccttgctgtcagttgaacaaggtgtgttatctccctacccaccagcacccaagccttattacactatttgaagacaggttgaaagtcattaaaagacggcatggttacctttcaacataatacgaaagggttcaacacttttgtaactttgcctgtgtgtcttcttcgataagaccttttaaaaagtgttgaaaatgtttatttttatatgtgttagtgttttgcctgtatgtatgtatgtatgtatgtatgtatgtatgtatgtgttccatcagcatggctggtgccagtgggggccagaagagggcatcacctcctctggaactgaagtatcaggtttatgagcaaccatgtgagtgctagaaaccaaacccaagccctctactagagtaagaagtagtcttaactggactggagagttggctttgtggctaagggtagtggctgctcttctagagtacccaggtttgagtactccagttataggagttctgactccctctttggacctttacaggcacagacatgcatggaggcagaacactgagacacataataataaaatctcaaaggagtttttttttttaataaacagttttaatccttgagctcctctctcccccagtttggaagtccgtccttaaagtactctgtaattttgtgttcctttcttgtgagtcctctagaacctgaataggagcagcaatccctatataatgtgtgtgtatgtgtatatatatatatatacatatatatatatatatatgcatatatatatgaaaaattggagagatgtttgggtagaaatgcttgctatgcatataaagtatatatatatatgtatatagtatatatgtgtatgtatatgtgtgtgtggatatatatatatatatatatatatatatatatatatatatatatatggtatagagtgttatttggtgtttgcttgtgtagctttttctcagacgcacacaagtcatcccacttgatttagtctgcatgttgaggtatttcctctgagtagtgggggtatgcctagtctttcttgtgctgttgtagctgcagggccttgcacatcctaagcaagtcttctaccaagctgatacccctccaacctctgataatggggtaacatttttttcttgccattttctccatatttggaacctaggatggagccaagctgtttcttttcacaacttcaggtgactctgtggctccctaggcaggccatgaagagattgagattcttgggcctctttcactagaaaggttcaatcttggggttctgtggcctgagaatcctaaaggcccacggcagtttcctccccctatcctagggattgtggtgagctgctctgtgagattattggaaataaggaagctagtaaagtaattgtgatgtactgcttcatcacctaccagtgctctgaacacagtctgttaggagtttttgtcattatgcaacatcacagagtggacttacacaaactcagatgacatagcctagaccaaatgataaaactaacagctcctcagctgggaacctatagcgtagtactatgttgaatagtgtgtgctattgtaacatattggtaagttatttctatgtctaaaacaaacaaacaaacaaacaaacaaaaagatagagtagtaatttgctataaaataaagaagggtgcatttctttaccattaacagagcttatgggactagaagttgttctagatgagtcagcttaaaacacaaatatattgtatagctgttaaaactctattcttcttcaaatcactgttctataagtgttcaaggtttaagggactagagagatggctgtgtggctaagagcacttgttgctcttccagaggacctgagtttggacctcatacctgtttcaaacagctcacagccacctgtaactccagctcagcagagtcattgccccacaggacatcctccctcccacacatacatgtgcaaatacctacatacagatgcatacatacctcagcctctcaagtgctctgattgcaagcatgtgccaccacccttgagtttatgtgtgttagaaatggaacccagggcctcaagcatactgggcaagcactcaaccaactcagctatctgctcagtccatacaaaaatactgtattcgtatttgaatactttttaaagtattcaaatttccccttgaatatatttctaattttaaggctgcatacagaaattagggccttaagactgaatttccaaatattttgacctaggtgttttttttatatttagttctccctttttatgttactggggtttgaaatcaggtccattttgtctttcagtaaatgttagcaacagaaatgactagccgttctttttgcagcatgttcttcatatggggtctgtgtgcgtgtaaggtggtgtatgcatatgtatgtgtgcaagtgtgtttgtccatgtttgcacgcagaaacgagatcatcaggcatcctgctctatcacttgccttattcccataagacagtagctctcactgagactagaggttatcatctaggctagactggctggccaacaagccctggtgatcttcccgtctctgggattttaggcatgcagccacacctgactttgtatgtggttgccaatatttgaatccaggtcttcatgcttgcatagcaagcatttctacctaccaagcatctccccaatttttccaatgctttgtattgaaaaaaaattgtgtgtatatctacatgatctctctctttctgtctctgtctctgtctctctctgcctgtctctgcctgtctctgtgtgtgtgtgtgtgtgtgtgtgtgcatgtggtggtaaaaggccagctttgtggagtcaggttttttccttttaccattttgtgggtcctgcagattgaaacacatcttgccagagtgatgactttatcaccctccacatcctgttatgttctttcaaactaggtatgttctatttcagaaccctggtttgtggggtggcagaagactatataacctacttccatgagtaatagatttgaactcaaaacagtgaaaaatagaaaaatctaaataacattctgtgaaaattccaatttgaagattaagatcaagaataccaaagtattaatctatgtagaaatgtacagaaaggggaaagattatcaatgacaaatagagaatataaagactaaagtcctccagcaagcatttctgttttagtagggccagcagagattgtgtcacagctaaataagatgaccaggtagctaaggacttaaaaattccaatgagcaagtatgcataattatgtgttcttttgcaactgaattaattggcttggtgaaaggtcaaagatttagtctggcaacacataattgtcaaaactacatgtaggtagtggatttaataaaatgtttttactgagggacttccactcactgattgctgtaattcagtaacttggagtctaaggaaaggtaaagatataattttttggttagtcattatcctcaacattgtgtagaaagaatttgctattaacttgtgctagaatgacttggcagtgtttggtattcttgattccttcaatagctttttaactgtgctttcacagatcagtttgttaatttccagtgtgtgtgtgtgtgtgtgtgtgtgtgtgtgtgtgtttgaaaaaacagcctcatcatttagccctcactgtggctggccttgaactcacaaggatctgtcaccataccaggcatatatatataaatatatatataattactgatatggtagtatatggttaagagtcaacacaagcaaaagtaagctaaaatcaatttacctagttgagctttgagagggttgctatgttcccattgagtacatagcttttattttatttcattagcgacctaggacatttctagacaagtcaagtaagtcctttgagtgcaaagggctgattcaaagttcaaagatgattagtttgtaattgggttgatcttacttattgaggaagtatggtgtgataataaagaacaaagtaaatgttcataattaacgtgctcatttgcttatgaaattagttctgggcttctgaagccaataaaatggaacgggcaagatggatccattaaacctcatccatatctcttgttgattttgcagataattataatgtttgtcttgatctcaagaagtagttgggctgaggatatatatagctcagagggagagcactggcctagcatttttaaggccctgggttcaatccctagtattacaaaaacaaaacaacagaaaaagtgccaacttccaatttgtgtgccaggtgtggtagggcatgcctataattgcagcactcagaaggtagaggcaggagaaccacaacctcaagctgctgctgctgctgctcagctacatatcaagaccatgagaccctgtctcaaaaaacccaaaaaaccaggaaacactttcttgagaaatccacacccgttcttgaggtctgtcctttccccggtcacctctctttctattaatttccatgtttagttctatcttaaaatgtattcctaataaactctacttctaaaacataagcagttacagggctaagggtttgagggtgtggcacagtggtttagcttgcacgttactaggttcagtcttcagtcagggctcatggatcctgtcacaaaaatcaaaagtagaggcagtcagggcatatcagttagtaaaagtacttagctgacaaccctggaacccatgtaaatagtaaaaaaaaaaaaaaaaaaaagctgaacgctctttagtgccagcattcttatggcaggataagagacagagataggagaatcacaaggaatctcaggggccagctagtctggagtttgcagcatggcaggaacaaaagagacactgcctgtcttagggttttactgctgtgagcagacaccatggtcaaggcaactcttttaaggacaacatttaattggggctggcttacagaatcagaggttcagtgcagtatcatcaaggcaggagcatggcagggtccaggcaggcatggtgcaggtggagctgagagttctacatcttcatctgaaggctgctagcagaacactggcttccgggcagctaggatgataaagcccatgcctacagagacacgattcctccaacaaaaagctacacctccaaatagtgccactccctgggacaagcacattcaaaccccataatacttcaatcttctgaccactacacatcacacaagcacagaaaagaaattattaaaaaaatatctggagtgatagagctgatttaaggactacccttaaatcacatacttgtaaactgaaaactcctataagatacatagtaaagctggtgtgtggctagatactgtggaagaagtgaggtcttactgtgcgagtcctagagaaacagctctggaaactattttaagtaagctttttcttgcttttacaggctttggaccttgaacaaggggcttcttactcatggcagaggactgtctcaaggatcccaatacaaaataagtgaacccttacacatccatcaaggcaagcagggtgtttttattcttttgtgcctacatgatgaaaaaagcccatttccctttagaggtgcacagcatgatagtttagcaataatgaaacatccctgttaaaatgtatatttaattaattactatgtatgtggggtatggttggatatgtatacagaaatgcatgtgcatgtagaaacatcagtttcctttggaggcaacacgtggttctgaggtacctgatttaggtgctgggaactgaatttgggtcttttgcaagagcagtacctgctcttaaccactgtgtcatgtctccatccctgagacatacatgttaagtgtctatatttcataaacataaagtaatgaagatagctgtgtaaagctttaggtagaaatcagagtgagaatctgagttgttcctaggagtcttggggactgagttgttttttatttccacttctcataaagcggtacagaaggcacaaacacagatctagtgaataagaaatgagcctaccctttgtaccaacctaaaccattgtaggtagttatgatcgctctcgttaatgtatgcttagttgcagttagtttcactcactactgtcatgtacagactacagaatgccttagacattaagagtccattaaaattaaaattgtttaatctttaaaggttctacgagagagagagagagagagagagagagagagagaatatgaatgtgtttaaaattaataattcttgatcagaacctcccagtctttacactgaccaaactagtgagaacttttgtgtcagtaatgtgtgcactctttgggatatgttgtatacattttttttactcaggaggaaattaaaaaataagactaatttactatgtctatgttttgcagttctttgtgatttaactataattagtatatacactgagtttgtgatatgtacacagcagtctgatagaaactccagcacttttatgagactgaatattattctaaccataatttggttttgatcatatagttattgaaggaacaagtatagctacatttaatttcccatgactggaatgaatagtttgatgacttagttactgaagtaccaagtatagctacatttaattttctatggctggaatgtatattttgaaatatagaaaaaaagctatttgaaatattatacatttattttctaatttcaaattactgctgactgtctaattatttccccctttttatatagcacgttcaactatccatgggaatcatggtgtgtgcaatatcaattttttcttcagcatttaggttttgttttaaactacttcactcttgcacagtgggcattaattaaaattaaatcacactctttgctttacctggatttaagtcttgctttatttttctggtgtaaactgctctaattagactagtgtaaaaatgtaaaaactaaattgcaataaactcggttttggatattagtattagtagctgaactaagtaatttgatctgatgttgtctataagaagatgggtggagattttacttataaatatctttgttcccagactaggaagatagctcacttggtaaagtacttgccatgcaggcctgagaagtgagcttgattcctagtgcccatgtcaaaaagccatgtgtgatgccatacacttgtaatctcagcactaaagacatggagtcatgtggatacccagaactcactggccaattagcctagcttacttagcaagctccaggccagtgagagacagggtctcaaaacaaacaaacaaacaaacaaacaaacaaacaaacaaggtagatcacacctgaataatgatacctacacttgatctctggcctttacatatgtgcatacatgcagaaaagtgttcgatcctaaagagactaacttcttgattttgataaagcccctttgggtaaaaaattgaaacgttcctttctgacttatttcaataaacctctgtaattggcaaaaagtatgcgtatttgcactgaggaagctgcataattgagagaacagaggcctgattccttccctgtgctgttcctagtggcactggatggaattcctgaatcttttgatacattttgagtgcatgagaaactttccttagttcctgaccatcttgccttaacccagctttgctatttcttggtttcatggaataaagtctttatctttgtttcagttcgagacaagctgcgggagatagtaggcgtatccacagtctggaggtatggactttcgtctttcatccccaagggatcacgctaagtgatagttaggcttagatgctgatccccttctatggtcggagagccctgtctggagatagagctttctggtgagaaggaaaagagccgcgtcttagtgtagtgatcagctgatgcctcattaccatggaagaatgtgatttatgtatattgtgcattttcaaaacctgtttgggtatattcactgatttttcagaagaaaatatatgatatgcttatgacatattttttcctatttcagttttttgtttacacacattaaaactgaagttcagaattgggacttgaattcaagccttctgattttactatttcatatagctttactattgaaagttttatgacctgggaaagtcctgtgttttgggcaatggatagagcatatctttacccaagcctagagatcctttgctgagaaggcagagaagggcagactagggtagtgcagtttgtgggactcaggctcaatctggaaggctgagaaaaggcttggatggataggttaagggtacccattaggctaatccccagagtgggcttggagatagagtgtttcctggaggaaaacaacaagcagtgctcttaaccactgagtgatatctcaattcctgaagaaactttttggtcagttgactgtgtgtcccaattaaatgtatcgatatcagtaagtatgcatttcttatgcatactcctagtccccagctatttaagttggtagagcatgagactcttatctacaagcttaaaattatcattagcaatgctcagtttttccaagagggtcatgagaaaggagtgaagggattgaagatgaggaaggcacagagctccctttcttccacttattatgtctgactatcatgtttgaggggtggggactagaattgtgggtcagcactgttcttgttttatgcagccttaccttttcttctcagagaccatgtaaaagcaatggaggaaaggaagttacttcatagttttttgcctaaatcacagaaagtcctaccaccgaggaaaatgagggatagttacatcgaagttctcctacctttgggtactgaccctgaactacgagacaaatatgtgactgttcaaaatacagtaaggtaacagtattatattcattatttccatttgtttgcatttttaaaagtaactactgtcagatacaattcataaaccttctagttcatttatttaaagtgtgtgactgtagtttcagtatagtgaaggagttgtataagtatcactacagtcatttttagagcccttttattatctcaaagtacattatgggattttaaaggaaattcattgtgactttcatttaattcatagtttgctttgtttcacagatttggcaggattcttgaggaccttgacagcctaggaggtactagtatttgtattcctaataacagttatgagtagacagtgaatccttgatagaaagggccattttattctattattctggacatatgaggacataaaagggcaaaaaatatttttcatcgtcatattgtttttattctaaacaaagatttctctttaatagagttaccattcaaatgagcctcatttatgatgacttctagttgtaaaatttagtttagctgctgggaattaaagtcaagacctcaaacctgctaagcacagacactagatgtagttctatctgcaatgtcagggaacactattatctaggtatgacatggccgttgcattcttgagctttcagcaagttactgactgtacaaggactatataagattgggcccttggaaattccaacatagaggggtaaagaggccccgcctctcttggaagctctatgtgcagttaactgttgctaggctggaggggtttatgatcttcctctcctccctgaggatctagagacagttggttcctggggaatgaaggaatatttcctccttccttccttccttccttccttccttccttccttccttccttccttccttcccgtctttctttccttctctctctctctctctctctctctctctccttccttccttccttccttccttccttccttccttccttcctccctccctccctcccttctctctctctctctctctctctctctctctctctctctttctttctttctttctttctttcttatttttgagacaggattctctgtgtagctatggctattgtattagttagggttttactgctgcgaacagacaccatgaccaagacaacccttttttttaagatttttaaattttatttatatgagtacactgtagctgtcttcagacataccagaagatggtatcctatctcattacagatgattgtgagccactctgtggttgctgggaattgaacccaggacctccagaagtacagtcagtgctcttaacctgctagccctctcttcatctccaagctccaaggcaactcttataagaatgacatttaattggggctggcttataggttcagttcattatcatccaggcaggagcatgacagtgtccgggcagatgtggggctggaggacctgagagttccacctcttgttcctgagacagctagcagaagactggcttctaggcagctaggatgagggtattaaagaccacgcccacagtggcacatctactccaacaaggccacacctattccatcaaagccacacctccaaatcgtaccactccctggccctcataggcttgttcaaacatataagtctatgggggacatttctgaacacagcataatgaaaaatatagtctatagcagtctcagcagtgttaaaagtccaaagttcatggactcttctgagattcatccaatcacttaactgtaaccccaaatgcaagacaggaaaccagctgggcaaactccaaactctgcatctccatgtctgatgtcaaagcagtcttcagatttccaactcttttttcatttttgttgactgcaacaaacttctttctcctgggctagttgcaatccctgttagcagctttccacagcagatagcctatggctctggcatctcgaacatcttgggatttccaagacaacttcaacattacagcttcttgttctaatgtcttggatccacacataatcttctgaggtcctccaaagggccttcatcacttctccagcactgacccctgtagcgctctggttgactccactctgctgctgctgctactgctattcttgggggtactggcatctccaatatgctggggtcttctgatgcaaccagaattcaccaatagcctctcataggctctcttcatggtcacaagcctcaacttctgtgcatgaccccttcatgccttcaaaaccaggaccacctgggtgactcttacactttgccaagcacagctgcaacaggagctacaaccttggctctctgcaacaaagcttctctgtgctctcagaaaatgattcccagaagatttcaccaccacagtgatgctggtcttttcttaatcaccactaatttcttagtatattatatatttttcctttctaagtttgctatgcttgttcaaaatgtttttcacaagacttaactagagaacaaattctctgctgggcttttttgagacttactttgtcaatgcaattaatataaatctctttaccttagccttcatataaggtaaaaaagcagccatattctttaccaaataccacaaaaacagtctgtaggctacatacagaaattcttctctacttaaatctcttaggtcttcacatttcaaatcactctcagcaacaaagtcttccatattcctactaggatagcccattaaaccccatttaaagcattccactgctttccaatccaaagtctcaaaattcacattcttccaaacaaaagcatggtcaggcttagtacaggaatacctcactcctggtaccaacttctgtcttagttaggattttattgctgtgaacagacaccatgaccaaggcaacatttaattggggctggcttacaagatcagaggttcagcccattatcgtcaaagaggaagtatgaagcttccaggcagatatgggactggaggagctgagaatcgcacctctttttcctaaggcagctagcagaagactggcttccaggaagctagaatgagggttttaaagcccatgcccacagtggcacacctattccaacaaggccacacctccaaatagtgccactccctgggctaggaatactctgaccaccacagctaccctggaactagctctgtacaccagcctagtcttgaactcctcacagagatctacctgcttctggttcccaagtgctggggttagaggtgtgcttcatcaccatcaccatccctctttccccatccctggcttgagacattttattcattggtatagtcactggcacattcttctatgttcatataaataatccttcacttatgcccatgtaagcactccaattaatctcattgggtcactatatttttaaaaaaagagttttaaagacaagatacagataccatataaagaattattttccctgaatcatgtgtgagagagtaaattgcagaccatcatatagtttagtgtgtatttcctattaagaagaacatttcctacatcattactgccatcacgatcagagaattaacactctttaatcctcagggcctatttagtctaaactagtggtcatttagtaaagaagagttcgcttctctagcataggtcgcattggataattgtgttgggaaaggatcctgagtctttccttggtttctgtaagcttgacactttgagggttgcaagctgcttttcttatatattgtgactcaggaattcctctttttagtaagatgtaatatcatctcttttagtccgaaaaatcagtggaatatcatcttagtctatttgatctaccttttggggtgtgtgtgtgtgtatgtgtaatgtgtgttcgtgttcataggcatggctgcagtgcattgtgtttacacatgcatgcagagaccagtgatcagtgccgggtgccctcctcagttgcttttcatattcatgttgaacacagctctcttactgaacctgaagctcacagattgatgactggctactcagcatgccccagggatcctcctgtcttggcctttacagtactgaggttacagatgcaatcctggctttttatataagtctttatgaatgtgtggtaagcattttataaaatggagccttctcaatggcttcctggcttttaaaaatgtgtctgccatcattctttgagtactgtccagtaagacattctagattcaccctatcttttctctggcccagctggatagttagccaaatctccaaagaatcctaggtcttttaaatggagaacgacatttagaaagcaaggagtctgtgctgggagttgttgctattggttgttactattcctgtatgctcgctgttgggtgagcagggatatttctgtccatgggcatacatttacatttgtttactcactgatctctctgtacatggaaactacttttatactggtagcttcaacttgactttagcactgtatggtttgtacttacttcccttttccagttatctccattatccttaatatacttactaacttgaccagtgtcctgcatgtaacccatttaccagggccactacctgaattcctcctggccatgtcctttatgtcactcggactctgatatcctgagccaggtcctttctgcatggtcatcttcctcgttgtgcttaagctgcaatgtgctgccattgctttcgtcactcacccctctgcagagtgtcctcctgacaccactcaggctctctgctccaggctgcctttcttactccctcctaatgacagactgagctgtttggaaaaggctggaagaaagaacccaatatttcttaaagtacacacaagactacttacatgtagccaccctcctcctctagattagttacaattagtggtatttaaaaattatacacatttatatttgtatatcctactttggtttacttctctgtcgatatagtcacaaagtcccttgccattgcccttactttcccttttaatgctcttatagttatttttgcgcgtgcgaacaggcaatcaaagggctgctgtgggagttggttctccctttctgccttgtagattttggagatggacctctgaggtcattaggcttagcggcaactggctttagcagctgagtcaacttgctgaccttaaccttgtgttctctcattgcctcctgtgaatggccaatcccttccacctgttctcttaatacttttacttctgtcttcaaggaacttgccttatcaagtatgccttttgctttgtatcctaagccatttcccaacttaacttttcctgaatgttatacaacattaaggttctccatcttaaaatgaaatgtagatataaactcccttcctcttataagcactctcagattctctttccccttccttccttgctgatttcctggaacgaattagaaaggttgttttgtttcattgacctttattgaggcctgttacgtgttagactgctatgctctggcttctcctcttctgagtcattgaaaacattcttgccacactcaccattggcctcgttattacacagtacttccccatgcttacctgatatcttttgtggtttctgttattgttctactcatttttggtctctggtgacttttcttcttgcctctcatttccaatctttataggatcctcttcctctgttgatccattaaatgttgcctgtcccagggtttttaatcttcggcattttttttcaaacataaacagtgtactttattgaaaatataattgtaacacaataacttagtaatgacaaatcaaataccataacaagatatggacaagacaaatgaagaggcattgcttcagctcactagcgatctcctttaaacaggaaaggctgctagggtagtgtgttctctctcattctgcacaacacagggataaagaatcggtgcaaaaaaccaaaataaagccagacatggtggcgcacgcctttaatcccagcacttgggaggcagaggcaggaggatttctgagttcaaggccagcctggtctacagagtgagttccaggacagccataggctatacagagaaaccctgtctcaaaaaaccaaaaaaaaaaaaaaaataaaacaaaataaaacaaaaacctatgtgtaaagccaccttcaaataattgactgagatctctctaggaccagggcagagatggctaaagtgctatcagtgttgagaactacaggcctaaaataatataagcaatataaaaaatgtcctcaaaacaaaatcagtaaactgaccagatcatttctttcatctcagaaaagggaggaggggcaggcatctgcttcctactgttctctatccatcgtttggctagattcattgcctatactgttttaataaacagcaaatagcgaaaggtaaaacacgctacccaaatggaagttctcactagtttaaatttacactcttgtaaaacaaggttagctttcagagacaatctcacattttaattttgcatcgatacttgtctcctatttgttcaaccaaagggatccaataagatgtactagcaagtatttattagcatcagctgtataaatgtattcgttccatgcaccacaaataagctttgtggatcatttgacagaacaagtgtgaaagacctgagtgcttcctctgaaactgtcaaaacattcttttccaagataagcatcttcaaagtcaagagtgtgaacaaaacctttttcattaaagatgcacacacagagtactttgtctgcagctgtaccacaccctggacaactctccattaagtgagattcagtagtcattagttatttatccccaaactctcagttttcaggtttgagaaaagaatcataccaagtatataaaagaacttttttctttaggtcgcctcaaattcagtgaatcccatttcttcagagccttctgtcaggactccatgtcaatttttcctcactaaactaggaactttgcatttattcaagtcttgttagagctgtatttttatctcttgaatctttgtctctcccattctactactatgaccacacacagattgtcagactcacaaagatttctgggaacatttaaatggagtttcttgccttcaacatctcgggccccagtgtaccctagtgggtacactgtatggaatagttaactatcatttagcatgtattgctgagcagactttgtcctgagaatgctaagacccattgaaggagatcatggtggcaaaagcaggaacccaaatcaatgcataactgtaatgcaaatttaaatgagttcatattcataagtacatagaactgtacttgctaaatatataatgcatgttaagatatagagagtatacagaggtctgcaggacagtgtgggagccaagagtgtggttgggaaagagggagagctgagaaaaacaacagcttcatgattaggaaagagttggggtgaaacagttagctgagtcctgtgcttacttcctctttctgggggtgttccattcatactgtcagacatgtgctaggtttaagagctttagctgccaggtttaattttcaaaatctacatggcaagtcacaactgactgtttatttaacactaattccagggaatttattaccctcttctgacctcgtgctccttagttttatgtcatgttgacacaagctaatctaatcagagaggagggagccacacttgagaaaatgccaccataagattggactgtaggcaggcctataagacattttcttaagtagtgattgacagaggaggacatagtccattgtgggtggtaccatccctgggctggtggtcctgggttctaaaagaaagcaggctgaagaagccatggaaagcaagacaacaagcagcacccctccattggcctctgcatcatatcccgcctccaggttcctgccctgtttgagtttgtatattgaattccttcagcaatgaacaataatgtggaagtctaagccaaaataaaccctttcctctccttcttgcttttagtcatggtgtttcatcataacaatagaaactctaggaccgatttctatagcttcttgcataattgtggcacatatacatacactcaggcacaagcataaacacattaaacaaatgagcgttttgaaaaagaggggaaatgtttttgtcagggctgaaggcttacatctataactcaagtacttaggaggatgagttagaagaatcaccacaagtttgaaagcatcctagaaacagtgaattccaggccagtcagggcaatggaatgagaccccgactcaattaaccaaaagaaaaataactttggttctaggataaaagtattagagaactttattgaaaataaagaccttttgtgaatttcaaagagaattgtaaattgaaggaataattctgcttttctgttattctcttctggttccatacagttcttgtttgctacatgcacaaccacaatcattctaccaagatgtctcctttatcaatagttacagtcctggtggacaagattggtaagcaagatcagcttctctgcatgcttagaatttccagtaattgtaaagtattattgggattgggtaaaattgttttccatataggggattttaatgtatatatgaaaacagactataacatgatatttatatagttaggtgggagattttttacttgatcctagtttttatagtctttgcatggtctccagtttccacaaagacttttaaatttgttttgtatgctaaaaaaatgattttagttttaaagataagaaatatagtataattgcagcttttcaaatgatattgttcccttatagtatagacatttctgatatggtttgggtggatcttaaatttctattttgcagatatgtgtaaacacagcttaagccctgaacaggacattaagttcactggccatgttagctgggttggaaatacatccatggaagtgaagatgaaaatgttccaggtatgtatgtacccgaagattccctcactgttcaaatataatcaactagtctcacttgaagaaaaactgtattcgtggacagatatgcagtccacagctttgaaacaattgacagttcaaggggagttagcatcttcctgctgcacaaagactgacacatcatctgttactgacacatttatgactttgtagtcatacaactatacattaaggtgcttgtttctggttttgctcaggaggatttcacaaaagtctgagttatattagatgttaattagattgattactggattactttcctggagctagtgtaccacaaaataccacaacaacagttggctttgaaatcccagcagtttattattagtttttggagactctaattcccaaaccaaggtgtcagctgcagagtcacatttcttctgaaacctataggagcttatctttgttacgtcttcttggttttaggaggcttttctgcttttaccattgcatggttttcatgcatctctatttctgtgtcttttctcttattaatatgattatcgtattggattgaaggcccactatgctgcaatatgaactcatggtttattgctctcttttttgagagaaggttttatgtagttcaggctggccttaaactggtacccaatggtaaaatagctattggtggctttgccattgtcacaactagtgtggcaaccttacagaagcagttggaggcttttgtgttgtttgggggttttgtttttctgagtcaagttcatcttctgtattctaagctgacttcaaattcctaattcttttacctctgtttctcgagagttgggatagcatgtgccacaatgtctgggttaattgctctttcttttttctttttcctttttcttttcttcttttttaagacagaaccttagtttgtaacacaggctgttctggaactcatagcaacccttctgccttagcctcacaaatgctgggattatagtcacgagttgctacacttggctttcattttatctaattatgtctataatgtccatgttctcaaatattcccacctataggtctggaggttaagagttcctcataccttttcagggatgaaagacacccttcaattctttgcttttttttttttttggtacttgggattagactcatgttcttatacatactaggaaaatgctttaccattgagccatccttcccatcttctgtctcttagttttttttcatcctttttccatgatatcgcctgaaccttggacagggtgataatagatgttccatttagggctgtctatcatttttttaattagttgattaggcagctgaaggtattgatgcctgccagcacttctgaggccaagacagatggatcatgagtttaggatggtcattgactatgcaacaagttcaagaaggtccagcctgggctatgtgagaccctgactcaaaatacaaaacaaatagatcaagagcatcctcctccaaatggtcaaactcatgcgtgagccccctttagtgaacttttatttacctagactatacatatataggcctcaaatcaaaaactggaatttttatctgttataagagttatgtaagctatccaagtgatcatctttagcagtttgaggagaaacctggaaaatgtaagcagctttgggagggcatttttgctttaagtactttccctatttatagagagcaaagctctgtttttttagaactctactaagtaccatatatggcctgattccccacacaatggcaaacattgccctcattaggatcctgctttacatagtagcacacaaagaattcattttcattatggcaggttatttttcttttctttaagtgtatggagatcagtggtcaatattgtgaagttagtactttgtttacaactttatgtgggttcttagtatcagactcaagttatcaggttagcactgcgagccccttactgctgagctatcttgctagtcccattatggtacttttcaatcaaaatttgtcttttgtcatcctcccactggccccttcctccacattactgccttcttgtgtttcccctccctcccttccactctggctccctctccttcctccttctttccttcctttcttttttcttgagacaatgtttccccttatagcctgatttgtagaccaggcttgcctcaagttcacagaggtatgtatggctctgccccctcacgttgtgtaattaaaggcatgggcaaccaccagctagcttttctttacattgtcatgtcatataatgacctctttaagttttgtttcagggttaggattctcctttagtatagtagcctttaaggaggtcccttttgcttcctttagcacaaatttttaaaagtcccttgtccctttagattctgatgtaattacataaatgtctgaataagatctcagaccatttcatgttttgtttttgtaaaatataattgtagaaggctaatttttgtgtttaaattcgtgagactgagttctatacttgcactggatgattttggtgtgtcctctagactttctgaagaagtatactggtagtaattaaaataggaaaagtagagagcatcagtaagaaaattttaggatcaagacaggagggcctggagcctatgtcatacatagaagtggctattacttggatgcttatgaagacaatttaatggtaacattaataagagctgaagagctagtggggcagagaacctggactttttatggcaccacagattggtgctggataggtccatggttaaaggcactggttgttatgtataaccctggtttagttcccaactccaattccaggcattctgatgccttctggattgtgctggcagcattgcatgcacatgctgtatggacattcatgcaggcaaaacaccatacacataaaatgaagtaaattaattcaacaaaatttttaaaaattgacatacttggccagagactactggaatttgtcaggtttccccacaccactggacagtatgtttaatggcatctatttgagtagaccctactaactcacatattactcgagtccttgtttctgtttagtcccatttaatgttatcaatgcttctatgctttagttatagtttggctgtccagtgtgtcttcacccagcaagatatgcatcgcttagagtctaccttctggatttcttgtggtctttctggtcagaaaaacagatgatttactggaattctagggcccttttagtggggtctgttttcctttgggtcctagttgatgctggaaggaatggatcaaaacattagcttcctcctcttcctcctcctcctcctttctttttcggatttctcctcaaagctttgcttgtttaacctgctgaaaaaaaaattcagtcttcctttcctttctcctctcctctcctctcctctcctctcctctcctctcctctcctctcctctcctctcctctcctctcctctcctctcctctcctctcctctcctctcctctcctctcctctcctctcctctcctctcctcttctttcccctttcctttcctttcctctcctttcctttcccctttcctttcccctttcctttccttctttcctttccttctttcctttcccctttcctttcccctttcctttcccctttcctttccttctttccttcactcgctccctcctccctccctccctttcttaatagaggcaggagcacagttgcacaggagtataatcacacaagctagactgaaaaccactagactagccccacacttacatgcactgttctgcttcagcgttccaagttactaggttctcaagcatgtgccaccacacctggccagttgtttcagttaagaggtagtagtatgttttaattttgacatgggtataacatttggataaagcttagacttggagtacttttagttcttagggatctgacctttgaatccatattgacacatccggtgttgactatactatatagtaatttaaaatggtgatgatgatgcagatgcagatgatggtgcaacttggtacgtcttcctaataaatatatttcttacaattttgtttttcttttctttgttctttagctgcacaatgatgagaaatattggcctgttttggatgcaacctttgtaatggtggctcgagattctgaaaataaggggtaattgctgctcttttataattccataatttgaaaaacttcaacggaacataagactaaagagaaaactaatgagtttctatatgcctgtgacctgagtttaacagatttaattgcaacatatttgaaaaattcatattatctttctaaagaacatagatattttaaaaccaatttcatacatgatgacattttaccctagaatactttagtgtaggcatttactttattgaacgcataccctctgtcctgagtaaacccactttccatattccccaggctgtaggagtcactggtttactttcagactgacttggttttagcatagatgagagaacacgtggtacttgtgttcctgtctttggctcatttccttaacatcatgcactttagttcagtacactttcttgcagaggacattctccctgacagctgaattgtatatgtgtatgccatttcacttttgcattcattagctgatggattcctaagctggctcagttatcttagtgcttgttaatagtgctacatacataggggtgtatagctatctctggtatgctaatttaattttctgtaaatatatacagataagagatacatgggccatgtagcaaatctatttctaagaaaaaagttctttatgatggctgtactaatttgcattccttccaagaatacctacaatttttttcctctgtatcagtgttagtattaatttcttaaagtaaaaatagccacttggggtgaattgttacttcatttgacttgctgactcactctctaatagctaaagatatcaatgactttttcatttacttgttagccacttctatttcttttgttgagagttattgagatcatttgcccattttgaaaaatcagtttattacattttttgagtaacatatattctagatatcaacttcgtctaaaatgcatgtttgtgaagctttttctcccattcttttggtcctttctgtactctgttgagtttttcctttactcaatagaatctttttattttgatgtaataaaatttcttttcttacttttttcatttattgtttttttattattatttttgttttggcctagagataccttaccaaaagtccttacccatttcagtatcctggagcgttcctgttttcttgtgatggtttcaagtcttagatttaagtgtttcgctcattcgtttgttttgttttgacaccaggtttctccatgtaacagctctggctattctgaaactccttctgtaaaccaggctggcttcgaactcagatccacttgcctatacctcctgagtactgggattaaaagtgtgtaccaccactgctaggctatattatattttgtaagtgctgagagatgactgtagtttctttcttctgcatatggatattgggtttcccagcaccatttgttgaaaagactgtcctttgtactacataatgtaggtgtgttattgttcttgtaatctttctattctcttcaactgatctgtaagttctttgatggcagtaatgtcctgttttacattctaaatctatgcaatatgcttatttgttttttgacacagggtctaatatagcccaggctgtccttaaactctgtgtagctgagaatgatcttgaagtttatcttaattctgggtattataggcatgtatcatcaccaatacccaactgtttgtgtgattgggaggcaaagtctagcaattatcttgtgcttacattgaactcaatatgtgggccggattggtcttaaacttgctatcttcctgcctcagcttcccaaaagctaggatgctaggtgtttgccatcatatcaggcctataatatatcttgaattcaggtactgtgataccaaaactggctattttcttaaataacttatgtcaccatgctagaaacttatttctctggtatcatgtttggtgagcttgtatgagaccctgagtttgatacacagcactgggaaaaaaactcaaaaattcaaaaataggtttattgaaatataattcatatactatgtgattcacctattaaaagtgtacaatttggattttgatatacttacaagttgtacattctctaaagtgtgttttaatctagcctacttgtgtgtctccattacccactattttgtattgttaacatgtaaggctgggctagctagtacacaaaatctcctacttcctggatttaccttgccgtttcctcatgatgtcttacttctttttgtttggtaccctgtacttattatatcctgtatctgaagtacaatcaagcttcatgttagattcagtcaagatgctgaggagagcaaattttcagtgttactgttcctgaatgtttcaccagaatgtgaattcagtaggtcccacttggcatgttgctgagattgatctgtgcattcaacaaggaccggctgatctctccacagtggagttcaggttttcctcgtgtattcttcttaatcttttgattggatacttcttccatattttcaatttatttatttacttgattgattgactgtgtgtttgtgtttgtgtgtgtgtgtgtgtacgttaagagacagcttctggaaattggttctctatttcttgtgggttccagggtttaaactcaagctgtcagtcagacttggtagcaggtaccttcatctactgagccctctcagaatacaccctcctcatattagttaatttaaacgtatgtaattgatcattgctataatcattgtcattggaatatacaagacaacttttaaattctgccattttcccttcatttattagcttgagttctgtaaaggaagctttcacttatctattaaggccattggatttgttaaaaattatatttatatgcatttttcagaataaagacttgatcaattagctaatcacatgatattcccatttctttctttggaaagctgtttgacttccatggacaaggtatattatgtatatttcaatcaactgtagtccttgctcttcttgatgttcaggatatgtcatctttggctagagggggtgagacatctttgttcttccagactatccccactatccttttgttttgttttatttttaatttctgacaattcatatttatgaaagtaacatttcattgcattattttcctcattaatcgtggaagtgggggctggagagatcgttcagcagttaagagcactggctacttgtccagaggatctgggttcaattcctagcacctacagctgtttataagttccattccagggaatctaacatcttcacacagacatgtatgtaggcaaaataccaatgcacataaaatgaaaaaaataatggaagtagatttaagcaaataatgaaaaaaaattacctttttattaatcatacttcaaccaccaagatttcaacaggattttaagtttcagttttttatttattcttagatcactgcataaacacacacacacacacacacacacacacacacacacacacacacaatgtactttgatcatatttaccttttagtccatcttatttatgcccgttcttcttcttcctagttctgctgaacccccttttcacaagaagtctctctcctactttcctatctttttctgacctgctgggttcatttagggctatttacatgagtgtgagggtgatgctgaaaaaaaaaagagaattctctatttagctctgtaccccatttttaaattgggttttttgaattgttggtgtcaaatttcttgagttctttatatattttggatattatctcattgtcaaatgtagggttggtgaagatcttttcccagtctgtagcctgctgttttgttctgttgacagtgtcctttgccttacagaagattttcagcctcatgaggtcccacttattaattgttgatcttagagcctgagccattggtgttctgttcaggaaaatttcccctgggccaatgcatttgaggctctttcccaccttctcttcttttgtattcagcgtatctggttttatgttgagatctttgattcacttgaacttgagctttgttcaaggtgatacatatagatcaatttacagtcttctgcacgcagacatcagtttgaccagcaccatttgttggaagatgttctctttttccatttgtatggctttaacttctttgacaaaaatcaagtgtccataggtgtgtggttttatttcagtgtctttaattctactccattgatcaacctgtctgtttctgtaccagtaatatgcagttcttatcactattgctctgtagtacaggttttggtcagggatggtgattctaccagaggttcttttattgtttaggatggtttttgctatcctgggttttttgatttttcatatgaacttgagaattactcttttgaggtctgtaaaaaatgtgttggagttttgatgggaattgcattgaatctgtacattgcttttggtaaggtagccattttcactatgttaatccaaccattgactatgttacaaccaatccacaagtatgggagatctttccatattctgaggtctttttcgatttctttcatcagagatgtgaagttcttgtcatacagatcttgtttggttagagttacccccaagttattctgtattatttgtggctattgtaaaggggtttgtttccctaatttctttctcagcccatttatcaattgtattaaggagggctactgatttatttgagttaattttatatccaggcactttgctgaagttatttatcagctgtaggagttctctggtgaaatttgggggcagggcagagttcatggagcagggtattgtggggtcctaacaggtggggtattgggtgggggtattggggtgggggtctcacctgtgtccctggttactgcaggtgcgctgggagacagacagggctgtggcttggggacagtgctgcttctttaatgcaagtagaagtccagacagaaagggagtgcctttgtttctttaaggcagtggttctcaacctgtgtgctgcgacccccttacaagtagtatatcagatgtctacaattcctaacaatagcaaacatacagttatgaagtagcaacgaaatattattatggttgggtgtccccacaacatgaggaactgtaataaatggtcacagaattaggaacgttgagaaccattacttgaaacagtttagattttatttatttattggcgcatacatgcatgtgacatggcacatgtttggaggtaagaggaaaacttccatgagtcagctgtgtcctgccatgtagttctgaggaataaaattcaccaggtcaccagggtggtcagcaggtcctttatgagctatggtattactggtcctatacaatgttttgtatgtgttatgtatcttaattacttttcctgttgctgtggtaaaataccctaacaaaggaatttaggggacagagggtttggtgttgttttcaggtcaagatagagaagtcagggtagcaggagctgaaagcagctccattgcatccacaatcaggcaacagataacagtgaatgaatgctagtgttcagctcacattttctattttctatagtcccagatcccagccagaaaaggatgccacccataacgggctggtcttcccaccttgtaatcaaggtaatcttccataggtatacctagaaactaacatcatctagatgatcctttacatgtccatccagagacctaacttccagttgataacatattctgtcagactggtaacactatcacatgtattcattgtacataatgatgtatcataaagacatttttgtacaagtggattatataggcttggatcatattgaccaaaaccatctttttagttcacctttcttcctctgtatttccccagatagtcttggttctaatttcatgtcatatatgtgtgtgtatgtgtgtatatgtatatatacattcatatatgtatatatacatatatgtatatatgtatctatatctatacatatatgtatatgtgcatacatatatgtatatataaaatttaatattttggcttgaaatctaagattcacaaatgatatacgttggattccttcattatagtgaagaactctcttttcttatttttttagttctgatgaattcattttattttgaagaatttttattttttattttatttatcattttaatgattcatcatatttattatttgttttattcttttattttgaaaaatttttaacgatgcagttaacccttgtatacattttgcctaaattccctcgtcagcatagtaccacatttgtcttcctttcttaccatttgtaaatatacacgtggaccattatttcctaaatcatttaaatgtaagttgtggttcacttcacctgtcactagtttagtgtgtgtctcttgagaacaaagtaatcctactacatgattccagtgcctttatatcacaatgtttccaagatatttaacagtatagcaattatataaatctaatatatgatccatacttggatttcatcatatttccctaaaatatcctcatgaagttctgccccagaatcaggatccatcagagcagtggttctcaaccttcctgacattggcactctttaatgcagttcctcatgttgtagtgacccacaactataaaatgattttgttgttacttcatcactgttatgaatcatgatataaatgtctgctcttcggatacctgctatgcaacccttgtgggagtcacagctaacgggttgagaactgaagcatgaaaggttcctacatcacatttgcctatcgtgtttgtttagcagaagtgcccctactgtttgctctctttgaagacattgagacttttgtagggtccatactaaactcgtatttgtgttctcatgagtagagtcaggtttaatgtggcaagtacctgtaccctgttttctttgtccctgttttggacagggccttatggacgtcaggctggactcaactcattatgatgatgatgttggacttgtagtcctccttcccctgtctctcatgtgctaggattacaggcatatgctgttatgcaaaaattcagtattctttttataataggaactttctagtgtatagttaggtctataaacaggtttacgtaattgttctagtctccttgtgtgaggctatcagtgagcattacataaaacaaatggcaaaagaagacattttcatgttggtaatgctggtccctaggaccttacgcatgccagacccaacactcaaccattgagacataaccctgatgaaaacctttaaactaggaggcagttattcatcttaattttttattagataatagcatacactgtggttttttagttttgtgtttatttatttatttatggccagattggcctaagtcttgacatcctcctgtctcagcatctctaaggttgggattacggaggtgaatcatcaagccactatcttaacctaaatttttctgttttctttaggccggcatttgtaaatccactcattccggaaaataaagaggaagaagagctctttaaacaaggagaatgtatgttatttttcttatagtgaaataaaaaaaaagtatactaattttactatagaagggattattgaagattatatggattccttataatagtcacatgctttacccttgccaggatttttttgatagacaagtgaatatttatttattttatcccatggagctcatgctttgaacaattttattgatggcacagtattaagtgaagcaatttgtcttttcattttttattgattgagaatttcatacatgtatataatacattttggttaagtctctttcccccaacctcccttcattttcttccttcctcacccactgccctctttttaaaactcattaaatccacttagtgctgccagtatgggcaaggatgcagagccatttactggaacacaggtagctattttttttttttttatgaaatgggaagtatatcttagttgtgtaagtactagtcagaacagggctgtagatcaggatggtaaccagtattctcatactaaaccgatagaatttccatctgaaagaaaataggctggacagatggctcagcagttaagagcactgtttctcttccagaggaccggggttcaattcccagcatgtacatggcagttcacaactatctgtaacttcagttccagtgttcctgacgccctcatacagacatacatacaatcaaaataccaatgtatattttttaaaaagtaaatcattaaccccagcacttgggaggcagaggcaggcaaatttctgagttcgaggccagcctggtctacagagtgagttccaggacagccagagctatacagagaaaccttgcctcaaaaaccaaaaataggtatatagatatgtagatttaaaaaaaaagaaaaaaatactcagtgggattttgtgtgtgtgtgtgtgtgtgtgtgtctgtgtgtgtctgtgtgtgtctgtgtgtgtggtgttgggtttggaacccagggccttgtacatgtgaataaagtgctttagtatagaactatgtcccagctccatctctggaaattttatgtgattgctgtggtcttcccttggacatatgcataaattattctggtatgattttgaatctgagaaatactttgtaggtcacaaggcaccatagatgctgtggggtgaccttcctgatcatacttcttcattttgtatatttcagtgaacaagagccgaaggattgcctttagcaccagttcattactgaaagtggctcccagttctgaggagaggaatatcatacatgaactgttccttaccacactggatccaaagtaagttaagattgtgagactcccaagttgagaaagtattcgagtccaaggtcttttccagagccacactgccatgtttgtaacctatttcttttcaacagtgaaaacatggcattaacagggtttaattcatttccacttgcacaggactataagttttcagagtcgaattttgcctcctaaagcagtgtggatggaggatacaaaactcaagagcttggatatttgtcaccctcaggtactagaactttgtgagcaatcctctgaatttgatggattgcattcatgttaattgtctaaactttgacacacgtttaaatggacattttctatagcattgttaatttctttgttgtctagataagggataaccacagacttttattagtactcatttatgttttataggaacgaaacgtattcaatcggatctttggtggttttcttatgagaaaagcatatgaacttgcatgggctactgcttgtagctttgggtaagttcgagttatgttaccttctgagaagtcactttctccagtctactaaaaggaaacattttaaaccagtctgggtatgaactgcactataggattatactttatataagaactcgctgtacttgggggtggggagattatcatactagtggcaaatgtaagaggacactgtgaccttataggtcccaaatcactctttcttttccttttcacatattgccatattttttcagtaggtctttaattaatgggctaagtcagggaaacagttttatgaaatcaaagccaaatgcctctgataatgttctttaatgtaaaactttcattatatattcctagataatgttatatatcaatacagtatatatagagcatattgagccccacaactttgcttttaattaatatcacactcatagtagctgcatttgataatttccccttttttgatcatttcttttgatcattgatactttacatcagtgaattgttaagggaaatatttgagacctgaattttgcaactcactccaattttgggcattctccaatagcggttcccggccatatgtggtaacagtggatgatatcatgtttcagaagcctgttgaagttggttcattgctctttctttcttcacaggtaggtgtatcatgaggggtgaaaagtgattttttttgtttgtttgtttttgttcttttgtcatttgtgtctggaaaagaagtttttactttttgtgtttctcttatgactggtttccttccccattcttaaagcaactgacaaaatcttgtgtctataatcttttaggtatgcttcacccaggacaattacatccaagtcagagtccatagtgaagtgtcttctcttgacagtcgtgagcatatgaccaccaatgtctttcattttacattcatgtcggaaaaagaagtacccttgattttccctaaaacatatggaggtaagttgtgatgattgcttccttctaatgagaagaagaaattctcaacaccaccccagcacccccctgtggtatgggactgaggccagggatttgcatgtgttaggcaagtactctgtcattgagctatattctcagccctcttcctttaagtgagccttgatcccagggattcacatgag

SEQ ID NO: 117 - DNA, 450 bp, mus musculus
cacagccctaccccgggcagcgcagccccgcccttcctgcagtgaggccctccctatcccgggccctcttgtggcgtcacctagaaggtgggaaccaagattcagtccggcgcggttgccggtgtttggaggtgtcctcacgctcacgctcttctgctaccggtttgtctctacccgggaggaccttggttgtccacccgtgggtaggcagtggagtgccatgaagcgggcagcgatacggtaggtggcagggcgtggaagggcgctgccccggagtgcccacgccttcccctttgaggctcggagcctagcggggcggaagaagccgcgggtgggatgggggtggtggatatttggcttgggaggaaaaggcacccagtgccagaccccgtcctccggcctaccctggaaaaatgccaccaccctactttagcgacagctgacactttt

SEQ ID NO: 118 - DNA, 1140 bp, mus musculus
taccccgggcagcgcagccccgcccttcctgcagtgaggccctccctatcccgggccctcttgtggcgtcacctagaaggtgggaaccaagattcagtccggcgcggttgccggtgtttggaggtgtcctcacgctcacgctcttctgctaccggtttgtctctacccgggaggaccttggttgtccacccgtgggtaggcagtggagtgccatgaagcgggcagcgatacggtaggtggcagggcgtggaagggcgctgccccggagtgcccacgccttcccctttgaggctcggagcctagcggggcggaagaagccgcgggtgggatgggggtggtggatatttggcttgggaggaaaaggcacccagtgccagaccccgtcctccggcctaccctggaaaaatgccaccaccctactttagcgacagctgacacttttaaaagggaagacgttgggtgttcccttgaaattcctatccttttgctcaccaggggtgtggctggaatcttggtgtagccccttttttcaaaagccagtactttcagttctgccttgccttgcgagcacttttctcttaaaaaaaaaaaaaacattttgggggttaagtgcatgacacacttggaatctgtcttaagtatgttatcatacttgtaaagactgtagagaccatttggctctcttaagctgattcatctgtttggtttaattttatttagatctattttttattattttatgtatgaacatttctcttgcatgtgtgtctgtgtcccacatgcctgcctggtgcttgagaaggtggtgagcctccatctgggtgctgggaatcaggtctttttgcaacaagtgctcttaaccactgagccaactctccaaccccttgtttgttaatttactcttttttttttttttctgagacagggtttctctgtgaatctttggctctcctggaattcactgtatgtagacccaactcatctcaaaatcagagatctgcctgcctctgcctccccagtgctgggattaaacacatatcaacatcctgtttgtttttgagatagaatttactgtgtaaccttggctggcctaaagttggctatctatatatatcgatatctatctctttctttatctat

SEQ ID NO: 119 - DNA, 1551 bp, mus musculus
gttaaaatggcctcatctaaagccaagcccttgtctttagaagactgccgttgtctcctttgtatggaattcctcattgagcccataactctgccttgtaaccacacagtttgcaaatcatgctttaaagcacttctccggaaaacaaatttatcctgccccttctgccgctctttgatctcttcatgggctcggcaccatattcatataaacagtcttatcaataaggaactatggggaagacttcaaactcagtacccagaggaatgcagacataggctccctggggaagaactgagcacatttgtcttcaacgatgatcctccaattcgagtgctaagtaatccgggggaattgaggaaagagtatgaagaggagatgattaggatggaggccgagcgccaggccatcaaggaaagccaaaacagagccactgaggaatacataaggcaattactggcacaggaattggaggaggaaataatactggaagaaaagcgaagactggaagaacagcagccaagaaaggaggaagaggctcaaaagggctgcacaagtgatccagtcagatcgccaagaaaaaaaaagtgcaaacaaaagcactgtgacaatgttccgaagttttccctttctcagcctcagcttgagtcagcattgcagtatgaaactgtgcagtatggcaagaaaactctcttgtctgtcaggggacaagaaacgaaaacggaattaagtatgccagcagcaactactttgtcaacaggtcctgagaatcctaaactaagtactttaagctcacgtgactcaattttttatagctatggtgcaaaaataagttcagaagatgagacatcaaaaccaagctgctccagtgacaactcttatgtcccatttaagagcattaaacctgaagctaccactcattcttctgcccaggtagagaatataagcaatgagtcaggcataatagaaggaattggaaactgcacaactaaggaaaaaggaaaaatgccccttccttcgagcagtaaacatacttctaaaagaaagcaccaggaatcagcatctgaagcagcagctagcacttcttataaaacaccctctaaatcttacttggatgacaaggaaacacaaaaccccattgccagaaagctgatagacttggagcaattgtattataagaagcatctacaagaaaaacaagataggttatttgcattggagcttcaaagaacatttgatgaagaaacgtgggaaaggagggctaaaaagtccctgctgaactatccattccacaatgatgccccgagtccagacacctcagtgaaagaggattccaaagataagaacacctgaaaggtaaagaaatataaaatatttaagatttaaatcaaccatcttttaaaaagattcagttgaagcatttagctaatgtcagtgggagaaagatgccagattctactagagatttacaaacataaatgtttcattactcactgccaaataatttatacataagtatttttcaaatgatttgagaggtaaagaaaatga

SEQ ID NO: 120 - DNA, 249 bp, mus musculus
tgacagcaggacagttgcagaggaacagcctcgtggtcccctcacactgtccccagaacttggcaaactgccatttattgttggatgaagagaagggataggacagaacattacctaccctgtaggcagcctctttacctggttggtgtcttgtagctgtgcctgagtctaatagggatttgtgttagagggactttgtaggtcttgccttggttatctctgaataaacagaaataggaaggctgagct

SEQ ID NO: 121 - DNA, 8545 bp, mus musculus
caccatgtggttgctgggaattgaactcaggaccttcggaagagcagtcagtgctcttaaccactgagccatctctctacctgccattttttttaaaaagattctgccctgaatggctgtgttccttttgtaaacctgccatctgccagcctggtaccattctttataccacagggaatttctttaagaaataagaaatagcccctgctccctaaaagtcactgtcaaaagacagacaaaaagaactagaacaagctcagctggccctcagggaaaagcagtcatcctttgttccagagggctgctgctataaagtcaagacagtggccaggaggaaggtagcctttagctgagctccaaaggtgctagggcagcattgatgatagggctctgtctggcccatctttcacactggcaacctgctgatcatttggtagatgaccccttgtgagatcaagtttgccgtccatgtggagtcagtgctcaaccgtgtgtcccagcctgagtatcggcagctactggtagaagccatcatggtactgactctgctctcagataccgaaatggacagtatcgggggcatcatccatgtggaccagatagtgcagctggccaatcagctgttcctgcaggaccaggtgggtgtaactgggccaaaggcggggtagtcggtttggttgctagttctccctgtacatgctggagatagtgtctaattggaaggcatatactcaaaccaagaaaatgtcatcacagatggtaaaaaaaaaaaaaaaaaaaaaaaagaaaagaaaagaaaaaaatgtcaaccatttggttaggaaatggcgaagttggccacttgggaaatctaacaacctttaaggaagctggtctttgttgctgtaggttttattccagacattacatacctggttttgggtaaactacttaccgtgcacacaaaattgagtggggcaaagaagctgtcataagaatcggtactgagcagcaaaaggaggcctgtgaaaacacagtatccacagtggccactttaccatgcattctgtgtcattgtcatcatgtcacctgccttgtgctgtgaggcctagcctccagctcccagcctcccctgtaacccagctgacaccacttccaacatgcagagtcctttgtgacagaaaaagagaggtcccactcattttttttcctgctttttctggctgcaggtgtcatttggaaccacagacatcctggaaaaagaccaagccacaggaatttgccacctcttttatgacagtgctcctagtggggcttatggtacaatgacctacctaacaaaagcggtcgcttctcatttgcaggaactgctgcccagttcaggctgccagatgcagtagggccttacccataaacatgtccaccctctgaatctgtcatttgtagactcattgggaacgttcttctgccttccccctcgagcccctgttctgtcacaaaaagcatgtcccaccagaaagcttcgcagggagagatgacagcactcaggctgaaagcaggatgtgtttaagccacagctaatgctgatgaacccgctgctcccctgagaagcaccctgggatcattttctaggttcatttcactggaacatttgtcacagcatctgctctcatggactccaaaaaggaactagaaattggtctcttctgagtgcagagtgaacagagaagcagcttaaattggctctcaccaagagttacagaaataggttcgatgaactagtgacacatcttgaaggtgaaaagatccttccagcaacaatagctaggcaggcagaccctgacaggggcacatcttaacagaatgacgtctgtctgaaccaagctgttcaccaagcagaataagtctgtctttctggaagttttttcagtgccctagtctactctggtcatgtaattcttcattgccaaaatggactaaatttgccctagttaactttgacttatactcttcagaggaacttgtcctggctgtttatacttaagggcatctcttcttaccttaagaaaatcccttatcttccagaatccagaaaaagtatctggcttttctgataggcagacaaagccttgttttaggattgtaacaggtagcctgtgtccctgctccccctgagagcactatactgcaggctcagagcatgagtcagcatttgccatagaaatgagtggtgtgttcctgcacaaacaatgttcacttcatttttacagaagcactcgcagatgggtatggtcagggcactgcagcagggaaggctcaggcctgaccaaatctgctaaatctttcaccgttgtcctggggaatagcattgctttttaagtcttgtcttccccgtgttaggacagagacggacaacgaaaataatagtttctgggaataatcagccctgaaagacgtcactggtgcccaagtatcatgctcacatttggttgtgataggttgcaattcgcagtggcttttcacctctgaaatggaaacaaggctgtccctgagcttctccaagtgtatgtggagatgaaaggaggatggtgctcagaggtgtccggagctctcagagtgcagatgcagggcatggcgccttgttctcaaagtagaagatgccagggagccatgggggtcctcagcatttataggcattttttaaaaatgtatttatctgtttctgtgtgtatatgtgcatgcgtgcgcgtgtgtgtgtgtgtctgtgtgtgcatgcacaccgcctgtgtaggggtccctgtggaagccagaaggaagtatcagatcccccaggagctggagctgttgacagttttaagccaccttgacatggattctgagaacccaactcaggtcctctggaagagcagcaagcactcataactgctgggcatctctcctgccctcttgtatctttatgacattttcaacataatccaggctcagagccctgtaattgcctaacaggctcctggtagagaattttgaacatacagtaaaaaagatacaggcagccgggcatggtggcgcacgcctttattcccagcacttgggaggcagaggcagggggatctctgagttcgaggccagcctggtctacaaagtgagctccaggacagccagggctatacagagaaacactgtctcaaaaaaaaaaaaaaaaaaagatacaggcataagagtgcccagtgctgcatgagggaagttctagaagaactagagtccttcagactaggcccaggctgactccgaacactcagcctgccagtgatgtggctgtgaagtgagaagcagcagctgctgctttgcgctcaagatgagactctggccagggagacgagccacaaaaagcaattcgctgcagcttcccagccgttctttgaaatctctttcaaatgaagtcctgaaataggactgcatttccacaggcagcaagctgccagcttcaaaggaggagagcaggcttctgagactatccctttagcgagcagcccaagacaggcagatgtgggagaggatggcaacaagcctgcccttgcctagaggtactggtggggagaaggcctcacaagccctgtggccttggtcttggttgactgttccccaacaaccaggggcatggtcaggaggcttttccccattttctctcccatccctggaaagccagggttttggttttggggttttgggttttggtgttattgttttggtttgtttttttgtttgtttgttttgttttgttttttacctttgcaggggactataatgtggtctcagaggacagacacattaatagttctttttttatgctatttttttaattacgtattttcctcaattacatttccaatgctatcccaaaagtctcccacaccctccccccccccacacccctacccacccactcccattttttggccctggcgttcccctgtactggggcatataaagtttgcctgtccagtgggcctctctttccagtgatggccgactaggccatcttttgatacatatgcagctagagtcaagagctccggggtactagttagttcataatgttgttgcacctacagggttgcagatctctttagctccttggatacactctctagctcctccattgggggccctgtgatccatccaatagttgactgtgagcatccatttctgtgtttgttaggccccggcctagtctcacaagagacagctatatcatggtccttgcaacaaacgcttgctagtgtatgcaatggtgtcagtgtttggaagctgattatgggatggatccccgagtatggcagtctcttgatggtccatccttttgtctcagctccaaactttgtctctgtaactccttccatgggtgattgtttctatttctaagaaggggcaaagtgtccacactttggtcttcattcttcttcagtttcatgtgttttgcaaattgtaccttatatctcactatactaagtttctgggctaatatccacttatcagtgagtacatattatttgagttcttttgtgattgtgttacctcactcaggatgatgccctccaggtccatccatttgcctaggaatttcataaatccattctttttaatagctgagtagtactccattgtgtaaatgtaccacattttttgtatccatccctctgttgaggggtatctgggttctttccagcttctggctattataaataaggctgctatgaacatagtggagcatgtgtccttcttaccagttggaacatcttctgggtatatgcccaggagaggtattgcgggatcctccggtagtactatgtccaattttcggaggaaccgccagactgatttccagagtggttgtacaagcctgcaatcccaccaacaatggaggagtgttcctctttctccacatcctcaccagcatctgctgtcacctgaatttttgatcttaaccattctaactggtgtgagatggagtctcagggttgttttgatttgcatttctctgatgattaaggatgctgaacatttttttcaggtgcttctcagccattcggtattcctcggtgagaattctttgtttagctctgagccccatcttttaagggggttgtttgattttctggagtccatcctcttgagttctttatatatattggatattagtcccctatctgatttaagataggtaaagatcctttcccaatctgttggtggcctttttgtcttattgacggtgtcttttgcctggcagaagctttgcagttttatgaggtcccatttgtcaatccttgatcttacagcacaagccattgctgttctattcaggaatttttcccctgtgcccatatcttcgaggcttttccccactttctcctctataagtttcagtgtctctggttttatgtgaagttccttgatccacttagatttgaccttagtacaaggagataggaatggattgattcacattcttctacatgataaacaaccagttgtgccagcaccatttgttgaaaatgctgtcttttttccactggatggttttagctcccttgtcgaagatcaagtgaccataggtgtgtgggttcatctctgggtcttcaattctattccattggtctacttgtctgtcactataccagtaccatgcagtttttatcacaattgctctgtagtaaagctttaggtcaggcatggtgattccaccagaggttcttttatccttgagaagagcttttgctatcctaggttttttgttattccagatgaatttgcagattgccctttctaattcgttgaagaattgagttggaattttgatggggattgcattgaatctgtcgattgcttttggcaagatagccatttttacaatgttgatcctgccaatccatgagcatgggagatctttccatcttctgagatcttctttaatttctttcttcagagacttgaagtttttatcatacagatctttcactttcttagttagagtcatgccaagatattttatattatttgtgactattgagaagggtgttgtttccctaatttctttctcagcctgtttattctctgtgtagagaaaggccattgacttgtttcagttaattttatatccagctacttcaccgaagctgtttatcaggtttaggagttctctggtggaattttaaggtcacttatatatactatcatatcgtctgcaaaaagtgatattttgacttcctcttttccaatttgtatccccttgatctccttttgttgtcgaattgctctggctaggacttcaagtaccatgttgatgaggtagggagaaagtgggcagccttgtctagtccctgattttagtgggattgcttccagcttctcaccatataatgtggtctcagaggacagacacattaatagttcttttaccatattcagctgaaaggcagcaggctgtcctatggtctgtcctgtggttttaccattaagtttaccatcctagcactgacaccagtacttgatgttgggcaagcaaattgacctctgtgtgccttagtttacccatctgcaaagaagagttagaagccttctgactggtacagaaccttcatttggtagtaggtaggtgaccagatataccctagagcaacagcagaccatctgaaacgaggtaaaaatgtgccagtttagtccaccagtcttctcacaaatagtggttgtcaggcctcagcttcccagatagaaagaatgcaaatgtgtctgctggaacaaaaggagagcccaccaatcaggagccaagagaaatcctttgccagttgattgatgccatttatttctgaacaagatgacaggaggcttggcctccctttctataaattacagtggagacatctctgttctattgacttgtacacaagtctgccaagccacctttgtctctttgcttcctttttgtcaaaggggacaacagtctcagtctctctctctctctctctctctctctctctctctctctctctctctctgccactctctttcaaggtcacttcagcttttaagtccctgccatatgctgtgtatagctctgtactttgcagggtagaagaacatcatgttcccagaattccttctgttcctatcatacatggtcattgatagtttgtctgtgaagaaagaaagcagttcttggccctcagggccctgtacccctcatctgtccatcagaaagtcacttaggaaaagctctataaccttgagtcaccaagtaaattaccagaggaatgaaaagaccagatattaagtctgatctccaattttatgctgtgcctgactgctgttagaaaaaaattccatcagaaaattgtttttttaaagagagtatatgtgcatttttaagggactataatgtttcttagaggaactggaatcaatagaaactaaactctgaacttatgtgactttcccctcgccttacctcagtacatagctcttctgaaaaaaatgaacaaaggaatccaaagtcatttgcagcatgccttctatgcccaggcttcactaagtaagcacataggagcttgggcatgcacagtggcagataacaagcagcctgctcatttctgaagctctaggaggaaaggacattgaccaggctgctaatcgagagttcttcatgctgatgtgttgacattcacatctcagttctaaatttggtggctgccgaagccttccacctccagctagtgcaggtgaggtgccaagttttgccaaggacaggcttcaggttaactaagctgtgtcttcattgagcacaagggataactgatttcatagcttcttttaaaggggagggcagtgtgcagaggtatgcatcacacctgtgcacacttagaggctagaggaagacactgggtgtcctggtctatcaccacctcactcccttgaagcagagtctcgctgactctggacttaagcgagaagccagcaggcctgtctctactctcccatgtgccccaacttgtgtgcatatgcatccacatgcatagattgtgctggagttatggacacgtgtggctgcacatgacctttcatatgagtcttgggatttaaactcaggtcctcctgcttgcatagcagtcactcttacttgctggaccctaacctcccaactcagttttgaaggttcttccccgcaaccaactctgaatagacttgccaaggagaaatatcagtaattggctctagactctcattgtcatgttacttttgaccaaatgttgcagtgcttgtttgcaagtaagtcaaataaactttagctgggtaaatatggaagatattccatgaagaatattggataagtcacatatcagaaccaagtctccagattgctcccagcctcacagatgcccctgacgcaggatactgccactaaagccattgcctctgcaattctggaaacttactgtagggactgccacctgttactagcatgaactgcaaacagccacaagctgccagtgcaaggtcttaggcaggaacgcag

SEQ ID NO: 122 - DNA, 311 bp, mus musculus
tccagcgtgtagaaggctgtgtccattctgctcacctaggtttcagtggtcacagaacttttggcaaggatgctacgtagctcattggaagtcactgctggggctcagctgggattcagcaaaactgcatatcgcttgtgctcagaacctgtgttctggatgacattgctttttcatttgggcgttcgttgcctactgtattggagtgggttattgaaccccacaatgtgggtacatatgaagacccacagatgcctacttctgtgaactgggactatgataggtttcactactccaagtcggaaagcagt

SEQ ID NO: 123 - DNA, 186365 bp, mus musculus
gagggcggggccggaggtttcgattacttgtcgctgccgctagggaaggtaaagcggtgacggcggccgcgagagtgaaggcttccccgatagaggtgggggactcggcagggtgagtagttgcgtccgcccgtcaggccgtctcatgttggccgtgtgtccactagcttgtctttagagagggaacccagtcggtccacttaggagggtaacagaaggggtagcagcgcaggtccctgcacaaccgggagacacggtgagggagtcccaagctggagtctccctcggcgatccaccacgagtctctagggtcttcccggaagggctggggctggaatttttggtgccaagagacagagggggctgtgctagacgtatggtaggtcgaggtcggaccccgcggggctcccctttgctgcaggtctgcggtgtccccaccccgctgcccccgtggccagggctctccgggcttgcagcaaggaaagcccttttccgctagcgccgaggagggccccccgaaacccccgcccaagttcccagagagcccgggacccgccggcagctacgactctcagccctggtccttctgaccttggctgcccgggagggtgggcgagcgccccgcctgcagccccgcaggtttctgccaccttccacaggacaagtttcaggcgttactgtgaagttcacggctggcgtgctggcagagaagcagaaattgacctcttctcagatcttcctaccctttggaccttcatagaaattgaatcctggggtttggaaccatctgccagaacgaacaggtcctcgcactgacacgtttttctgttctcttctcttcttttcttttctttctttctttttcttttgtgcccacgttggggtaaaaaataacctgggcatatttcagtgtaaaagcagatctttcttgggggttttgatttttcgcttcacttgagttaggcatggcacagatgcttggataagaaaagcctgaccttagtcaggctagacagactagaaggatgctgtgatatttaaatagttgcagatcagtattctgttaacacaattatttttaattggctgaaatttaagctgattttagaaagtattgacacagaataatttctttccgcgcatctgatttaggcttgtttgaacgtaatggttatgtaggcagtataaaagattacacaaattaatttgtctgagagtatttgactggaaaaaagaggcataaatatgtatagaatataggattagggttttaggtaacatctgctggaacacttccagcttgtttgtttcttgctgtagggttacaaaaaagacattttgactgagacactttggaatttatagactgcataacatttagatgtaaattcgtttttaattcctttaagtgtattaaaatgtttcagtaaaatgcagaacgggtgtgttttcttatccctgtatatctggcgttgaagggggagtatgatcttacatttaacaacccaactaagattcattaataataaaaacataaaaggcctacccccatctttctgagaatgaagatttaagtacctaacgagccttttccttattaaaagaactattttgggttggagcttttttggcgttgatgctggaatgggagtaaggaagcctgcagcagtattaccagtttgacaccaccagtgggtgtttctgttgacaaatgccgagaggagaacagttgaaaaggaaatcttttttgggtggtgggatggggtggggtaaggaggggaggtgaggggagaaggagccagaagagagaagctgtaaaactaaagctgccaacactgtgtgtgctgggctttgcacaagtacagggcaacctaattagggagaagaataccatttggctgcattaaagactagaactccaaaagaggcatactaaataaagttaaccattccaagagtgtttactaatccaccatgtctgagtacttgggaagagggcttctcttctggaaagggcatcaaattcttttgaattggcttgtcttttgaacatagtcagtgcagtggttcatttgttaggtagaaatagaaagagtttactgtcctcattgtatggatttagcagagctcctaagcctattttttttttaaaaatataataaaaagaacttggtatgttagaaaaaatattcagaaataaaatttcttccccagggaggcattatttttatcactgcttagtcttatattaatgccttagggactccttaagcacccctgtcagggttctgattttgttgtttatgcaagggtcttggagttacttaaatcagggatacagctagtatgctccctgaggtggtttttttttttttaaggtttccattgagagaaattgcagggacatctcatataaatgaagaatagaaggttgactgattgtgaattaaatgcattgtgttccagatagtctacatctaagaagaaccagactttacatggcattttctgttttgaaggtgtaatattcttacactacaaaccttcagtacagaggtggaaaaatccctctaagtatgcattttcccccaacctgtttctccacactggctaggaatctatgagagactctcagccacagttgcattgttgaaaacgacagcagctcctcttgcagggtgatttacatttccgtttactttataatagaacattgagctgtagctgagatataagcttgtaggaaatttgtaaagaagtgagctggggaatattttcttatctgttaacattttcacccttttcttccattttcacagcattggtggtgatctcctttattttaataggattttaatgtttggctgttcaaaagtgtgctaatatgaaattttatttttggcagttagtgtgagagtatgatactctagtataacaaattgatgtcaaataataacatgagtcatttaaaatgaacaaagcagtccacttgcatagatctgaaataggaggaagatcttttatataactctttagtacaacaccagcaagatttgagatatttagttgttttctgattcaaaaagattttttattcagaatcagataactttagatcttaaagttttatttttggcaacatcaaatttcttgacagaggagaagataaaatgtcaaaggtcgctcaccagctgataattgtgtcaggaccacatatttcaaattaaaaaaataatgcaaaatcaagacatttagaactggagctgtaactcaggcagagtccgtggctttgaattggctccttacagaggcaagtgggaaggtagtctgcatttaagctctctgtatgagcatccactttgctttcaatcttaaaatctttcctttttgtttttttcatttttttgataattaatttttttagcatttggatttttgttttttattttcttgagatagggtctcatttttaattcaggctttcttggaactaacagtgtagcccaaggtggcctggaacttgtggcaatcctcttgcctcggcttcccaggtgctgggatatgtttggtctagatttaacattttgatatttttttttttagaaattcccctttatatgcagcagtgcatgcattagtgaattatttaaatgtggagtctcatttctcatttaagtttatacacttcttcatatggagatatgaatttgggaagcatttccatcagtgcatatgaaaactgagacagaggattttctacctacagagatatttaacatttaaatatttcagatttgggaattaacagaaaattatttattagattaaaaggactaggctcttggaaatctgttgtcaatacattgaattaagccgtttcacgtaaagatatttgttttgggggtagttctcatcagacgttttgggtgcagcctctcttttgtatatagtctgctctgtaattttcataatgctacatccattgaccactattgaatatcagatgctatggcaaattatttattcacgtgcatgcatgtgtactcacagcctatctcatatacatgtcagacgagctcagaaataatttgcacatattagctagctagtcagcagaagaggcaaaattgccatccaaaccggtctgacttgaaattgtgcttttccaagccctgctttctgcttcttttaaagagtgtggttccttaagcctgttttgaattcattgtgtacattgtgcctggggagtcctggaggtacacatttgcttcctgggttgatgggcctcattggcaaggctgcctagactcttgcgacatggtggactagactagatccatcaaaactgctggttaggacaacccagaagtatagactttttgcaaataccttggtttgagtatttcataaatgaaagttgtacatataattatgtatgtctaaaatgagataattgtttcaatcatgtgtgtccaaaatgagataattgtttctagttaaacacttggtgcttcatgtttctgcatattcattataggcttacattggctgattaaatttactaataaagattatgtagataaagtaataaataaagatttagtaataaagattatgaagatatcctttgaattcagttttatctttgtaggtatgtgttgctagggtattgcacattctaggcaagccctctactattagctacattcctaatagtatcctcctaatcccacttttcttccccattaaaggaactcaccttttgtattccagacaagacttgaacaatcttttcctgtcttgatgaagaattctgcctggagctgcaatttacaggcctgaaattccaggcctggctaggtatatgcttgaagtggcagctattacgatttccagatggatatcttttcagtaattataatgacttaagtaaaataaaactgagaggtaaagtttaaacaggtacattgttcttgtttcttttttttttttaaattatcttatgtatttgagtacactgtagctgtcttcagacacaccagaagagggcatcggatcccattacagatggttgtgagccaccatgtggttgctgggaaatgaactcaggacctctggaaaagcagtcagtgttcttaaccactgagccatctccccagcccttgttcttattctttaattttttttaattttcgtgtatatgtgtgtaggtatccaagaggctggaagagggtgtctagattctttggaactgaagttataggaagttttaactgcctgatatggtgctaggaattgaactctggtcttctggaagaacagagcagcaagccctcccaacccctgagccatttctctgacccccccccgcccccgttcttgttcttgtatcttaatacatagagattgacctctaatgaaatatttgctcttgaaagcagaattgtggggctgagttgtaggcctttcagtggggtgcttgtctaacttccacagagccctgagttggatccttagctccacatacacaggaggtggaagagagatctgtaatctctagcattcaggaggcaccaagctctagcccttcataaagtgtgtgtggtggcatatgccgagaatcctagtacttgggaagattagatcatcaaagtcactcttggctacgcagtgagtttaaagccagccataagatgctattatttttattattatcattattattattttagaaaaggtaattttctaggtaatactttgtgtgtggtagtagtagtagtagtgatgatgatgatgatgaagaagaagaggagaaggatgctgatttctctttacatttttatcacatttgtttcttttgtgtgtaggcgtggctggtcatccacatgccatggcacttgtgtggaggtcagagtataaatgcaggagtctgttctctccctccaccatatggggctcagggattgaactcaggtgataaggcttggcggccagtatcattacaagctgagccatattgccagccatattagttttaaagcaagacagccaaactgttcaagattagtttgaaagaacgcttacaggttcctgtgaaagaagagaagagaaggacatgtcatctttgtttttcagttgataaaagtcatttttgtcatttagtgatgggtattatagagcctcgggaccagaagtctttttggccagatcagagagatgttgtgcgtagatggagccttgaaaatatttgttgatttctgtacaaagtacagctttccaacatacaacttaacacttgttttagaacaacagtctcaatgtgtagccctggtttgcctggaattcactgtgcagatcaggctgaccttgaactcaaaaacatccacctgcttctgcctctctagtcctagcattaaagatatgcagtgccaccccccagcaaaagtagctcttattaaaaaagtatgctaatcattctttaataaatttatggagatttatagccactactgtcaattttcagaatatttcaatcatttaaaaaaattttctccttgaaacatagtttttgaaactcagtttatctgttacaactaggccacagacaccagtgatatcgtaaacgatatatttaaaatataatttctttttttaaaaaaagatttatctatttatttcatgtgtgggtatactgtcactgtcttcaaacataccagaatttggcattggatgcccattacagatagttgtagccaccatgtggttgctgggaattgaactcaggacctctggaagagcagtcagtgctcttaaccactgagccatcgtctctccagccctaataatttcttttttttttttttggtttttcaagacaggatttttctgtagccctggctgtcctggaactcactttgtagaccaggctggcctcgaactcagaaatccacctgcctctgcctcccaagtgctgggattaaaggtgtgtgccaccaccgcccggcttaatatataatttcttatacatgtcataatgtttgtgtttcatttttatctatctggtgtgtgtgcgtgcatctgtgtgcctgtgtgcctgtgtgtctgtctgtacatgagtatgtgaacatgcaaatgaagggcagaggacaactttcaggaatcagttctctccttccactatgtaggacttgaggaataaactcattaagcttagtggaaaatacctttcttacagagccacctttcagaccagtttcaagtttttacctaagcacaattcttagtagactatgaagaatcatactacaaatagctcaagttaccttgtgtttgtggttttattttatttaattagtaatgtttggggaatgagtctcatatagcccaggctgatcatacacctctgtgtagccaaagctggcctttacgtccatctctccctgagtgttgggagtacaattgtgtgccatcctatttatgttgtgctggggatcaaatcctgggcctcaatcaagccaggcaagtgttgtaccaaatgagtcacattcccagtcctggcttcaatttttttgcaaagctagcaaataaaatagcatcattcttagtgatatatgagaaacgcatagaaaagaaattgtgggaaaaattatacaatcattgtataaggaaaactcactttctgatataagactatgggcagaataattggttttctttatactggaccagtgctgttgtgctgtttactctttgatctcttatttgagttctgattgtcctagacagatcatctctgctgtgcatgttataggacacccttcattgtattcagatacccagatattttgtactttgcgttgcttcagactggatggtggtgggatttagacatggttttcttacatcatttttcttcttagttatcatttatgtggactggagaataaagcaaaaattctgccatattgcactatcttggtctttgcctagtgtgttgatgatgtaggtagggagtgcttataatatagcttgtacatgttatccttatataataaaggataatggtttggttggaagtgattagaaaactgtgcctaaattttagataaacaattcttgtgggaaagtgactcttaaaagtgctaggtagagggctggagagatggctcagtggttaagagcactgactgctcttccagaggtcctgagttccattcccagcaaccacatggtggctcacaaccatctgtaatgggatctgatgccctcttctggtgtgtctgaagatagctacagtgttctcatataaattaaataaataaatcttttttaaaaagtgctaggcaggtaaatcatttactctgtatggtaggttgtatctggatttgtaataacaaattagacaaatactgctggatcgatattaatagattattgtcaatttagtcataattctttgaaatagtttctaatctttaacagtgatgaatgtttcttttgttatttttatatcctttctaagagagaggcctaatatcaagtagtaatatctggaaataacttgtttgttttgtgtatatgtgggttcttgagtgtaccctatttgtacagtggctgcagaatccagaagagggcatcagatccccgagaactagagttgcaagcagctgtgagttgcctgatgtaggtgggggaaaaggaacctggtcctctgtgagggtattaaatattcttaaccactgagccatttcctcagcactgcaataactttagatagagagtgggttttgacagcaagaaaacaggtttctgggagctaataaagcatggatgaatacatttaaattttaaaaaaatatctattttttaaaatttatgttttactgtttaattgtgtgtatgcaagtgagtgtgtgagtgtgtgtgtgttggtatatgagtatagatgcccaagaaaaccagaggaattgaatcccttagagctagaatgtaggtgcagggaattgaactcatgttctgtgtaagagtatactctcttttagtgactaagctgcctctccaggccttgtctgtctgtctgtctgtctatctacctattataagtacattaatatttataaatattctgtgtgcctgtatgtattcatgcacatgtatatggaatgagtaagaggtcaaaggacagtttttagggattggttcttcattctactgtgtgggttcctgggattgcagttaggttgtcagacttggccgaaagcacttttatctactgaaccatctcattgggccatttttttttaaagattgacttaaattatttcatgtaagttgcagttacagatctttgtattatgtctagagattagattcttggaaaaatgagattaagtttcatattaaacgtataggaagatatggcaaataaaaactggtgctaaatagggctaaggagctgggttagttggtaaaatacttgctatgtgtgcatgaggacctgagattagtccctaccactcatgcttaaaaaaaaaaagaatgaattcaattgtatttttttgttgttctcataatgctttgtgtgggtttatttatatatgtatttatttgtttttactgtgcaggtcttgatttctgattttgttcttaggggttttctgtgtgttcgagtgtgcatgtctctgtgtgactatgtgtgtgtgtgtgtctgtgtgactatgtagatgttttggctctttttttctgtttattttgccctattctggattttattttattgctatttttacctgcctattttctaatgcgtgagagaaagaaagacgtcgagtggtttagagttggagaggagactataatcagaatatattgtgtgaaaaaaatctatttttcctttttccctttacttattacttattcactttacatcatgattgcagtcccctccctcctctcctttcagtttcaccctcacacccgctctcctccccctcctccccccttctcctctgagatgatatgaacccatcctggcacatcaagagcatcctctcccactgaggccggacaaggcagccagttaggagaaagggaaccaaagggaggcaacagagtcaagtcccttctctaatagttagagggcccacacagaaaccatgctgcacatctgttacatatgtgtagggggcctaggtccagcccctgcacactctttggttggtggttcagttactgtgagccaacattggtctaggttagtttactctgtaggtctccttttggtgtctttgacctctctagctcccacaatccctcctcccattcttccacaagccttccggaactcccgagtaatgtttggctgtgggtttctgcatctatttccatctgttgctggataaagcctctcagaggacagttatgctaggctcctgtctgcaagcacagcagagtatcattaatagtatcagggtttggctcctccccatggtatgagtttcaagttgggccaggtattggttggctgttccctcaatctctgctccatcttcatccctgtgtatcttgtaggcaggacagatttggggttgaaggttagtggatggtttggtgtccccctccctctactggaagttctcctggctacaggaggtggccacaccagcctctatatcctaggctgctagtagtctcaattagggacacccacatagactcccaggagccttctgtctcccacatttcagtctcatcccagagatgccccccccactgatttctcttctctctcccaccctacacctccaatgtctattttatttccccttctgagtgacattaaaataaaatacatttaatgaagagtaggggtgacaaacacacacttgtaaccccagaggtgatggtggtgagatggagacaggtcaatcccagaagttttttgggacagctagtctgactgaatcagtgcctccaagttccttgagagactttgttaagtgcagaatggtagagaaagtcactagatattgacctctggtttccatacaaatgtgaatacccaagtacacacatgtgcatataagaacatgtacatatgcatacaccccaccctccacaacatgatgatgaatgatagctgaagaaaacttgttggattggatttgctgaattaccctgatgttggccagttgtagaaactagtttcctgagaagtagaatcttaaagagatcttcagagttggttcagaaaggaataccctagaattaatccacattcccattcttgtgggacatacagactttaattgctagtaataactaatagtatttcaactaaattcaaatttcaaatcatacaatacatacacaaaaaaggttttctttattttcttttgaagcggagttggagtttattaaaggggatttatttttatgtgtgaggttgttttatttactgctgtgtctgtacactgcatgcatatttgtggagaccagaagaggatgacagatcccctgaaactggagttgcagatgattaccagctgtcatgtggtgctgggatttgaacccaggtcctccagaagtagccagtgctcttaactgctgagttgctctccagtcctcaaatgtatttttaagcatagatttaagtgtggtggtagttatgatgattgtggttgtggtggtgggtggcaggtggggagtggctaatggaaagacatatacgtggttaatcaaaaggttaatagaaaaattaatatatgctgagcaaaggtgtggtttctcaagggagcatcacagaaaaggctattctttattgtgcttattgaaattgatggatgcaaacaaaggttcattttgtgcaaattggaatttcgtactgcatcagttctttataagaacaacctatcttacatcctgagacctgttttttgcttcatttaacaaacacttaatgagtaactactgtggtcctgccctctaagagtttagtattgagatggagacagaggagagaggaggaagtcacctgtgggaacaaatgacatggttaaggtggatgatctatcctgaggcttgataggaaggccatcttgaggtaacttttcagtgaattttaaggataagaaggattgctttaattggaaacaagttttccaagagagtgggtgcagatgccctgaggcaagatgcgagttagaggcttgagagaaacaagacctttggattctagcttgtgagtgtgtgtgtgtgtgtgtgtgtgtgtgtgtgtgtgtaatggttaaatgggtaaaactagaaaggagacccagagatcaaaagaggtgttgaggaacaggccatggaaggcaaaagaacacatgtgacatgagatctgaaaggagagtaggggaaatgtacgaatagagggagagggacaagagaagatagagggagaagagagtatccttaaaaaaaaacccacattgctttgaaaatgccgtaaactgagggactggagagatagttcagtggttaagagtacacactgctcacgttcagtccccagcatccatgccaggtggctcacaacaacctgtaactagctccagggatctcatcttttcttctggagtcctgggggctcatgttcacacactgccttgtacataattaaaaaataaaattaaaaacatcgcaaaagaaaatgccataatgctatctaatgcccttgtatgctaatttttgttggatttattgattttatatgtatgtttggttttgcctgcatgtctgcctggtgccagcagaggtcagaaaagggagtcagatcccctggaactggacttacagatggttttgagccaccatgttggtactagggataaaatccaggtcatctgcaagaaaacaagtgcccttaactgttgtgtcatctctcctgcccccttgtatgctaattacagataatgttaagaaggaagattttacaatggctagaaaggaggaaagacaaagaagaaggcagcggtcagtagtagcccagtagccccactggtttcctgcctggctcctgggggactgttggagactttaagcaggagtacactgtgaaatgcagggctgcaatcaagccaagagtttcagcttagcagaatcttggtagtttgtcaaaaaggtcatattctctgcaaggtaaaatattcttctcatcacattacaatttttgcaactgcttcctggattgattataacctgtagtactcttctcattgtttttctagaaactacctttacttttcctaagattccttttctcttttaccattctgttaaccttatatagcaatgccatttctatttataactgaattaaaatattttttctaatgatttcattttttctcttccttatttaaacttaaaactctgctggttccccctcatcccatttatctgctgaagttatttaatgccttgataaaacattttattaaatatcaacattatgtttgaattattcatttgtctctccaaatacatttcagatctggtctaatatttctcaacatgtatgctgtttctttcctgatttctaaccttttttgtgtacttatagtgtctttaggtaattttgcttatactctttaaggacatcagactccaggaagtgtagcacttcaaatctcattttttgtgatcttgtcttttatattaaactattctgtgttagacttctatttttctttactttctcattgtatacacatgtgccactgtgtgatataagccagaggagaatgtcttgaatcctgctctgtcactttctaccttaaccttgtgtggctggccagtacccctaaatcaatcctcttgtctgatcccagatccccagtaacaaggaagttagggacacgaaaggtcacacctggcttttttacacaagtcctgggtatctaaacttaggctttatgctcttaacgcacttagccctccagcccatgtgttcagattaacttacgtatgctcatgctatgcagaggtgcctattttaaatatccaggttatttatttcattctcctacagtaagcattctaacatgtttaggagatgtttgtttagaccaagtctcaagtagccttgcttttagtagagggtgattttgaattagaggggcatgctgccatgccaaacactgcaaaaaattggtttgccttgctgagtacatgaggttcaggtcttcattgctttagaattgctaactcctacctgtattgaatgctgcttttgcccctatacatatggaaataataaccacagcatcatcaccttcttcttccctgatgtcctatgcagtccaccttttgatgtagcctttcacttagcttactttcagcattggctcttaggctttattgaactgtccctgtacctgtgcagtttgcttgcctgtcctccctcccttcctccccacttgattggtggctatcccttgctacctttcatggtggttaagagtttgaaaatggtttatgtcaatttttttttcagttttatccagaccagggtatgtacttgaaaataattgcctctcttccaaattaagagcatgaagccaatatttttatcctagcggtttctccagtctccagagttaacgcccctgatttagaggtgtgttttgaagtctgtctgtctgtatgtgtgcagtgttggtaaaggaaatcgacactttcttggctgactttgtgctagggtaacagtttgattagtagagtatcattgttattttcttcagacaactgagagaatgttgacatcaatataagcaatggtgatgttctgtaagccagcagagaggccaaatgcaggactaaagcactgggtaataaatagcacattcaactggagaagcaggggacaagtggctgaggcagacttaaggcaaaagaaaggggcaaagagtgctttgagagtgggtgaaaagaatcttaagagaggcctagaaatgtcaggtaaaaggaatgggccttaagagggtattttcaagacatgggtccacaaataggcatgtaaacctaggagaattgtaaaactaacaataacaaagaagtgaatttgtgtactgtgtgcttcacattgtcctgggattttggctttctttcattatggcccataagagtatatgaatatcaaaactagtagtttaaatagtgttgtgtcttagggaaatggacgagtatatgatatttgttatgagttataaactctgtgatggtatggtgtaggctcagcatgtggcacataggaaatgctcagtagacatttctcctgtgaaaggtatccctttgctgccacaaaaaattgggagtctcgtgccagtaccttctttttgggtgtttctctatattaggtactcatctagtgaatttccctttcagttcagcctgtagaaatgtgctatccttggccccacattggtacatgaattggtgctgatgtctccctatggagagctctaaactttcctgccagtgttaatagtacagtggatgattgagcatggggggacatactgttggagcaggataccggggaggcaggacagcgatcaggatgtaaagtgaatataaaaactaatgtcgtattttcagatgacctggatagacagcaaaggaatcaaattccttaaataaaaatgtattgacttaatacaataaataattttatacattaaaaaaccatttacacagtttttaaaaaaatatagtatatgagaaggccaaagctgaaatgaagttttttttaataatgtattctactagttaatgtaattgcagagtccttgttcataataatctctctttgacttcatctctttttctctctctttctctccttccctctttcctctgcctttatcgtccattatcttctccttcctcctcctttaccatcaagcaaaactgtcatttttggaacatgtttcttatttatcatatgtcttcacacacccctaggctactacttaggtcttttagactggcaaactagctttaaatgggttaccacactgaggtaaaataaatactgtcacataaaacccttctgggaatgcagtaagctaaccaaataattaatttgccatgatataaattaggtagatgacttttgccatttttggattgtccagtagttttaaacatcctttctacctttgaattaatttatggcccctactttactggaaaatgtgtaccccagcctctcttactggggtacatgattgtgacataagtttgaccaagtacgttacacaatagaaacttggacacagagtgagcattgtataatggtgatcatactgaataaataatctgtaaatcatgttgatagagggctttgctttctaaaaaatactgattttaagaagttgtatgtatacatgtgtgccatgtaagtctgtgtgtatagtgtgcatgcaggagccagtggagttcagcagagtatatcaaatcccttggaactggaattataggccactgtaaactatcgtgtatgtcctggcaacccaacccaggtggtttgcaggagcagcaagtgcttttataatcactgagctgtcatctctccagtgccaggttttgaaggagtgccaatggcagggccttggaaatttagcctcttgttttaactagcaatgatggtaacaaagaaggagtatgtgttttattacattttttggtggtttatcttccttttcttgaattatctagcatttgtggttagatgtcttatgatcaattgggggataattttagccattatttcttcaggttctttagtcctattctcttttcttttcatggatcctaattatatcaggacctttgatactgccccacagatctttcctattaggctccccccgccaccgtgttatccacccactttcaaggtcactaattgcttcctttggctgaattgtgtctactggggaacccgttgaagtggccatctctcttaaatgataacattccattggtggcagtttatgtttttggtttttttttgttttgttttttgttttgtttttgtttttgtttttgacacggtttctctgtaaagccctgactgccctggaactcactctgtatgtagaccaggctatattcctcgaactcagaaatcctcctgtctctgcctcccaagtgctgggattaaaggtgtgtgtcaccactgcccggccattggtggcagttttatttgatttgtctttacagtttccatttctttgctggaattacccatctgattttttatgctgttcttttttggggtcagagccaccaacatactgcttaacagtatttaaactattctagtatgtctttgtgtctgactcttttttggttttgtttttctttgagcatttctttctttgtgttctcgtttgccttgtggtttaactttcttggaagcctgacttactgtgtacgtgctagagatagaggtacataatttttatgttttgtatgggcatgcttttgtttctgctaggcctttcatgttgggatttgagttaatctatttaagagttgagctgccccccccatcaccccatcattatagtttctctcagactaccttaggcttcaaattttcttagtgatactttgtattagtgtgggagttagtaccagttccattcaaaattttgaatctcccctttaatgccttggcaagtttcttccttccttcctttcttccttccttccttccttcctttctttctttctttctttctttctttctttctttctttctttctttcaataggctcttgttttctttctttctgttgaattttgctttagtgttcctagaagctctttagcttgttgaaatatgatctctgtttttctgattaaaccttggatgtaggttgaagtcccagggtcctgcccctctgactgttctattggcctctttgtggaagactgtcctactctcagaaggatacagcattcctccacccctctttcatggagctttaacccaggccctaaggatagaagtggataggggcactaactgcctttctttctttgttggacatgggaatgatggggggggcggggcttgctcctctagcactgctgttgtacagactacatcacaggactgcatcacaatgggtaccctcaaggctctttcctttgcctcagtgcctatggggtatgggcaggggttagtggctggaggggcataatcctgcagaagattgggctccccaaactctgcagcccccagaagtttcacagtgccccttcagcaagctacgccaagctctcaccactttgccacctgtttcaaaccctcccttttttccgttgactcatagtctattccaggtaagcaccagattgtctcctgtctctctgcttctttactttttgagccaactgtttgccctctgttgggtcagaaatctggttactcttaagattttcacatacgtgtatagttaaacctgaatttagttattattcattttctcctaaatgagactgagattttagaatggttattcttaaccctggtggccttttccatgataatgtttcttgtatgttaatcttgctttaattaaactaccctacgcctataaaatagtgaatattttctttaaatttctttgctcaccattcttcattcacaccctttcttccttgttgtctcagttcccttctgtcaatacataaatgccaactctgctttaaggaaaagagccaaatatgagtaagaatgacctgagaccatgaatccaagttactctgaatggtctgttctgccatgggagaaggctcacgagcttttatagtcatagaaacgtgtaggtgggggggccccaggtaagtgggggggaaattgtaagccttgaatatcagtgttagggttgaggggatgaggcatggtaagcttagtgatgtattccaagagctttatctgaaagtcaagacgttttagatcacaaacaggctattaaaaagggacaactagtaacccaaaataattttgttcttgacctgaaagatccaattacactataatcccagtgttctcctcaaccaaggtcaagctgtctgcaagctccctaatgcacatgcggctcattcagagaacttcggattctgtctaaatagtattcttaagtagttctttcagtaactgtccattagtagtaaatctgttcttacttaatgtgtctgaaaatgccctgacttaatgtttctctgctaaatggtacatagaatttcaggttgactgtgacaagcttcattaatgaaaaatttgtagttcgttcacttgtagttttcctagcaggcacatcaatatcttttctcttggacctcctttgaagaccttttttgcttttggttggtagtttctctgcactatctttctttttgttgttgttggttggctggttggttggttttgagacagggtttctctgtaacagaaccctgtaaactcagtctgtagaccaggctggccttgaactcacatagatctgtctgcctggacctccggagtgctgtgagtaaagacacgcttgactctctgcactatcattagccgtggatttactcttatttatcttgcatttattttgtatattccatcaggagactcctgatagtctcagttgtatttgtggtctttagaaatactgtttctctttcattttcactttctggagctattacttagatattggaacttcattgttctctgtgtatgtgggggagtgtatttgggtacagttggggatatgtgtagaggcaagaggacaatgttggatatcatttcctcattacctgttcaccctgacttttaaaatcaattctatttattttattttagctatatagtatgtgtgtgtgtgtaagcacatgtgtgcaatcaactgtgtgtgcaagtacctgtcagcctgtacacatgtggaggtcagaggacacctttatggaggaagttttctccatctatctttatgtgtgttctggggtattgaagttagattgtcaggctttgtgacaagtagttttacccttttatctctcctccttctctcccagacacagcttttttgtccccaagatagatttctccttggcatggagcttggctaggctgagtggctagctagatagccagcaagtcctaaggatccattctagggcacgcaacacccatgtttctttcaattgggttcttgggttctagggatcgacctcagtccctcatgcttaggaggaaagtgttttcccaactgagctatcactgcagccaagatattctttactattttaatatttaaattgtggtatttctaatgacttcttggcatctttttacaaaagaaaataaaagtttatttagtgtatactaagaggggcagtgggataggcagtcacaagagtactggctgtaacacatttcttttacaactcaccaatttgttttctttaacatatagttatattgagctttggattcttttcttaaggggttcttgaagaaggaagactctcacttcctgttttcccttgagcccttttgcttgtttctgtatgtagcttttggcattcattaacttataatctgcctatgcctaggttctgaagtatgattagtattccttaaccattctttttgttttgtttggtttcgttgttttgttttttgagtcagggtttctctgtgtacctttggctgtcctggaacccaatctgtgggccaagctggcctcaaactcacagagatccacttgtctctgccttctaagtgctggaattaaaggtgtgtgccaccactgcccaggctccttaattgttcttaatattgtttgaggtattactcagaagaggaactgtgaattcagatggtatctgaagaccatcttgcagccttttggtcacttttgagacttgttactcgttgccagtgagaagtataagtcaggtttttaagaggaggagtctctctctctctctctctatctctctctctctctctctctctctctctccctcactctctctctctttcattgcctagtgctttggtcactttttcttggcacagtcttggactgatgtgtggagaaattctttttcaccgatctgtgtacttatggtggtttacgtccagtttcttcccatgcagacctgaaacattttcagcttcttgactttatagtcatttgagttgcagttcttggtttaggaggtagaaaggagcaggtctttgtcctgtggtacattgtgtagaatatagtgtctgtatttttatcacttgctccgattattattttcttcccgtgccatcaagtagttcagccagttaaaaaccaggaagaagatacaactatagacattttttactttgcactggttatatgattgtttaaatatagctcatagcatctaatagtaatttttattttttaaagggctttttaaattttccaaattgtaaaacttaggagtctgttttttccactatatggatcaaattcatagatttttttttcttttgcagactacaatcgataaataaagataacttctgttggaaagtgaaatttaagattctcagaagggactatgtagtggtgcccaaccccactcagtccattttctgctgctataacacactcctatattattcaactcatgtttttgaaggttgaaaagtctaaaagcatggtgccagtgtgtgttgagatcattaatgtgatgtgaccccatggcagaaggcaagtaaacaaaatattgagacaggaaattgggccaaagtaatcctttttatcagtaagtactctcttactaatgatatcaattccttcttgaaggcgagtcctcatgacctaatcagttcttaaagacttcacattagtttttgaaacagaatctatgtaggtgtgcttgtcccatagctcactatgtaaaccaggctagatttgaactcatagagttccactggcctctgtctccataacgttgggaagaaaggcagaggctaccatactcagcaaggctccacctattaatgttgctatcatgccaactacatattgacatgaatcttggttggtttcccactgggtgttacaaatcctccccattactttcattcttgctatgaaggccaaggttaccattcatgatgagttagtggtaaccttgccttctctccaccgagaaacttcagtgttctgattttctccagctcctggaaccgcctgcaaataaatcagcttctagccttagaccttttcttttcatctttcccagatgacatactgctcagtgcttcagtgctgttggagactaggcccttgccggggagcctcggcttcactgcatctattcgaatagtcttctttccattgcctggtccctctttttctccctagcttgttctcagagagttctcaatggggaggaacagttttttttttctctctcaggacatcttgtgggtagaggccaaggatgctggcaagcatcctaggatgtacaagctctctgcccataacagaattatctcccttaaatgtcagcagtgctgaggttgagtaaccttgttgaatccttagtttcccctttgcctcttctgtttgctctgtcggtattctttttattttcattttttaaaaaaattatatatttttattttatatacattggtgttttgcctgtatttgtctgtgtgagggtatcagatcttggagttacagacagttgtaagctgccatgtgggaacctgggtcctgggtcagtgctcttaactgctgaggcatctctccagccccctccctctctcatccatattcttactgctaaggttctcatcctagaaaagcgttcttgagagctgtggagatggttcagtagttacaaacacctactgctcttgtagaggtttccagggtctacatgattaacttaacactgcctgtagctccagctctggggagtctgatgtcttcttctggcttctgtatgtacctatactcatgtgaatgtaaacacgtgcacacacacaatagttttttttaaaagattctatttcttaaaagaaaataaaaacttgtgtgagccacctatcaacttctcttctagcttcctaaccttcttatctaaacggcttaaagtgctcaggacacagtctgtccatttttcattcactcttcaagcttgagctgttgcttctatcttctcacctttattaccacttgtattattttttctgagctcaatagtgacttcttgtatgcttcatttagtcaatgcatttagtcctaattttacttggcatttcagttgcatttgacaaatgaatgtatactcaaaagactggcatctgtgttttctgtgtccttcttttatatttatttttcttgactcccatgtgagtacttattcgaccctttctcactttgtacttttttgaaacaggctttcagtgtgtttccctggctgatctggagctcatagtatagaccaggctagcctcaaactcacagagatccacttgcctccctctccttaatatttttctgaaacaggatttcatatggaccatgtggatcaggctagtcttaaagtcatgagtgctaggttcatagacaagtaccaccatgccttgagcaaagttgtttctcctagttgtctcccttgcttgtttctgttgagtgtgtgggttgcttccttgaactggtaggattctaggactcccattcctcagggcatgtacagttgattggtgccttgatccatttctcaggcattaccattactgagcatattcctggtctcagttggcattttagagaagcaggcctgggtagcatctgtcctactgaaagagactagggaaggaaggatactggcaatagtgttccctgctctgcagtcatgtagcttgttggcatctttccttttcttatttcctactgcttctaattgtattatctttcaaaggttcttttgggaaaatatatcttttgtgagcatgcctctcttctcttctcttctcttctcttctcttctcttctcttctcttctcttctcttctcttctcttctcttctcttcgcaacaaagctttgggttcttcaaatttgtggccaaggacgatgagcctctaagcttccagctttcatctcctcagtgctccgattacaggcttgagctcctatacctgattagtgctgagcggagctactgtctagtcaaccattttaaagtagaccttttgggccccatacctcagtgaattccctcattttctctgttgttgacatcatggcagaagatgcctttaaaagcaaattcttgtgtatacttatttttcttgtttatactttaatttttttaaaaaaatcatgtccttatgtccttccttagttttgctatgggcaacagtacatgattcctatgtgattgtgccacacctatgaaaagccagggagaaattttggtcacctgaacaaaagttgcttgttaaaaatgtgtgtcataagctgggtggtggttgcggcagccgcggcagcggtggcgcacgcctttaatcccagcactcgggaggcagaggcaggtggatttctgagtttgaggccagcctggtctacaaggtgagttccaggacagccagggctacacagagaaaccctgtctcgaaaaaccaaaaaaaaaaaaaaaaaaaaatgtgtgtcatgttgggctgaattgtttttgttgtattttcagaactactagtgagactgggcatttatatggttcattcattggctgtttatatattttccttctgtattttctcttcatgttaatgaaagacttttcctctttagtaccctgtttcaggttttgttaattctgtcaatagaaaataagcaaacatttaagttatcaatcagtttactttttagtttatctttagtatctcatttgaaaaagatcataaagcaccaacaaccttaaaaataatgcatatttcactggacatgacggcacagatctataatcttagtactcaagaagcaggggattgctacaagtttgagactgtttttgttttctttccagcactggctacaccccctttccagacctggttcaaatcctgtctctagtgtaaaatatggccttccagtctgaaataaacactctccttcgagtattcatagttattttatttgtttagctcatttggtaattataaatctgaattatctcattttgcttgctgtcctctattatcctaggatcttgagatatttccgtgtttgttcaagccagcaaaaatttattgagtacttgcattgtcctaatggcagagtaaagttttcagatattccaattcttacaactgggccatatgatagtttaaggaagacttttatgaatgtcttgagtttcatgaatgattcttttatatgtaatatagtgtgactggtgatgtcttgatgtgtcattaatgtgaaaatcaactttaaacattatttcatctttattatttatctttccttaaactgcttagccttttcacagatcttttagaaaactatttccaatgctggctgtctttgtaagttgtatcgttgcagtcaaatgctggctgtctttgtaagttgtatcattgcagtcaaatgctggctgtctttgtaagttgtatcgttgccgtgctttattgacatccttgagctgtgcccccttaccttcatggtggccatcaaacccagggacctggacatttacatgagtgagtatccctgaggaacaatctataggtcggttttgtttgggaattgatatcaaaagaagaaaataataatagacttattttctataacggatttgttttctaaaagtggtttgagcttaaaagctgttacagtctagcatcaactgggggcttttcttagaagaataacctttgtgtatagacttgaaggaatgagcacaaggatgtagaatggttcttgtgagaatcctgttcatttgatggattgtagtcgataattgaattttttttaaaaaagaatgacagggtcttgccttgtagcctacaaaggcaagtcttccgagaactgagattcaagatgtgcactcccacaccttgctaaattaatctttaaagttggatatgttctatataactaagaacacatgtataactgtataactatattgctataagcatgtgtttttatttttacttatgtgactgtgactgtgaggggggaaagaaggggaagggaagggagaaggaggaaggaagggagaaagagagaaagtgtgtgcatcacacacacacatacacacacacacacacacacacacacacacacacacacacaaattgcaggtaccctggaggccaaaagggggtattgcatcctctgaagctggaattacaggtggttgtgacctgcctgacttgggttctcagaattgaattctgatctataagaacaatgtatgctttttattgccgagcaatctccccagccccctaaaacatgtttcttcaccaaagctctgtgacatctttattatatgaactatgttcataatctgtcctgttgcagcagtatacagttttaatttgtgaacatgaaacaataatttagacagttggagaaaccatctagtacagaatgatgtttttatagttctctcttgtttttaatattatctaacccatatctaatttgacagcaacattttcaaagtgattcatcacctttgttgaatcttgccaaagcatccaatgtaatttttacttacaatgcaactctctttcagttgctttttcatggtacttaattgaaaaccatgcaatgattagtataagaagccataacagttttagggaagaaatgcaactgacttggatgttaaccatatagctcaatttaagggaccagaaatgtgaggtgaagctgaaagttgtttctcaagtttgtaatcccaggactagtgaggctgaggcaggaggatcacttcaagttacaggctagcttgagctacaaagtgggttccaggacattttctgctacagagtgagactctgactcaaagaacaaagaagggttccaaatagtctgagggtgagttaagttttagtggaaacacataggttatcttggtgttaacctgtctgttttatagaggttggtgggggtgggtagtagtcaggttaggtctgttagacctgctgaacaccagtatggcttgaatgcacagtgtaaattggcgtttgtaatggactttattcttttcaaaaggtccattaaccatgaataacatgcttaaaagaatcttgccgaaggtaactggtattcagactgcctggagaaaatcactgtgttcacttgagatttcaccatgaccagcctttcccacacagaagagttagcgtttcatcaaccatctatgctttcttccttatctagatatgggacacagtttggatagtccttgatttttttagcacttttcacagagggttcactaaatctttttctctttctgtaaattctttctttctgtaatttttatacctaatgtttcatacgcagttagtctagcccagtgaatggaatgaaatatacttttggggggaggggcatgtgtcacaacttaattttgctcagaactttcattgatgggctttagaaaaatttgttgctacatatacagtcaggtcaagaaatactttgatgtagttatacttaatcaaatatgttctgtatgtcttaagataccccactgcctctaaagccctgacttggatcttgtctgcaaacacagttcttactaggtcagtgggactgtatgaagaggagaggttagagcctgggggaaaacaaaagacttagcacggataggacctcaactggcctgagaaggataatggcacttttggtgggtagctgctcagaccctggctgctttgtgacattcaggagttgctgtctctctcaaaggttttttccattctatcacacattcctagtgttgctctacccattcctagtttccttcccctgccacagttctcttttctttaaccttattctttctgttcttggtagagtgcttcattgctctaaccttatgcttctggaagtacacttttatcatttttgcatggcacaactcttcattgatagacctcttacaatactctggtcaagtacataacgtatctttactggactgcaacttttggagggcaagtcccatctttgtaggtcttaaaatagtctttcattttctaagtagcaggatatgtatgtatgtacgtatgtatatatatatatatatatatatatatatatatatatatatatatatatcttcactctccaaatttggcttatcttccagactttccactttctgttcatagcactagagttttttccaaggccatatttggttggcaagttttgctttgtcttgataatgtatttgtagccatactgttttctccaccctcatcaaactcaaggatttagtgcacagtgtgttctcaacattcaataggggttagaaatacaaataatgagatccaagctcttgttctaagaataataggtgaggtgggcagagatggggaaagagtgaaagacaccaagactgacgtattttggcattttagtgactgatttctctatgtgctatcataggcaaggacaagctatagtcagtcatttcctataggctacttactcagctttaggaagaagctttagaagacagttgctgggtttcttttgtctgaaggagtcttttcttccctatgtttttagcatttatgaaatccagaagaatccaaatcctggcatgtatgttttatggagttttcaattctcccttcaagtgttgttaaattaattgtgcttataactagtagaacctcataactggggagctgtactatatattcaagcaagtattacagtggaagtatgtataataatacactgtcaaatatggtagctgtagccacatatggctgtgtaatataacttaactagactttaaatttaagcttaaagttaaaagatttaattccttggaaaaatgaggcacacttcatgttgccaatttgactagtggtattggacaatatagacagtaaagcacttccgttattgtaaaatgtcctttttgagcagtggttctcacctttcctaatgctgagaccctttaataacagttcctcatgttgcagtgaccctcaaccatgcaattattttcattactacttcataactgtgattttgctattgttacaagtcataatctaaaaatctaatatccaggatatctgttatgtaaccccatgtgaaaatgtcatttgacccaccaagggggttgcaacccacagggggagaaccatacttttagatcgtgctataatgtggttctacagttggatctggagggctagaaaaagtgttagctctttgttccctggtgttattactacatttcttcttttaagcatataagggacttatctttggttttaccagtgcgtagaacaatgtgtaggtaccaggggtggggaaaaaagatggagtataaatgagctcagatggaagtgaggaaatctcatttcatagcttagccaatgtgtaacggaatgccttttccccctttgtttcttgtttatagtttttttttttttgaaattacaatatattagtcaaagccctcttctttccctttcccccttccatcccctgccatgtatctacctctctttgttctgaatttgtggatttaaaaaaaaaatgttacaaacagacgcaggacttgcgcactctgtataatgttacttgtgctttttccagtttgttttggagacaggtctctgtagcattaagtctgcagtccctttgcctcagctttctgggtgttgagaatgccagtgtgtgccagaggttatttttaaacaacaaacttgattgcattgactatttaaggatttttgcataggttcttatcatgtatggagtgtggttcaaggaagctttttatgttagaaggttatgatttaatggaatgtataccatagtgaaaatttctgaattagaaatttgtagtactatttgtattttctcagagaagatatagttgggattgatagatggaaataattacataaactattaattcccgtggctttatttttgcatctagtgagtctggtttgcaaggacttgaggcaaagtgttcctaaatctttttcttgttcctattttattacatgaaggcagtctatacatcctcccattaatgatcatctagatagtttctttcatttggctagcaaaacatgggcagatgctttcatttctccatgttacataccctagggaagttgctaagctataacaaagatgtaatgcccaacagttttctaaggtagctggagtaactcatgttgcttttttttttattctaagagattaaggtttagtcatgtttggatttttatatctatttatttccccacatgtctccagcctgtgaaatcacaaataaacctaaaaatagtacagatctatactgctgtccaaaatacctttaaacagtacaagcaccaaggacattcttttttctattggcaattactaattttgacttgtttgtgtgtttgtttttttacatttttaaattttattttaattaggtattttctttatttacatttccaatgctaccccaaaagtcccccataccctcccctcccacttccctaccccccctcccacttcttggccctggcattcccctgtactgaggcatataaagtttgcatgaccaatgggcctctctttccagtgatggtcaactaggccatcttctgatacatatgcagctagagtcaagagctccagggtagtggttagttcatattgttgttccacctatagggttgcagacccctttagctccttgggtactttctctagctcctccattgggggccctggaatccatccaatagctgactgtgaagagctacttctatgtttgctaggccccagcatagcctcacaagagacagctatatcacggtcctttcagcgaaatcttcctagtgtgtgcaatggtgtcagcgtttggaggctgattatgggatggatccccgggtatggcagtctctagatggtccatccttttgtctcagcttcaaactttgtctctgtaactccttccatgggtgttttgttcccaattctaagaaggggcaaagtgtccacactttcgtcttcattcttctttagtttcatgtgttttgcaaattgtatcttgtatcttgtgtattctaagtttctgggctaatatccacttatcagtgagtacatattgtgtgagttcttttgtgattgggttacctcactcaggatgatgccctccaggtccatccatttgcctaggaatttcataaattcattctttttaatagctgagtagtactccattgtgtaaatgtaccacattttctgtatccattcctctgttgaggggcatctgggttctttccagcttctggctattataaatagggctgctgtgaacatagttgagcatgtgcccttcttaccagttggaacatcttctggatatatgcccaggagaggtattgagggatcctccggtagaactatgtccaattttctaaggaaccgccagactgatttccagagtggttgtacaagcttgcaattccagcaacaatggaggagtgttcctctttctccacatcctcgccagcatctgctgtcacatgaatttttgatcttagctattctggctggtgtgaggtggaatctcagggttgttttgatttgcatttccctgatgattaaggatgctgaacatttttcaggtgcttctcagccattcgatattcctcaggtgagaattaattgtttagctctgagccccatttttaatggggttatttgatttttctggagtccaccttcttgagttctttgtatatattggatattagtcccctatctgatttaggataggtaaagatcctttcccaatctgttggtggcctttttgttttattgacggtgccttttgccttacagaagctttgcaattttatgaggtcccatttgtcgatcttacagcagaagccattgctgttctattcaagaatttttcccctgtgcccatatcttcgaggcttttcccctctttctcctctataaatttcagtgtctctggttttatgtggagttccttgatccacttagatttgaccttagtacaaggagataagaatggatcaatttgcattcttctacatgataacctccagttgtgccagcaccatttgttgaaaatgctgtctttttttccactggatggttttagctcccttgtcaaagatcaagtgaccataggtgtgtgggttcatttctgggtcttcaattctattccattggtctacttgtctgtcactgtaccagtcccatgcagtttttatcacaattgctctgtagtaaagctttaggtcaggcatggtgattccaccagaggttcttttatccttcagaagagtctttgctatcctaggttttttgttattccagatgaatgtgcagattgccctttctaattcgttgaagaattgagttggaattttgatggggattgcattgaatctgtagattgcttttggcaagatagccatatttactatattgatcctgcccattcatgaacatgggagatctttccaacttctgagatcttctttaatttctttcttcagagacttgaagttcttatcatacagatctttcacttccttagttagagtcaccccaaggtattttatattatttgcgactattgagaagggtgttgtttccctaatttctttctcagcctgtttatcctttgtgtagagaaaggccactaacttgtttgagttaattttatatccagctacttcattgaagctgtttatcagctttaggagttctctggtggaatttttagggtcacttatatatactatcatatcatctgcaaaaagtgatattttgacttcttttccaatttgtatccccttgatctcctttagttgctctggctaggacttcaagtacaatgttgaataggtagggagaaagtgggcagccttgtctagtccctgattttagtgggattgcttccagcttctctccatttactttgatgttggctactggtttgctgtagattgcttttatcacgtttaggtatgggccttgaattcctgatctttccaagacttttatcaggaaggggtgttagattttgtcaaatgctttctcagcatctaacgagatgatcatgtgatttttgtctttgagtttgtttatataatggattacattgatggatttccgtatattaaaccatccctgcatccctgaagtgaaacctacttggtcaggatggatggctgttttgatgtgttcttggactcggttagggagaattttattatttttgcatcgatattcataggggaaattggtctgaagttctctatctttgttgggtctttctgtggtttaggtatcagagtaattgtggcttcagagaattaattgggtagagtacctttggcttctattttgtggaacagtttgtgaagaactggaattagatcttctttgaaggtctgatagaactctgtactaaaaccatctggtcctgggctttttttggttgggagactattaatgactgcttctatttctttaggggatataggactgtttagatcattaacctgatcctgatttaactttgttacctggtatctgtctagaaatttgtccatttcatccaagttttccagttttgttgagtatagccttttgtagaaggatctgatggtgttttggttttcttcaggatctgttgttatgtctcccttttcagttctgattttgttaattaggatgctgggcaattgactaattttgaaccacatgctattgttcttcctttctttgtaatttgatcgcattgaatgttggattcctattgctttctgtgataggaggaagtgatataatgagctttgtatatcactggtatgactgttaagtgtttgggaacttatgatgtgaagtatatcagaaagtaaagaacaaaagtattctgaattttttaaaattaattttgtggtgttaggaccaaacccagagtcttacatatgctaggtaagggctctaccactgaactatttcttcaacctgttctgtaagtttcattcagtcaagttcagcatagtaaattggtaagcttcaagctgaattcttggtatttgtgaggttctgttttaggcatctctacatctaaagtctgataagaatgagtctcctaaccgtataatctcatctaatgaggatagacacataatgcttagaagaacagcaatcattgtcactaggattacaagtaaggtgccctgtggcttctgtatcttatccgatttgagttgtagagaggagatggtatcctgtaagaattcatgggcgagtaatagtttatgatgtcaaatttgagaggattttggttaaggctgtgttctacgtgaggtgaagggaattgcttgatgaagtcatgaaactagaaagtatggtctatactaagttcttctctcagatcaggaggatcagcaacttcccgcagacttattagaaaggcagattcttggtacctaccaaaacaaacaaacaaacatacaaaaccaaaaccaaaaagccagaatctcctttagttaattgtgatacactaaaatttgagaaccattaccattgatctgtacttacctgctaagagaatagtaaactgcttttggttggagagtaaagattgatgcatgaagagatcaacagaaagggaaaagcttaactgggggtttcgagtgttagggtttaagtatataggtaccagcaaaggaagggtcagtccatgagatactttagaaacagtaagctgagacttctaaatagagtcagaactaagggctattaaactggtcatgccagtggtgcatgcctataatccagagctgaggtagctgaggtggctgaggcaggggtgactgagacaaatgaaattgtctcccaaaccaacccaatcaatgaaataaacagaacacctgagggatattggatgcagtgaaggtaaattaggggcacaggatatctgggacttctaaggagaccactgcaaaggagcggcaaagctgggatgggccagccttgacacaatactggctcaatggcaggaaaaaaagggcaactgggaatcttagaagtagctgaggccttggacctgggtgttgactgtgggccttgcagaagctactcaggcataggccagatgttacatggttcagaaagtgggctatggaagacaaaactgttttctctaagtaaagatacctccatgacacaacctcgctggaggaaatgtagggacttgaaagaaggtgaagagggaaacagaattgccttaaatcccactttactgagataagcaaagcacgtcctgtttaaatatttatgagttcacatttgtttatttaaattcagtcggtatgcatggaattatacagttctacaaccaaaatttcttagacaagtgatcttaaacacatgtcagtgttccacacgtgagagtatacccaggtcaatgtgtgtttgaaaattggtggattttatgtttgagagacagaatgtttatacaagcagctaattggtaaagattgcaatttcatttggcatgattacaaaaacgtcctgtctgcatctattttacacaaaatctggagcaagacagtctgagatgcatggtgtgctagctattgggctgggaaaaaaaaccctcccaactgtaaaaaaaggaagggatttatgtcttttattagaatttcaaggttattcttctgttttataagaaccaattaaagcaggtgtgctcgagtacacctataatcccagtaccagggaggcagaggtggagatgtcgacaaatttgaggacattctggtctgtatagcgagtgccaaaccagccaaggtttcatagaaaaactgttttttctcctttgttttcttttgtcttgtcttgtcttctcttttctgtccttcctgttatgggttatttgttcttgttgttgttttcgttttttgagactgggtttctgtgtgtaccctggctgtcttggaactcactctgtagaaccggttggcctcaaactcacaaagattcacctgcctttatctccccggtgctcggattaaaggtgtgtgccaccacacctggcagagaaaccctttcttaaaggaaagatggaaaaaacaaaacaaacaaaaacccaattaatgctgggcttaataccatctgccaagttttaaaactctgcatttaaataggcagttgctagtgggaattttaaaaaaaaagaaaaaagaaaaaaaaacaagcaaaatgtggaatagtttgtacatttcttaagttttgtaagatttttgttcattgatggaatatatcatctgtaacaagattccccaccctttttagatacatggccacttctctgtcccttcttttgaaacaatcttccttcctcagcctctcaagtgctagtattggttacaggcctatactagcttgtggccattcttccatagcagtaaatacagattaatgcttgtctgttttttgagacaaattctcactctgtagcccagtctggccttggtattgaccaactgtaatgatcctcctgtctctgcctcaaatggtgagattacagaggtaagccaccttgtcaggctcagtcatgagaatacatttatttctatgacattaatcaactttatattaactggtaataggttagtttttgttgttgattttataagcagcactgtactatcaatctttggccatttgtcagataatctcctaaggataaatctctaaaagtacaaaaaatatgatttttatccaggggtgatgaagcatacctataattccaggcataggcagctgtagctctgagttcaaggccagcctggtgtccagagtgagttttaggacatctagggctacacagcaaccctgtcttgaaaaacaaacaaaaatatcatttttaaattaataaaaactatgtgtatggacattttgcctacgtgtgtgtctacaccacacgtgtatttggtgcttggggagaccagaaaagggcatcggatctcctggaactagagttaacaggcagttgtgagctatcatatgggtgctgggaattgaacccaggtcctctagaagagcagccacttcgcttaactgctgagccatctctctagcccagtggaaatacatggtttaaaaagcaggtatatagttaaaatgcttaatgcctgttgcagggttgttcttcaggatcctttatatttctactgtgagtgtgaactcatgttctctggtacttacaagggtactagatattcttcattgaactttaatcattatgtttgataagttaagcaggatttctttgaaagcttatttagacaagcatggtagcacacacctttaatcctaacaccgggaatgggcggggctgtggggccagaggcaggcagatctttgtgagtttaaggctagcttggtcgtcatactaaattgcaggacaactgtaataaatagtaagtagtaaaataaatagtaaatagacaagatacatagtaaaagcctgtctcaaacattacatgatatttttgctattgtgggtaagtgtgcagatatgccacagtgtctatgtgatatagtgtacatgtggagggcagagggacattttgcgggagtcagttatgtctttgaactcaatgttctaggaattgggttgaggtcatttgtcaggcttttgttgcaagcattttagcagctgtgccattttgtctacctggttaaacatgccttcttatttgtatcttgtttatatttctttttatgaggcagagtttcatgtagcctgagtgggttttgaatcaaagttcagacacttgtacttttctctcctaagttctcgggttataccttgttgatcttgtatataaatgactactcgtgagattagacaactgtttattcatttaaaaggaaaccatttcttttttaagataggccagttcctatagctgttctttacctgtttccttttggattgtttaaatcatactgatttgtaaggtgctaacatgttaaggatatttagtctgtctcttatttcataaatcatttgttgactttctaaacttctttatagtgatatacgaggagaggaaaacatcaagctatatgagacattagtgaattatcacaaagccaacactaatgtcactttacccacctgagacataaacactggcaaacttcccaaatccatggatatgattttgaatgaccattgatggctgagatcacagtagattcaggtggcacgagtacattttataaatagaattaaaatcaatataattactgaataacagttggtattctttttattatcaccatcaccatatggaggtcctttaaaaatatcatcatccataatgtctactttctttgtggctttccaattcattcttttgataaacaaatgttcataattaatgtcattcagtttatctgtctttgagattgttgctcacggtattacaatgagttattcttctgtattatcttaagagctgctttttcatttacattcagaaaattaatattaatgctttgtacaaattggaagtcgtttaatttcactttcccttatggacatccaaatgctagtatcgtttattggaaagatctgctctgcagtgccagcatccatctcatatgtgatctatttctggtctttcctttctgttctctcatctgcttgtctccatgactgagcttcataatacatcttgataatctagggagaaaagtctttttgttcttctacaagggtgtcttctttgccatgacaatctgctccctgtataaattttcaaattaacctgtaaatttccataacaaattgttactgttgattgggattatatcgggtctgtaggtctccttttgacatcttaaacatggtaagctttagtatggaaaatccttttatttttaaagctcctttaatttttaaaactattgttttcattttatttacctttacttatttaattttaaaattcgtttagtttgaaaaaaatgtgtgggtgttttgcttgcaaatatgtataccacatgtgtgcttcacatccatagttgtcagaacaaggagtcagagccctttggactggagttacagaaagttgtaagccaccatgtaggttctgggaatagaacctctggaagagcagccaatgttcttaatcactgagtcatctccctagctccttgtttagtgtgtatgtgtgatggtacacctatgatcaaagggcaacttgtacgagtcctttccttccaccatgtaggtcccagggatcaaattcagggttttttgcttgatggcaagatacctgagccatctctgcccccaaatagtattcaagacagagctttactgtgtattcttgactggcctggtatttgatatgcagcccagtctagcctcaagctcacaattgtccttatgcttcaggttagattacaggcacgtgccaccataaatggtgtgtttggtctttttaaaaattaatttatttttttctttgacagttttatgcatatatatgatgaattttagtcttttttcacatgtagctcaggctggccttgagctttttgtatggctaagaatgattttgaatttctaattagcctgccttcccttccagaattcttagattgcaaatgtgtattactttgtctacttaaaattctagtgttgcctagcagtggtggcacatgcctttaatcccatcacttgggaggcagaggcaggtggatttctgagttcgaggccagcctggtctacagagtgagttccaggacaaccagggctacacagagaaaccctatctctaaaaaccaaaaccaaaacaacaacaacaacaacaaaaacaaacaaaacaaaacaaaacctattgtttaatgttatcattggcttatacaaattaatactaacttatgtgtcccttatgttgataacattcattttcccctaatttgtaaactagggaaattttttaaagtttttttatctgtataatttgtcagtaatgacagggtttttttttttcctccatagtttatatcttttattttccttccaggcattattctagaggaaggaaaatttctttcttataataaaaatgtactcacttcatatccttttcctttgcaaagcagacattaaataaatgaaggtaagaaaaatgtcagcaatattatgccgaccccatccccaaaaggcatcctgctgggactgccactttcctaggactcttgaggtgttttaacagatctaagcaatggggaatggtgtaggctcccagtgaagctatgccagcctgggctaaacctctctgcatcttgctcagtggttccatggtgagctgaacaaccagaggacactgtcatctctcgagatctctggtattgattttgttttgtttttatgagccaaggtgttggctatgcctatataactaatactggcctggaacttgctatatggcccaggctagcattgaacatgtgctcctattgctaaattcagcctcctgagtgctgggattataggcctctgctgccatgctcagctatgtagccttttcttcattctgtgcacagccttttgcttatctggattacttaacattagtaaaaactcaaattctttctgaatgaaaaactaaaactgcaacctattttcatttctgaattatttcaggttataagcccaattctgttgggacctcagtggccatgagactcagttaaaactcataatgccaccaatgttaataataatgccacaaatattcctagaggctgtttaaacaaatcacttaaaatatttttaatacttgaaatttcattttgagagcaatgtgaaggtaaaagagttagagataaaggcttgctagtggttacaaaacttcctccaaataatggagtcactagtgaagccacagggatccctggtgaattctttctcagtcattattcttaatattctcccacaggaggtagcccagggaggtttccacgtttgcagtagacattgccttgctcttgtgatactgcatggtgccaatagagataggaatttcgggaactctagaaacggcacgggcgaaaaggagcgaatgtgtatctgcgtgggcaatgtcagggactgtttgccaaggaaaattccaagttggctagtaatgtatttagttacagctgaaggattaattaagtattgctataggttgtcctctggcaatgtcatagtagtgacaaaagtgagcaaaagaagtctacgggccattgtggcctgccaaagtcaagtcaatggagcatacgatggtatcccataactaaatgtacagttggaaggctgaagttggagaattgccgtgagtttcacacaagcttgggctatacagtgagttatgggctagcaaggggttacagagggagaggtagagaaaaatcagtggctgttaggcagcctcaagaactagatgggaactgaagaaattattgctgcagggtcacctccatgggaagaactcctggtcatcatgactgtggcctttcagtagcacaactcatgagactgatgagctactactgcactaaaacggtgcttatgtgacagttttattttggggtcatatggcgcttttgatgagtaagggtttcattcattggctatttggggattataagagtgggcaagccaaaactaaccataggtttgtgaaaggacaataatgtttttttcccttgtattttcgtctttgccagcctcttttacatggtaggtgtttgatgactgtcagtggtatgtgtggatcatcattaagacttcagaagacttctggacactcttaaatgttactcaaacgagctcagtttaaaaaaaaaaggtttatctttgaccaaactagctgattaagtaatttcattcccctagattaaaatattttaataacaagtttagaggaaaatcttattctaattttagaaaatgatgtatttgaattcaatttgcagatttcaagtttgaaggaaaaaaatagtgatggctgtaattataatcagcagatgaatgggatgtgagacccatttaagtacaaaatatgaccttaaattaattaattcagaacattctggatgctcttcagactgtgatgatattttaagtaaaaatttcctttacaggaaatataaatggaatctatgctatagtatagtaaggattctaaaggaagccatgtggagtaaagaggtttttgtttgcccagcatgtcttgctggaccatttttatgaatttgtgtgtgtctttcttgagttttgaatttatgggatgagtaaatgattttttccctgtcctaaacatacattttctactgtctacagggagggatctagaagtagaacttcagaaagcacagctgcctgtatagtttaaacatatttctatcgaatagcaccatctttgaaaatggtttcttcttagcttctctatatggagtaaattcaaatatatcacaggactatttcttttaaatagagcatgaaaataattcttctgtttatttattagcatgaatagcttccaatcttctcccctaccccgaacacatattttggtctttatagggagggattttaatatataataagtttttcaattacaagtagtatgtcagagattagtatctgaatctggtacttaataattgttcgtagtcatggtagactgtcttttcaattttgaattattttttatgttcttgaatgtgatagcctaactatagtattcatactgtcacagtgatggaagaaatagttgataatttaatgtttagggagatgtattaggctgttatgattgttaaatcccaaatagaaggactggggagagcactggtgagagcatttgctcttctccttgaggacctgggttcaatcccagtacccacgtggtgctcacaaccattcataactctggctactaggaatccaatggcctcttctgcccttgggcaccagcatacatgtgtgtatacacacacacacacacacacacacacacacaggcaaaacattcatacacataaaataaaatcagtaaatctaaaagaatcccaatagacattgaggaatttttggaaaagctgacttaagaagagttaaggctgtggaaggggctcagttgctaaaacacttgccatagaaacctggagatgggagtttggatcctgagaacccacataaagagtgaggcagctgtggcagccacctgtaattccagcactcaggaggcagagaagggctccctggggcaagatggctagctaaactaactcttattggctagttctgagttcggtgagaaaccctgccttaagtagttatcaagcaagatacttgaggtcagctttaatcctctacagatgtttactcacacattcacctgcacaggtgtttacatccacacacagacatttggctctgcataacacacatacatgcacacaccacaccacaccacaccacaccacaccacaccacaccacatctaccctaccacactggaaataagtgaagcagacatttcagtgtctagtttggatgttggttcttcagcccgtactcatttcatttagagagagaagatatttcctatggcgtcatgtttagctgatcttgaactcatgatctccctgcttcaaccttctgagtacttctgcactttttataattttagagttagaattcataaactcactttagggaacacttatttatacctattatttattaatccatttcttgtagcaagtccttaaaagaaaatttggttaaaatagcacttaaaagctgaaatgttaacacattatttttgttacaataacttagattaaatatggttagattatataataggtattttatgtgctatatgtggagaaataattaaagatgataatagagcaggcatggcctgatggcacagtgggtaaggatgcttgctaccaaacctgatgacccaaatttggtccttggaacccagaaaatgtttcctaacctccatatgagtatcccctacacatccactcacttatacaagtaaatacatgttaaaatgaagtaaatggataaagtgaaactggttctttctgaaaaaaaaaatcagcttagtagtaatagaaaagggcctttcagtgcttaaactcattctgtcagtgtggctggattacaaattaattgcttactattgagtatatggggatccagtgagataaacggaacggctgtgagcattgtgggagaaggctatttattactgtaatctgccattatcatcatcaccatcaatcggctaggttgggaatagatggaaagcagatagtcactaatagatcctctaatagcactggtaaaggttgataagtgatgggttactcagaaaatttttagaaaccaaatgtgtacagccacgaaagtgctattgcaatgtgtctttttacagagatgtctgtgggaggtattgcctctctgagtccacagcccacagctaagcatatgttgttgggtgcttggcttctgttggccagctcagaggaaggactctgagctgggactcagagtgggacaagagaggaaatcaggaggatatggaagatgctatgtacctctccatttgattttactgtgtttaatgatgaaggctttccaagattggttatttgtctctccatatatatcatatatttttggaaatatttgaggaaatagttgacagtttgataacctttccataaaatgattcaatatgttgagcttcttattttgagcatatcttttggttttctctcatcaaaagatgaaaatggcttccatttctggctccaggggcagttggaacacttgactagcatcgactaagccatgaattatatccccagcaacagcctaactttttttatgttcttatgttatttgtttgagtaaatgttcataagctgtcgtcatcactggagaatttaaaacgctgtattttagatagcttttcttttgtttcttttttccacctctccaaaaaaacccaaaccaaaacaaacaaacaaacaaacaaacaaacaaaaaaccccaacactgatctttctttaacacacttcattttataataatttaatccatttaaattattactgatttccccttcattgttattgaggctttacagtgccaccaaggaatttccacacaggtaataacattctaattttggagagaaattgggtacaaaattgaaacatgattatctttgcatagtctttggtgggtttggggttaaaaataacaaagcaacccttctataatgttaaacattagcagttgtgaatcaaaggagatggccttttgtagaagattttaatttgaggacattggggctctctgaattacagaatgtcgtcatttttcacattgtatgtatttatatattcagcaagcaaaattaagtacttgtcggttattggatactcacaatatggctcatgttttgggtcagccttctatcttctccagcatgaatataatatacattcctactaatttttttaatgggtagctgataaaggagtggtaagtgtaagataaaatagaaagtcctgccattgcagtcatttattaccttcctgcagtgcatactgggttaatgtgtttccttttcatttactcttataccccctccccctccggaaaatcctttctaatttttaaaggcatgtttgttgacactaactgaaatattctagagagttacatctcaggcatggttttagaatatttagtgtgttttaagttggtttccagggtctgtttgcattaagatatatagtaactgacaagcagacatttgtcatccaggttaaaaaaaatcatttcttggtttactttgtattcaggtgcaggtataggagtaaatgttagccagtggaatacgaatggaagtgttggggacatcttttgtgtttcccctaaagagaaatgagtttggctctccctacatcccactttctccttttttttttctgtgactggaatgcagtcaaaatggtggaaaactctggaacatgttcctcagatatttacatgaaagagatataaatttctgttttatttaagccactgttgttttgagcttaatgttagatcacctaaattgatatcccaattcaagtattagtatgcagtgattcatggctgtaatcacatcaccatgtaggctcaggcaggattgctgccaatttgaggccagcttggactattgtcttaacttctttcctgttgttgtgacaaaataccctaagaaaaagcaatttaagaaagggtttgttttagcttacagttccagagagataacagtcactatggcagggaagaaagggatcaggggcgtagatcagcatgtcacattgcatcaggaagcacatgaatgcatgctaatgctcagcttgctttctctattctgagaatattctgtctaggctcccctacctgggggaatagtcttgcccatagttaagatggatcttctcatagcagtcaggataatcccccatggacaggtcattctagagctgccagattgactgttaacactagttatcacagctgtattaattatcacagctgtatagtgacctttaggccaccctgagctacaatgtaagactcgctcccaaaagcaaaacaaaacaacccctgtcaaatatcatatacttcataatatgattaggcattggctgaaagaatagacattttctcaaaaaaaaaaaaaaagacaaaacaaaacaaaaaaaaaaaacttaagggcaacaagattttgtactaactcagtttatcatctgaaagcaattcagaaaataaccaggcagcttttacctttaagatttgcccttctccaggtaatttctaagtttctaactcaactagttgcaggtcttttgtcactacctcctcaaaatcacaacccaaagccccatatctgttggatcttctagtgatctctcaagataattactgtcttgatttaggagttaagtccccatctcccagaaaggagaatattctctccgtctttggccagggctttgtctctagtcagataaattatggcccagggcagtggcgtacgatattgtttaactggcatctaaagactgtgactgacatcttcgtgtttttcctaagtgtggctaggatggaaatgatgggtgtcttctctgagcaaaagtttatgacaaaggtttttgaaacgtgttaatattttcttactgttaaagtggttctttaaaatatgcaacagttgaaacgacaaaggagaggctgaggatgcagctaagttggaaaaatgcttgcctaacatgcacaaagcgctgtgctcaaactccagaactccataaagcaagcattgttggcatacatgccgataatcgcagaaggcatggaggtggaggcaggaggatcagagggtcacatagaaagctctgatatagcaagtcttgactgcctatgtcctgtctccaaacgtgtaaattaagaaaaggcaaaacacttgaaatatttcaggagtctctttgtttatgctaggttgtaagacctaaagtaaaatgctaacattactcagaacaacaacaacaacaacaacaacaacaacaacaacaaaaagagtatcgtgtaaatctataaattagaatatgtaatttggaaaatgtaagtttattattggctaaaaaaccaataatacatactggaggatgagtagttcattcttttaatagtacttatctcattataaaatatagttttgttctgtttgataccttagtctgaagtaatttggatagagttgcaataatgtatgcttccatattaaatttgatatctgaattttggaatcttatttggcctgtggctttgtacatattgactaagattaaggttgcttatttggaggtatagttattataataatgaatattattcatttttctagaagattttttaaatgcagattgaaatagaattgatgctttcatgataaaatgaaaaaaaaaacttgaggcatatatatagtatacatagacctcttttgtgtgtgtatgatcagacatgtgctcctcaacatactctagctcaatggcaagttccaggccaaatgaaaaatcttgtctcaaaaaacaaggtcaggctgggcatggtggtataggtctttaatcccaatattcaagagttaatggtaggtgtctttctgattttgaagctggcctgatctacaccgcaggttctaggccatccaggactgcataatgaaatcatgtctttaaaaaaagctggatggcacacatgaagaaaaacacaagagtttgacttctgacttcccaatgcatgcaagcccacaaacatgctcacacaaacacacatagacatacacacaaagaagcagagagaataaagattaagtatatatttgcatatacgtgtatctgtatttattggttttgcctttcttcatgtcttcctttctttattacaatacagctttgcccctatccaccttccttgtgctttactagcccttaaataagtgtgtggactcaacattactgtcctgtgccatttacttcagagtacaatttcttaaatatgtcttgtatgttatatcttctggatgtcaattacctcatttttactttttaaaatacatttattttgcctttatgctagaaacagtagacaggtttcagtttgtttgtttgtttgtttttgtcagtattgactgttgaattgtcatgatgctgtctccttttctgcccttcctctgtctccctcacatctttgtcttgctatgtgatctcaactggtttggaagtcacttatgtagcccaggttggccttgctcattgagcagttcctgcttttagcctcctgtagtaccagcactctgcctatatgctatcaagtcttgatttctatcttttctaactagaaacctgctattgacctggctaagtctgccttgtatgtgacaagctcattttacttcttttaccattttcctagttttccagtttgagtgtatgtcttggcatggatcttcttgtgtttattctatttgaggtgtgtcgaggtccttagatgttgtgctagctactgttccattgctgagaagagacactaagactaaagcaactcttatgtaagagcatttaactgggggttggcttatagttctagaggtttcgttgttacataatggtcgggaacatggtgattttcgtggctctggagtagtagttcgcatggccagaatgtttgaacacatatctagaatttttgtagcatggccagaataatgtttaaacaaatagctgggatttttgtggtccagtgaagttgacacatgcaattaactaatgcaatatgctcaaaggtagctcctggtttcctgaggactgcatatttctctttattctgttttcttcttcagattgcatgatctttgtcagtacagtctacaagttcattgattcttctgccagctaaatatctggagcctctttaatgagttcttcaaataattaagtccaaagtttaggatacttttcagtgtagagaaatattgtgaaggtagtggcgtttccatctgcttctccctttactgtcttactttagtagtatatattcattacagtttatgagttggtgactcataaattattgatttattgattattgatactgctaataaagtttccagacttcatccaggccttatttgtaatctgacttgagaattcaggagaggtaatagccaaatcccattaagcaaaacgattttgctaacatttctataaagctcaacctgtctttttattgaaggaacccattggaactctgttctgtgtttttcttttactttacacttatttagtgtgtatgtgtgtgtgtgtaggggcacagggagcacacgtatgcatgtagaagttggaggacaacttctggatatggattcttctctttgaccatgtgggttccagtggtggactcaggttgctaggtgtggcaagcacgaaatgcctttacctgctgggtcatctcacaatctctccattttgtgtcatacattggatgtggcctaggtcataaataactaataactaagtgacagtgaaataataagagtaaattataatatctctgctctgttcaattataaatggttctctcaaaacctgatttctttctttattaattttctcaagttttattaattctgatgatttttaaggggggactataaattcttatacccccaccccgctcttacagggttttcctcatatacttatttaactgcttattgcttgtctacatatctgtttcctttaggcaaattataatttcctgagaaatagatgtcatacctcagaacctagcctatgcatataacatgggtgctacattaatgaagacacacaaaaagataaaaactatatcaagagtttctaagattttgtcataggttagagagatctgtttcattatctttcctgtcaaaattctctctgaagtactaaaaaaaatcattttagcttttttctacctgttaactgaagaatttaataacagctcatatttatgaaggaaagataaaaatcaaagaaaagctttgcgcttggaataagctgtcctaacaattcataaataagaattgaccatgtatgtttataacaacagtaactgtcagggaatgaattcttacttgctctgtagattattcataatatgttttacagttccataaatttaattatttgtgggttggatttttggtttttttgttgttttttttttttttcccgagacagagacagggtttctctgtgtagtcctgagtgtcctggaactcattttgtagaccaggctggcctggaactcacagagatctgcctacttctgcctcccagtgctgggattaaagacctgtgccaccactcctggctattatttgtgtctttagttccatgcagaaaatcttgtaaagcactttgaaatactaatcaccaccttcctgtttggggacagaacctgaaagctgggacaaatcttatatgttcattccaaaacagagaaaattcatatgcaggtcctataagcagcttttgagagggtgcttcacagcagagtaggtgaagagtggcatagcttcctgatgaccatggagccagtctcatcatgggatcatcatttatttcaaaataactactacctaactttaggtgcgagattcagtcctttaaaaagacccacactcaatgtaaatattatcttaccgctgtttcggttagtcaggttagcatagcctaattttaaatatcacaagtgactttttagttcctggcattgatatgtctttccttcgaagatgagacatcattatctcaacaattgaagccctattaaaatgacgaacagtcagttcccacgcacttcttgttggcacaaactcttcctgccagaactccaatttctatttttcagagaatactgataaatttgagcgccatctttcactaattatgtgaccaaaaccaagtcatttttacatctttcagcctgtgttttcattcattaagaggaaataatactatctaaacaaaaataggctaataaggaaggctaaggttttatatatatatataataatcatcactaattgtataatgacagcagtataacagtaaatgacagaaataaagcaaatacctctactaagtgggatttatcatcttaattagaaacttgtacttaaaggggttccccaaatgacacaagcaatttatgtcaatttaccaaaagaaatggtaaaatcataaaatatcattagcactttttggggatgcagggaggagccagtcttgctatgtaacccccaggctgtcctcgaactttgtgctaaatttggggattgcagacttatatgaccctgtcaatctcattttagtcttgccacttgttactcattaagttgtttacaaagcacggttattaaattgaacaatatcattgaaaaatttgaggctggagagatgatagcttagtggttaagaaacttgctgctcttccagaggacctggcttcaattcccagcacccacacagtgtgttacaatttagtataatgattaatgcttcattcatcatttctgtgtcatttctccacacttgtgtgtgtgtgtgtgtgtgtgtgtgtagaggccaacctcaagtgtcattagtgccatccacatttttttgattgagacagaatctctttggcctggaactggcgggatttctcagatcttgtagattttacatttccaaggcaagcggtttactgactaaacctcacctgagtttacaaggaacatacagataagcattactttgatgtatacagaggtgttttgcccacttgtgtgcctgtgcataagtgtgcagtgctctcggaggctagaacaggaatgcatccccctggaattggagttgctcattgtttagaacaaccacataggtgctgggaattgaacccaggtcctctgcaagagcagccaatgcttttaaattcgtaagtgacatgtttggaagtttctagcttggtaaccacacagaagttctaagaagaagcgtgccatgagaagtcgtgagagaacctgagtcgtgggaaacctgcagttccccaccccacattctttgccttgtgaagacctcttccttcaagctgtttcatcactatagaacctccaataagaaagcactgactatgagtagcattttctcatgatctggagcaaagtttgaacctgaggagatggtatggaaacccctgaatttgtcctcatgtcatataactactctggggctagagctttgtggctaatgttttaaatgggacagtcttgttggactaagcccttcaatctgtgtggattgagtcatagggcagccagctggggtgtagtatcagagaactgttattggaaggagcagggcggggggttgagatgccctgcagatacaaactgtcagggaaaccccacaggtcctcacaggtatttccagtttacaaaagaaaacaaatgcaatctctcagagactgcacagctccacatcaagttagtatgtggtaagatgggaactccaagctgctcttagccctgttttgtcctttcttgaaattgtaatctgcttaagggaaagagccaatcatttcttttacttaggttttatcttttcaatttgattgcttacatcatttattgatcttaaagaaactgtaagttttactatttgcccttcgaaagtttagtagcacagacagctgagaaagtgtaagggttttttgttttgtcttgttttttcttgattttcttctaaaatttttaatttttttttttaaataggacacaagtatctttaagtaaaaataactttcagtcaatctggaaactacccccaggcttcctctgatgccttacagagttgctgctgtctagttattaccacttggttttcatctttaacataactctcacagggctagagcttaatcaccagctatttggcaggcagtgttctatttgttctggttttgctattttttggaaaccttctgaattgcactcaatcactccacagacttacctttcaagtgatttggaatcataatgagaagatgggatagactttacagatttcatattgatcccctgtgaactgatctttattattgagaattttagcatccattctcagtttgcaaggcttcgagtgcttagaaatgcatttgtggacttgaaaacaataaggaacctcagagatcatctagcagagggatctcagagttcaactaagaggttaaaattagtcaaggtcaggcatctaccgggacatttgtcttggtgagggaaatctaggtttcaggatgtattaagtactttccagtgtgggactatgaggaccaggagtctggagatcagatgagaatgtcagtttgtcaatgtattaacactgtagtctggaagcttttggaattttctatgttattgactttgagattttatggtgtcttcaagactagtaacttctattatgttgttttaaaagatttgtgtgtgtgtgagtgtaggtgtgtaggtgtgtaggtgtgtataggtgcctgtcaaggccaagtgataagatcccctgtagctggagttacagacagttgtgaactactggatgtgggtgatccaaacttaagtgtcctctacaagaacagcaagctataccagacatctgtccagccctcttcatcttccactatgtagggtttttacttgttggttagtagattttgagagatttaaaaacagcaataatatcataatatgattgccagtatgttcttaggtagaaatgtacaaaacaaaagtggcatttaattagaacacagctttttacatttattgttgtgtatgtgtgcagggcacatgcatgttatagcaagcaagtctagatcagaggtcagcttataagagttggttctttccttttgctgtgtgagtctgggggatcagattcaggtttttaggcttggtgacaggtccctttactcactaagccttcttacttgccctagaatatagtattaagtataattcaagattattcaaaactaagataaaacattatgaaatattttcttagagtatatatgtatttcacttttgactctcacttaaaataaatgaatgactgtagacaggctcctatggtatgtttaggctgcttgctctatgtgagtgggggaggggtagatgctgctgatggaatgcagggcctccatggtaaacaagtgcttctactgagctagaccccaacctcattctcttgttcttgctaacagtactgtggtgcatcatatgtatgtctttgtgtacagattcctaaaaatgttattcctgtgtcaaaatgtttgtctttaattttggttttgtcaaaaaattgtgtcaatatgatttcctactagcattgaatgagcaggcttaatttcctcaggttctcaatatggtatgtttactcttgggtattgccaatctgaaaaatcatatctcagtatgattatttttacatctgtctattgtgagtgtacgtgtgtgcatgtgtgcgtgtgtgtgtgtccccctctgcctgtgcatatgcatgcacattgaatggttagaggacaactattggatttcgtctccagaactcactcagtttgtcagccttggcagcaagcacctttacccacttatttttctggccccaattttcagtctttaatatatgtatagccaagttacattgtatattctttccatttatttatttaacatcccaatcactgtccctctctcggtctccccatcacagtccctacccccatcctccctttcctcctctgagagagtggaggccccctcctggggatctccccaccctggcccatcaagtcattacagaactagctccatcctcttctactgaggccagacaaggcctggcccagttgggggaatggattccacagacaggctacagctttagggatagcccccatttcagttgttggggacctacatgaagatccagctgcacatctgctacatatgtgcagagggcctaggtccagcccatgtatgttctttggttggtggttcagtctctgggagcccccaggatccaggttaattgattctgttgatcttaactgtggagttcatatcttatatatccaagttttttttgattattttaactgatcttaaacatttattttgtgtgtgtatgcatgaatattcatgtaaaaaaacaaaggaaaactttgagtagttgtttctatccttctactctgtgggttgaatttaggtcatcagacttaacaattagtgcctttacctgaagagccttctcccaggctccacactagttgcacactaattggttatccaataccaaatggcgagcgctgaacacatacatacaagtaacattatacagcctaaaaacacaaacacaagtaacagtatacggcctaaaaacatacatacaggtaacattgtatgtaacattatacagtctaaaaacacaaatacaagtaacattatacagcctgaaaacatacatacaggtaacattatacagcctgaaagcattcatacaggtaactttatatagcctgagcagattttacaagtgtgtgtgtgtgtgtgtgtgtgtatgtgtgtgtgtgtgagagagcgagagagagcgagagagagcgagagagagaacagttaatgaaaaaaggagccatgaatttgaacgagagcaagagaaaatacatgagaggactaggagggaggaggaaagggaagggggaaatgatataattatatgaattgaaaaaaattgggcttctactcttaattgaacagaaggattggggactttttgttagaatgttgactctgtaatataaatagattttcttccccaggtttttatttctatttttctccttttcgtttgtatggatatctaaactcagaacatgtgtaaaatggtgttctggattgtctttcttttaaaaatatgaataataacattttcatgtcatccctgtgtctctgccacaccttttgaccctctagtagctccttgtgtcccacaataaaaattgtagcatttaaaatacatagtcttgggccagtgagtaaaggtgcttatcaccaaacctcatgatctcagaactccaatggtggaaagaacctgctcctccaggaggttgccctctgacctctacacacacacacacacacacacacacacacacacccagggaagctaggggcatcaatcccttggagctggaggtagaagaaatgtaagcctctggaaaaacagcaagtttttttaagcacctttctagctccttagctcagtattccttagtcttgaactccagttccttccatcatgttataatcctaaggatgttgttgttgttgtttcttggagtaggggacacagtaacttgcatcccaaaatctggtgcatgtcagtataccaaaatctagcaagttccaagctttgtaagtttattttaaagttagttatttaggatttggggttcaaaatatcattttgtggtaaccttggtaaaaattgatctgtaaatttttcatatagttactttcaaaaacaattttaacctctaagatatcttaaatggttggtatattattaatatggtgtgagtttttcctgccctattttagctcctttgtttcagtgtgatccccaaagccttctttggaaggcttggagtgtttagtaggattggaagtgctgggaagtgaggatcaaattggtattggattagtgtgtttccttccttgtagaaagactggaaaggacacaacaaggtacatgttggttagtttaaacttttcacactagcaagttctgtgtaactcatgcttaccaagtaggtgtttgatttaatgataggaagtgaagtttagaggctagattaataaatcaaattactgtctgctattgagagagtaaagcagaatgaagaccctattatgtgagggtcagatggtcctatgcaggaagaagactaaaatagagtgtactatctttttcccatttgactgtggaaaagcctccacaagaaggtaattaggatggtttgcacagggctgtgctttctgcagaaatggtttccttctatccatggatcctgagtttttaagatgctttcaaattgtttgaattcttctattattgcaaatttagtcatgtaccaaatttattcctgtgcagtcttcagtgacaaaatggtctcctcatttgtatgtataaaaacaatgccaggaacaaaaacaaaactcatgattcaactgattttgttctctctttgaacagaagaaaagatctgttgagatgaagattataatttcagcaatgaagagaacattctaggcccaggcagcttttaaatttgatgctcgaaatttatgagataaactccaagccttatctttctgtcagttcttatagctacctgcttacttacatatgcagaaagaagattaattctagagctgatgacattgctcatcgggtaaaggcacttgtcacacaagcctgactgttttttgatccccagaacccacactgtggagggaaagaacagaattcagtgagttccactctaatctccacatctgtttctgtctgtctgtccctgtctctgtctctctctcttagtctctctgtctctccataaataaatgtaataatttaaaaattctcctaattttaggtgttacttattactgtgagacatttggttatttgtttatgaagttgatggctagtaacctcaaatcttgtctttggaaggtactggagaggacatctagttcagtacaagactggtttcaatcagggaccaactgtttccagccaccccttcctgccacctgctggccttctctgttcctgagctcatcaagtccctctttgtattgccttgaatgctcttctcctgaccctgtgccgtggcttacttctttccatagaacagaatgtggttgatcactctcagaccacctatctaaaggacccttttctgtcatctgccatggcttaattttttatagtaattgtcactgtaaatttatcatgcttgtttgttgcccacatccccttagtgttatgaaagcaagaggcaggctggtattcaccagcttatctcaaagcctttctaccatcagatggcctgttggaggcatctgacaaatatgaccaatgtgaacagaataaatatgactggtccttgcctaatcactactgcgctgaaatctctttctgattctctttctttctctctttctctctttctctctttctctctttctctctttctctctttctctctttctctctttctctctttctctctttctctctttctctctttctctctttctctctttctctctttctctctttctctctttctctctttctctctttctctctttctctctttctttctttctttctttctttctttctttctttctttctttctttctttcttttctaccagtaatcttaattctactccatgaaataaacctgcactttggcttcctttttctcaacaagttcagatgggatgtcagttatttttcatagaagaaaaactccatttcttcattagctttctcactgggtgttatttgaggagtgtgataaactctggtttatctgtctctaagaatattttggctttgttaacggtatctagcaatagacatagtaaactgagtggaacctaagcctcagtgacagaaaggacatggcatttttgtttatgtcattaatgcagtgctcaatgttttatcttcaataagaattctcatttgcatccaaatgaatggtgaagaaactaaatatatatggtatcttagggtcattgtgaattcttaagaacatgttttatgattgaatataacagcatagaaattccaaaaacacaaatatacaatagggaataattacaagtaaatcgttagttaagccattaattaaatagaaatgacatctctgaaagaccatattagtatgtgtctcttctccatttcgctgctccctagaggtaattaatatcctgatttttgtaacaaacatataatcacatatatggctacatattatggtttgtggcttagtttttctgttttaacattgtaataaaagaaatgaggttgtttttattagttttctgttgtacagcaagttgccactattgttcctctaaaaatcacccatatgctttagctcacagttctgtgggggcagaaatgcaccctggcatggttgaattttctattcaggatatgatgaggctgacactctgcctcttgtattttttttctcttttagtaaataggttctctgtatagtcccagactagcctcctcggactcagttctcctgcctcacctttccaaatgctggggttacaggtgtgttcatagtctaccatatctagcttaaaacaaatacacaaataaaaacaaaaaacaagaaaaatgtaaattgtaactttgatttccaaggcccaactttgcccttttttaaaacccacttaaatatgtttcctatttttggaatttctggcatgaatgatttttctatatcatatatattcattttaaccttgagattggtgcttagttcatttgttttaagtttttgcatttttggatgtatgtatatcagattcttagttttcgttcttctttaaaaacaaacaaacaagcaaacacttgttttatataggtgtatctcacatatgtggggatcaggggtcaaggcaatctataaaagtggttctttccttccatgatgtgggtcctggggattgaactcagggtgtcaagcttggtgccaaatgcctttacgtgcaaaggcatagcatcctctggcccctggcagtttccttttctaagtattgatttagcttcttgccataaatttgtggcattgtaatttttaaatgttaaaacgtcttgtttgacttactaatgggatgttttggggattattaacttccaaacttattaatattttttcaattacttcttttgtgtttgactccctccatattttaggtatggcgagagaatatcctctgatttcagcccttgtaatttggtttgaattacattatggccaagcatgccatcctttataagtgtgtatgtgctagagaattagagaaaacatattgtgtaggtaatttggtgtttttagaaaccatctaggatcttctgaatgctgacacttttctttctcattgagttcttcttgcatcattctcttgttttgctattctaactcactgagttttgtctctcaccctttggaccaaccagtcatcaaaatgcttgctctctcccacctttttttctatcttaatcctgcagttatttcctgggctttcctgatcatctgactctttgcgacccctgtgagttccttgctgtctcagcgatctgtttacctcttgcttgtgggctctcaccttgtatttctttctgcctggtggtgtttccagtctgtccactgtaaatgagaaatgatttgtgacactaataccaggtctagattggtactgttttcccctaagatgagcagtgacacccccgatcttaatatggaatcattttagtctaaggtacatttagagattttatctggatcactggaatgccatgaggccacagttcggctctttccaaaggctgacgtattgctctttccctttgtctagagatgggctttagtttcaaatgactagcgatgtaccaagctctgtccttttgaaacacccttgactttgatattcatgcccctatatcagtaaggatttcataagtaacctgtttttctttcattttaccagatttcttcaacttccaaaaaggatcaaaacagtttagagtggtttgggctacctctccaggttcaattcttttgcattgatttgaactggatacttctttataatcttaactatcatagctttcaagttcttttttaaaaaagtatttccccagcatttgtatttgtcctcaaagacacatttcatccaagttacataatttgccattagcagaagctaaagtgtctttgtcttcattccattttttctcttttaagattaatcagttttattcagctaaatttggcagcgctttttttttgcctcagtatgaatactggtagttaaaacatggattttgacacctatgtatgtactggcatatttaaattgggattctcagtttaccttgtttggcttgctccagagactaggttataacacatctcctgtttctcttgtggtggaccaggattcagtgctgggtcatcttagtggagatcatttacttgttacctcagttcccttgaaataaattatactgtaattttcagaagaaaggatatttagatgtttcctggatctttcaaaccagccttaggaagtgaagattaacagtccaaaatattctgagcatcttttaactaaacacgcatcttcactgcaatctcaacaccacactttctcctccctctgtacagtgagaaaccctacggcagtgagagcctggactacttaattcaccacagccttgtgtgccttttcaatcagttagtctgtatggatgatgcatattgtgtgtgtttatcatggggcgtgagagtagaggtcagaggtttggcctttccttcactgggttccaggggtctgaacttgggttgtcaagcttgtgtggcaagtgctttcccaagatccttgtgggtcttatttaccatttccccgaaacatgggagatagtttcaaaatgagattttaaataaataatagaatgtttgacctttttccccccaaactgtaacattgtaagacaggtatctgaacatatgcctgtgatcccagcacttgagagactgaggaaggaggattgccatgagtttgacgccagcctaggctatagattttgggacacccccatctcaaaaacaacaacaaaggattgtaacataatttttactgaatatcatggtaagccattaaagccgtggtttcaatctgtgggtcgggacccctttgacaaacctatctccaaaaatatttacattacaattcataacagcagcaaaattacagttatgaagtagcaacaaaaagaatgttatggttggagtcactgcagcatgaggagctatattaaagggtcacagcatcaggaaggttgagaagcactcactgcactagagaattgtgtgcagatggaagaaacatgtttcagttttctgaggaaagtataatgaaaggtggtcagtgtgattggagccaggatcaccacattgggaactagcagatgctctcagaggatggatgcatgtggcttacagatggacttcagcttctacctttgatgatgggggaagtcattctatagtttccagtgagatgtaacatgatccaacgtactgaatgttacttcaagtcctatcaggattgtaagaagttggagggatattataatattgatattacttattctttgggttcatatctgtctgttccactgtctttatttgcctctggtggcacagctctgttagaactctcagtatattctgtagaatattcagtaaacccccatccctagcctgacttccattcttttttttatccttataaaggagtattacttctacttgtaactctactcttccatgcagattttgtttgtgcacatgagtgcagtaccctcaggaggccagaagagggcagtggatctctggaaagtgaacttgtaagcatttgtgagcatatgtaggtgctaggaaccaaacatggatcctttgcaataacaaagttctctgaactactgagcttacattattacctggttgcaggtattccttttttttttttaaagcatctcactgtgtagtcctggctggcattgagcacacagagatctgcctcctggagaatgctgggattgaaggggttgttcgctatgcctggctgttgcaggctttgtatggttgcaaatcttcatcaggataagaacatttaaatatcattcaattatgcatattctaattgtttggaggtcttatcctagtttacattcccaccatcatgttggaaagaatgcttcctgtttacatatcatgtgaagtaccttttaaaaaatttttgagattccacaggcaacaaacaattttctttgtttaaatttatttcttccttttaaaacattgttttttaatatctgttattgtttgtagaagtagggcaagttttttttaaataaaagaactagaacaaaaaaacctagagcatagttttctatgacctcagtactatcaaaattaatactgtttaatctgtgagcatttaaattttgttttttctttgaccttgaactcacaatctgaccaaagctagatatgaatttctgatcccaagggctaaaattacagtcatgtactaacatacctcgctagatttaggctttacatttctggtagaattgccacagagatagttatgtagtatgttctatcaagaaacatgtaatgttggtttctttcattcttgaccatattaagtttgatcacttaattatggttgtattggccagaattcttcactttaaaattatactttgttcttttgtaattaataggcacctaccttgtgggtagatagtttgagataagatagtatttttcctgtaactttcaagtataaattttagcacatattgatgacacttgctaaagtaattatttctagagtgattgctacatggagattttgtaattccatcactaactttattatttgttatagaacttcataaaaaagctttgtctatatttatttatagatatgtttttatttcattctgtaaattataatttattaatacctttatatatatatattttcctgttgccagtatgagtcagttgagcttggctcctaggatcatttgacatgctgtggttgttcttcaggcatttcctcactttgtggctctgcactttttctgccctagtcttaaattagtcacttcttcaaagaactgggagtcttttcactagagtatgcagtgtgctcagagctgttggtatgccattacttgtatgctctcttagggcatagatctagggaacatgtatatgtgagaacataaacatttacatctttttcttgccctttcatattgcatttcccttttgtgggactaagaaatgatggtctaattcctgcctggagaaggtagggcttataaggccctaacccgagcagaggagccattggcagttgatagacaccatcagttttcttcagggatgtggcccatggtaggttgtccatgttccagtggatagcaccccacacctatctatatactggctaaactaattggactctgggtcattaaaaagaaaagataggaaattgggaaggggaagtggtagaggtttcattatccagtgtatgcttacctgtttggtccaaaatatagataaggaagttccctgtcatctgggtataatgacacaccctttagccccagaacttgtgcatactggagtcagagacatgcgaacttctgagtttcatccagggctatatagatagtgagactcttatctttaaataaaatggttctatcactattaaaggaaaaatgtctaagatctaagtatggttgagtacaatgtttgttcttagtttgagatactaggtaaattcctattttcaaaagttaactggaacttttttccttaatggtggtattaattttaaactaagaggttcatttcatttgaggttctttcttcctactttcatttacagcatatgaaacactaacacagataaagaaaacattttaagaagaataagataggttgagtattgtaacataacagtaatggtgcttcattgtgtttgctcttccagggactcagttaatactgcacagttgaacaaatgtatgaaggttccttgccaaccattgagaatttcttcgttgggacattatttccctgcttactgaataacttgtttagacgtttcttttttggtgccatgttctgtggctcacatcaaaagaggagtttgtcttcatgaagattcctaacattggtaatgtgatgaataaatttgagatccttggggttgtcggtgaaggtaagttagaatttcacgtttgaagtttggagtactgtatcattttatacatcaccaaaaattctattcagatcctcttagtttatcaattcagatatgcacctaaatgtacagtagttttaaaaaccctgttcttcaactatgtgggtcttattctccaagtgaaaaatcttttaaaacccttcaaagttaaatagatattttttgagaccaagtatctttgtgttgcttttgctgttctggaacttgttctatagaccaggctggccttgaactcacagatccactagcctctgcctctggagtgctagaattaaaggcatgcgccactatggcaatcaggtatattttaaaactgacctgatttcattctcttcactaacatggtttccttagtctatgtatttttgttattgttatattttttatcatctgagctatttttaaatacctgaaaattcacttgtatatgcgaacttaaattactatgtagtagacaaatggataaataactttttttttcctttgagaattcagaccatagtttatgagttttcaagtacatggtttggttatatttttaatctcttaaattagtatgcatggaatggtttaatgccatttatttttctttccctgtagtgtataacatgatgcttttatgaccaaagctactattgattagataaaatacaattcagttttcaaaaattgactcctagaaaaaaaatgaccctttttttttcttgcttagtcatttgagatagctttacagaaatttgtaaacatgattttagttgagtatccaggaatacatgggttcttagcattttaaaaaacagatgttacaaaacttttggattttaggtttttaaaataaatttagaatttcaagtattgaaatttttttacagggctctttaagattttaatattaggttgacaaatttttctaaatagatagaaataatgagaatctgattattcattaggtgcttgtttcaaggtctgaagttcaaaccacaccaaaaagtggtttttctcccttgactagttgactccttttcatctcatcattgatattacacagcaacaagttattctcagtctcttacctgttttgtaaaatttgccttttggggccagcaagatggcttagccagtaaggtgcttgctgcaaatcctgagaacctgagttctagtccaggacccagaatgtagaaggaaaacatggactccacagacttgggtttcaatcttcacacacactgtggcatgcctacacttccctatacatttttttaaaaaaaaggtttttacttaattttttgagacagggtttctctgtgtagctttggctatactggaacttgctctgtagaccaggctggcctcaaagtcacagagatcttcctgcctctgcctcctgagtcctgggattgaaggcatgtgtcactaccttgctgtaaaaaaaaataatttttaaacactgcttttttagaatttatttttctgaagtccaccttcttgagttctttatatatgttggatattagtcccctatctgatttaggataggtaaagatcctttcccaatctgttggtggtctttttgtcttattgactgtgtcttttgccttgcagaagctttggagtttcattaggtcccatttgtcaatcctcgatcttacagcacaagccattgctgttctattcaggaatttttccccttgcccatatctcaaggcttttccccacttgactctagctgcatatgtatcaaaagatggcctagtcggccatcactggaaagagaggcccattggacatgcaaactgtatatgccccagtacaggggaacgccagggccaaaaaaaaaaaaaaaaaaaaagggaatgagtgggtagggaagtgggggggacttttgagatagcattggaaatgtaattgaggaaaatatgtaataaaaaaaaagaaacaatatacaccataaaaaaaaagaatttatttttcaaagctgttgcagttaaaagctcctgcaataaagggaagagggtaggtagagtataccaaagttaaaatgttcggtttgcatttgactgtctagattataaccttgttttggttttttgtttttggtttgttttaagtatgtgttaatgaaaatcttagatattggctcaggttagccaaaattgcaagcctatcatttataaattagaatctgttgatttgtaactatggtctgtcattctcaaagaaaagaaaagttatttatagccaaacattgtcgttttactttttctttgtagattaactcagttggttgagtttaggaaatgtatctgtcaagcatgcattcctgtagcctacacgatgcattttgaccacctagaaaagtggctgtggactgtttcctggtgattgtgagtgagttagaatggttctcatccactggtttcatcttagctatgattattagactcatacctctcaacaaaaaataaaggagcaactttaaggtatcctcaccccttagagacatagctcccaattttgtctcactcaagtccaccttctgcttaagtagcatgtgggatttgcctgtctgctaataaccatgtttgtagcgtttcttcagagatccaccattgcatatatgttatgtcttgattctttcagttagctgtttcacattgtaactttaacctctgtatcctggctactttcctgccaaggtactgtttcttagttcttcctctagccaggtgagcttcccacttccataacaggagatcatgtcagaataaaacagaaagcggcagtgcttgggacctatggaatttgtactggttttttaaaaatttatttattatatgtaagtacactatagctgtcttcagacacatcagaagagggtatcagatctcattacagatggttgtgagctaccatgtggttgctgggatttgaactcagacctttggaagaacagtcagtgttcttaacctctgagccatctctccagcaggcatcttgttctgtttaacggaattactgaggctggtagttttggtgtgtgtgtgtgtgtgtgtgtgtgtgtgtgtgtgtgtgtgtgtgtgtgagagagagagagagagagacagagagacagagagagagacagagagagggacagagagacacagagagacacagagagagacagagagagagtgagacagagagagagacagagagagacagagagagacagagagaggcaggggactggacatagacccaatgaccatggaagaaaagcactctaccactgaacttcacccctagctccaacctataatacttttcctgttagtatattacagtgttctagaaaaggctatacttggctcctgggatagagatcttatttgagtaggctttgtgtttgactttactcttgtgaaattattagcttttaagttttaagttccttaggatctattgagttgatttttatttgcttcaaaacatgcattttttgagatgtcttgctgtgtacccctgtttggcttggcactcactatgtagttggactgagccttacactgatggcagtcctcttgtctcaacctggtaagtgctataattgcagtgtgtaccactgtgcccagttcacatagcctcacagccttatggtgtgtgtgttttcttcgatcccattttgcttaaaataacaaatgtgtgtagtttgtttcttagccatgatttgcctctactctgggtttatacaaaaacacatgagacccctgctctatttgtatgtgacttatgatgctctcactctagaatattgtcagagatgttgttattctaacatatgctcataagcaatataaatatagaactatagttcatatgcatatctctgattgcttacttctttttaattataggagcctatggagttgtacttaaatgcagacacaaggcaagtacatgatttttacaaggaaaaatatgtatgtattttagctgttttgaaaatgaagcaatgttctttgtatgtgggcatataattaaagttgtctggctctggtagtgatggttagtaaaatataattgatatgtaaacatggagaaaaagcaacttttgggataaacgtgatcatggtaagtgaccattacattttaatttttattttcatactgtttttaagtcaatctatttatgtataggtgaaagttatatagtgggaagaaagaagtaggatggaaggaagcaagacagtgtcatattaaatttgtatgcatatacacatgaatgagggaggagctttgttgtgtgattttcacgcagactagttgattacttgatggagtcctgtctaggttttgaaaggtagtgaatgggtagatgtttggctgtgtacaagggcttgggataataatgtatgattatgggtattggctctagttgatcactctcaaagtcaatcatacaggtttttgactacagcaaccataaattattcatagtcacctgaggtttcatagctgctacttggtgactgcatcttgctcagagactacatttctattagaatgtatccagtcaaggtattcttatttagcctcatgttattttgtattaactttaagatcaaggctttagtattttgtaatttttttccattttagtgatgtagtttgaatccgaaatgagttcaactattggactcaagatatcatccatcaatagtaattaatatatatgtaaataatgaaagcttttccttataaatacctgctaccttttgattttagaatccattaccatatgggtttgtgttttacatcatggatctattttaatacaatgatttcttaattcttgaatttagatatttgaattacttttatgttgaaaatatctgcagatctttgtcagtaactaaatcttaaaagttgcttgaatgctactggctcttgattaaggatgattaaggattcaaaatacatgtaatcaaaataaatttagtacactgaatacctcgttaagaagtattactgtagtttgaaattaaacaaatggaaagttctctaatgaaatgctcttcttttaatgagtttccttgagttataataaatttccaaagcttaaaaaaaaaaagcattcccctttctgtgatggctctgttatgtacagcattgcaaatagaagcatcagtgtttaattgtgggttttactttaacattattttttgagacagggcctcaaaaatcccaggctgacctcaaaactcactatgtagccaggcatgatggcattgaacttctgatctcttgcctcgagcactagagtgctgggattcccattatgtgccatcgcagcctggttatgcagggttgggcattgagcttggactcttatgactatgaggcaagtactctatgaagtaagctacatctgtgctcagtcctagtgctgggttttaaaccataaagatttaggagatccatacacgtctagaatacacacacaccacaccacaacacacacacacacacaccacacacacaccacacacacaccacacaccacacaccacacacacacacacacacacacaccacacacacacacacacacacacacacacacacacgatacacacacacacacacacacaccacacacacacacacacacacatcacacacacacacacacacacacacacacacatcacacacaccacacacacaaacaacacacacaacacacacacacactacacaccacacatccacccacacacacacacacacacacacaacacacacacacacacacacacgcatcatttgcttatgatttttatatttatatggtttaaatattttctgctagtctttgtcatttattaacctaaatttagtcatttgtttgcttgtgttttggggggaggagtggtttgagagagggtctcatgtaggctgtcatcaaacttcctatgtagctaaggatgacctggaatgcctcattctcctgcctctaccttctaagaagtgaacttataaagtatgcaccatcatacctagcaaggtgtgatttcatttgcagaaacctcaagcgctagattttaaagtaactattttcatataggctacaagggcaagaaaactatgatatattcatcattgtaattcaaagggttgtatataatagtcagtagacattacatttcacattcaaaatgggtttcccaaaaccaaaggatgcccactcccatccaatttcctttagtcccatattgctggcactatttattagccaaaccaagtatatattaaaacaatattctaacaaacaagtaaatggaaagataaaaacaaaatattccacttagaggtgtagctcatttagtagagtacttagctggtatataggaaaccctagggtttacccacagtacagcataaaacagcatggtggcacacacctgtgatcccagcacttgggagatggaagcaggaggataaggagttcaagccagtcaacctgagcttgtatctaaaaattgtcttgtcctgcttttcactaaatgagaggttcagatcagcattcaaagtactgttgcttttcccttttaatgcatctaaaaagattgttacaggatggaaaatttaaagcataaattaggccataacttagaataatatgaaactcattttagcatcggcagctgtttagccgtttgacttgttagagtatatccttttcccaactaaaatcagaccttcaaatctatgctccaatatataaaaatagggaatccggtgtgcctcatgggatttatgctttagaatcaaatgaacagattgctatggaattcatgttataggtaaaatatatgtgatcctgcttattgtgttcattatataaaaaaattgtgccaatatatttgtatatcaacattttagtaagatgcttaaaattttaggtattattgtctctaattatttatataataggtttatttttaagcatagatcaactattgttaggtattaattatataataataaacattatagtatacttaaatattatataattaagtggttcataatatattatgtctctaagcacgtataaaaaaaaagccactttaggtctgtatactgataagagctttagaggtcaagtatgttttgtcttttctgaacatagtatgatgagctattccagagcaaaactatactttctttttaactattttttatgaaggtgggcagatagctggcaggagattgaaagtccccctgggatagcaggctactctgggcagaggactcaacaaatagggaagatgggttggggaaaggaagctaatctgtatggttcaggctctgcacatctgatgacagggatagcaggatgcttagggcagcttgggatgccccagaggactcagagagcagggaagatggatgcggggagggaagcttacctgtgtggttcaggatcctcaggtctgatgaaagttggcagagaggtggcaggaaaatggaagtcctagaccctcccccacacatatgtagcagccatgcagcttggtcttcatgtgggtcctgaacaaccgaaccccaatagttgttgcctgtctgtgggatatgttctttcagctgggctgccttgtctggccccagtgggaaaggatgtgcctagccccacagagacttgatgtgccagggtgtgtgtggggatacccagagaggacccaccctctcaaaggagaaggagagagggaaggattgtgggaaggggtgactgggaggggttagtgagtggaatgtaaagttaataaatgaaaaaaaatgatttaaaaagcaatcatttgagattataattacatcatttcccacattccttttcctcccttctagccctcccatatgcctttgtttcatttcaaatttattgtctcttttttcattagttttgtgtgtgtgtgtgtgtgtgtgtgtgtgtgtgtgcatgtgtgcatgtgtgcatgtgtgtgtactcctaaatacataaatacaaccttcttagtctgtataatgcttatagtatgtattgtatgtttttagtgctgatcatttagtattgaataaccaattggtgtgttcttctttagacttcagtacctaaggtttataggtgacttacaggagactttgcttgcttgcttgtgttgtggtacatcataatgtgcatgtagaagtcagaggactatctgcaggagtgagttctctccttccaccacatgggttctgggttttgaaggcaagtgtctttgcatcctgtgttagttcactctctaaagactattctttttagcttagcggttgaaatgttgcccaagtgaaaaatacagcttgtggtttttttttttgtggataacgtctggtttttgttatgtgtacacattgacatgtatatgaaaagtcttaatgataatgcttaattataatgcttataatgacttaaaagtactcatatttgaaagatgcaccttttttaatttatttattttattagatatttctttatattcttttacatttcaaatgctatcctgaaagtcccctataccctccttctgccctgctcccctacccacccattcctgcttcttggccctggcattccgaggggcttctcttcccagtgatggccaactaggccatcttctgctacataagatgcaccattttttacctttaccctacacagataccttggtggttttctttttattcatatatatgtgattcctcctgccactcctcttttcctgagggccagagttgaaaatgttaaaaacataaacccacaccacatattgagcactgtcatatgctaggcactgcagatgtttcaatctcctcaacagttgtggttgtgtccccattttaaagataagaaaccattaagtagagaaaccaggctttgttctgcttctagaagtagataacttggggaggaaatggagttttgaaatgataggatgcttacaagagggaatatagagctgaatgaatgggctactgaaattgttgcttcaaaagaagactaggagggaaggaagaacttgaaagatagtatttatcagtagtctaaaaattatagaaggacgtatgatgaggattgagaggtgaacaaatccatgtgctacaatgagccacgtatcaaattgcctgtaagtgaaatgggtacatgacatttttaaataagtagacattataaaatgtgctgttttcctctttcacgtgttaaaaatgtgattgtaataggtagtataaaattgattaaatattcactagttgtgctcactagttttatatcaattttacacaagctagaatcatcagagaggaatgaacctcagttgagaaaatgcctctataagctcagggcattttctcaattaatgaccaatggaggaggccccagccccttgtgggtgggaccatctctgggctggtggtcctgggttctataagagaacaggctgagcaagtaatgatgagcaggtcagtaagcagcattcctccatgacttctgcatcagctcctgcctctgagttcctacccttaatgatggtgaactaagttgcttttggtcatgatgcttaatcatagcaatagcaaccctaagacactagtaacaaatatctttgtctgtaccaagaagacattcttagttgttcatactcagttgtcacagtttcttgtttatcatgaggcttcctggttggcttttaaagtctttttttttttttttgagataaggggtgtggtggtttgaatgaaaatgatccccatagactcatactgagtggcatgattaggaggtgtgtccttgttgaagtcggtgcagccttgttggaagaagtatgtcactgggggtgcactttgaagtctcaggtgattaagccaggcccagagtctctctctcttcctgatgccagaggatatagaactctcagctactctccagcaccatgtctacctgtgggccaccatgcttcctgccatgaggacaatctactaaacctctgaacctataagccagccccaattaaatgttatcttttataagagttgccttggtcatggtgtctcttcacaatagaaaccctaagacagtgtgtgtactcataatatactccaggttttcctgaaactcactatgaaacccaggctagccttggtcttcctgtcttagccacttgagtgctggtagtacaggcttgagccatcttgcctggctagacttcattgttagtagcatactttttccttccttcttttcttttttcctcttccttctctccatctctccctccctccttcccttccttctttctctctttctttcttcttcccttcccttctctctctctctctctctctctctctctctctctctctctctctctctctctctctgactaatgtctcatactatagcccaggatatcctagaatttactgtgtagcttaagttggcatcaaagatatagagatccttctacttcatccttccaagagctaggatttagaaatgagccatcacacctgacaggagcatatacaggaatttattttgatttttctccaaaacaatttgtaggctttttaaacatcaaactatatcaaggtcatatttgagtaaaagctggtgacttttttttttaataattttgaacaatatatttactttgggcaaactgccatctaaaactgtgcagtattttctactaaaacaaaactaacttgtttccctccctccctctctccctccctttcttttgagactgtgttaatctgtgtggccctggctgtcctggaacttgctctgtagagcaggctggcctcgaactcacagagaaccacaggcctctgcctctgagtgctggcattaaaggtgtgcctcatcatgcctggctaactaacttagtttttaaaactacactaaataaagcaaattcttttttctttaatttttagttttaagcttcatatataagttacagttttaaaacaaagatcagtagaatagaagtttgttatatcattttctccatcattgctttctttttatttaagtaaatatcagggtttctgctttgtgtgtataaatttttattacttaaaatcacagagaaatttggggtttaataaatactgtaaaaaaactggaaaaagtttgcagttttcattataatccattctaagtgatttaatttactgaaggttagggagattaatgagatgtcactagacttcaggtttagagcaaagataataggaatcattaataaagaaaatatcttttgtccttgtcttatagaggcactcatacagaacaattagttcacttgctttctgctcttgacctgttttttgtagttgttgctgttgttgatctaattagttttctgaaatactgtaagactttcattaaaatgttacttctctgtagttatgttttactttatttttgagacaatgtaatatactggaactcactatgtagtacaggttagccttgaacttgtggcattctttctgctccagtctctgctttatgagagttacagaaatgagctgtcaagcccaccccataaccaattgataggaagatctgcccatatttgtacatcaataaaagaaatggatgttattttccatgcagatctgacttctttagggaagtagaagaatttggatcttttcttgcttcctgaatgcttgaatcttcatcatcctcatctagatttggttttctgttggtttctcagttaatggaacaaagaagtactcattaaaattatttttactagctctgtctacactgaagactacctcattctatctcagtttttttgtttgcttgcttactttatcttttcttctctctcttctgtctgtccttccttctctctacccctccctccctccctcccttctttctttcattcctttttttttctttttattagatagggacttgctatttagtcttgactcccctggaactgcttgttcctgcttctcaagtgctggtattaaggcttatactaccatgcctggctctgactcagtttctaaagcatctttttaaccctttgtagaggattgttccccaggctgcttttccagtttaccacattcaaatggccaggaacatcttggattccttgtaagggaccaagtccagctttttggtaccacctctcttctatatgtttcttttcaggttcctcatttcaatcagtgtcactatttattgaacattatagggtgaactttaaatcccttttatgcaaattatgctataattagtactaagacaagaacattctttctccatcttaagatgagtgatttcaagctaggcggtagtgtggcgcacacctttaattcccagcactggggaggcagaggcagaggcagacagatctctgagttcaaggccaatctggtctatagagcaagttctaggatggacagggctacacagtgaaaccttgtcacggggggggggggagagaaggagtgatttcttatctctgacaaagatctgtggttaagtaatctataatgtcaccttcatgaaacttctttaagacttcaatagtaaaaattaatacagattatttttctgtacagacttgaaaaaatatattcactgataatgtaagaaaaagctaattaacaaatgcccttttaatggatattgttaaataaaaaatatagtctatatgttattgaaaccagtgactggaaagtagtgcagtgtggtctatttctaaaaaaaaaaaagtgtagctccaaagtacatatgattagtagctatcattcacagcttagatatttttgaattttagtatctcttaatttaaggatttattttatatgttaaagtattttcatttagaaaaaaatcaagaacttaaaacatactcttcacacatggatacacatgttgggggtgtcatgtgtcacatgcatgtgtgagggtcagcgggcaactttggggagtcagttctttcctaccacctttgtgtaggttgtaagaattaaactcaagttgctaggcttgattggaaagcactttcacctgctgagccaacttttttttctttaaaacaatgttttccaggcctaacattacaaacaaaattgaatacatatctgctaaagaaaaaaaattatggagtgctgacaaaatatcagccacttagctaggacagtgctcttctaattcaataagaatgaattattttgagaaagttagtttagcctagctcaaccaacacatgtaaggttacatttttcctttgtcaaggagcttaaaatgtagttaagtcgtcagtctgaatactgtagaagatggcaattgaaaggaaaatgtgaaacctcattttcctgctaagttccctatttaagcctgtttatgaaaaatgcttgtcagtaataaagccataggaaaggacagtatttcctagtgccccttaagacaaatgcacaaagctgagaatgaaagcagcaccattagttgctggcataacaaatgagaatggggtagtaggaagctcttttataaactcctgaggtctacaattattattcagatgacacagtgcaaacttgaccttaggccctggtcatttcctttaagggtaaggccatcatattaggatgggtaagagaaattagcccgagaatgtagatctgaaggttgaagaataaaattctctcttgaataaagttttgttggaacacagtcacactcattcatgtgtgctatttctgtggctgctttgtgtgatagagttagagagctgtatagttttattatataacccactgaggctaaagtacttatcatctggcttttgcaaagaaatttgcttatttctattgtgaagcaaaccccaactaggagaatgtggcagaaatagtatagtagtctcagtggagcaagcatctgttttctgtttctcggagcctaaggaattaaaagccagaaggaggagattttccctgagaattacttttcctttgatttcactttgagtaaattctttaaacggttccatgggaagttgtatacggtgagcagtagaatattctgggagtcagacatacagaaacatactaatcagctgttgttccacccaaagatgaacaaaagcacaatgcactcttcttgagaatgaagaacacagtcttcggattaaaagaaggacattcttgcaatgtgacgaataaaattctttcgagaaaaacaaaacaaaacaattgaatatctttcttgtataagtcaaggaaagataaatacattaataagtcacaacaataacttccacttaatgtctctccgtcaagcattgtgtcagctgctttacctcctaactttaggttagaaggaattatccttctttatgtgagggacgctgctgcttaactagtttaagtttctaaggcccaataaatggagtttttttattgaagtgatagttaagacataactttgccccccacattaatatgaaatttacattccataaattaaccattttcaaatgtacatttcagtgacatttagtacattcacagtctttcaagttttaaagtattcttgtatcctcccaaacaaagctccatgcttattgtcttagttagggttttactgctgtgaacagacaccatgaccaaggcaagtcttataaaaacatttaattggggctggcttacaggttcagaggttcagtccattatcatcaaggtgggagcatggcagcatctaggcaggcatggcacaggcagagctgagagttctatgtcttcatccaaaggctgctactggaagactgacttccaggcaactagggtgaggatcttatacccacacccacaatgacacacccattccaaccaggtcacacctattccaacaaggccacacctccagatggtgccactccctggtccaaggatatacaaaccatcacacttattaagtataaactccatttttcatccccacttttagcacttggatttgctttttgtgtttcttggtttagatattctgaatatttgatatatgtgaaattatatgacatgtgacttttgaatttggttttctttgcttagcataaagttgtttttttgttgttttgtttttttgggttttttttttttgaggctcaccaacattataccatgtatcaatgctgcattctttatcaggccagaatatgtatttttagtgactgaatgtctggctgtttctaccttttgactattgtgaatagagctgctatgaacattcatgtgtaagtattggagttctgttttcagttctgtagggtgcatactgaggatggggagactatcatatggaaattctatgtttaactggtttccatagcagcaccaccactatattcccaccagcaatgtaccagtttttccacatctttactttattttccttttgaaacattatagccatctcagtggatgtaaagttgcccctccgattggtaatgttgaacctctttttaagaatttattgtctgttattggccatttgtatattttcttttttttaaaaaaaagattaatgttgattcatttgtatgtgaatgtatgtatatatgtgtgtgcatatgcacatgtgcacatacaggtgttcatgcatatagacacatggaagcccaaagaaggcattaggcatcctctttaataaccatttcctatctgtttctttgaggcaggatcctctcttgaacttggcatgtgtgtcttagctaggctggaagtcagcaagcacgagtgatcctgctgtttctctttcccttgaagctggagtgctgtatgcctgtttgttacatggttgtagggatctgaactctagttcttatgattgcacagcaagtgtttttaaccacagagacaactgtccagctgtaggttaatagtagtgtcctgcgtccgaccagccacagggctagggccactcatggaggaggatgcaggaagattgactgtgcacaccccacacctccggtcaggctttgggctgtgagaagcccaggatcccactctgggggtggggaatctcagtctgagatccccatggacctgttggagttgactaggggaccccaggcctgcatggaggccgaggacgacaggttctcaggctcttggacaccacagataactgctggatgccatggaagagctgagaactgagtgggggcccgatggctggatttagcccaggctgaagggaaaagggcaggaggagagctctggctgattcccatggggaggagagtttctggtttgcttgggctgctgggcttggtggaagccatgtctggaagcacagggaggccttttagaggaagacctgctccattgctccagcacggcaggtcccaatgagaagagatagtccatggttttaaggtgtttattgtcatggcagagggctgtgatgagtgaaaccttacccccttttctctgggtgggcctgaggttaggaaaggaaagctaagagaggcagagaaaggcagagagatggagacagtagagaagtagaggctggccatggccatgtgaagagagggggaagggaattcagagagagggggagcaaggggcaagagagagaggcaagagtaagagagggaggagggggcaagtagcccctttaataatgggccaggcctacctgccaagtaactgtggggaggagcatacctggatgttgccaggtaactgtgggggtggagtccagacagaataccagagacttggggcattgtcctatgtaactgatggccacataattatggagctgaggtctcatgtcaggagcctggtgtctaggggcatgacaaacttccttttgttccttgcagagttatctgctgggtctctggggttttaaccttgctcaaccagaaaacaggctgcctttcatggtcccacatccagccatttgtatattttatttagggaattgtctatttaattcttctgcccatttttaaattgaattttgttgtctagtttgagtacaagtttcttgtcaggtatatggtttgcaagtatttcctctcgttctttagatggccttttcatattgttattgttgatgcacaaaagcttttaattttgatgatatattatttactttttctttattgtgtgcctttaaaagacactgaaatccaagtatgtgaaagtttaaatgtacttatctggatttaatagaatactagtataattttagcttttataattgggctcctcacctattttaagttgatgttcatatgattttcatatagtgtgatacagaggtccaaccttttcatttttttaactaattaattaatttaatgtgcatgtgtctatgcaccacatgcacgtagtccccacagaggcctgaagggagtgttggatcgtctggaataggagatacaggttgttgcaagctaccatgtgggtcctagaactccaactctggacttctggaagagctctgctagtgttcctaactagtgagccatccctctggtccctgtttttttggtttttgttttttgttttttggtgtgtgtgtgtgtgtgtgtgtaatgcatgtgtttttatattcatgtgtgcatgtgccggtggaaggcaggtgtcttctatcaatatctaccttactttttttgttgttggtggtggtgtttttttttttttttgagacagggttacactgtatagccctggctgtcctaaaactcactctgtagaccaggctgccctagaatttacagagatctgcctgttactgcttccttagttctgaaattaaaggtgtacaccaccgtgcctggttctgccttacttcttgaagaattgtctcttattgaacttggtgcacatcagttggccaacttcatggatgtcccatttcccctgtacatgtttatgtgcactagtgttacagatttgtgcagctatgcttggcttttatgtgggcgttgagaatctgaactcctgtccttaagcttccatgacaggcggtttactcacagagcgaagcctccagtccctgcttttggtttcttttaaactgagtctcacatagttcaggctgctctccaggtcactttgtggctaaggatgaccttgaacttttgaccatcctgcttctgcctcccaagtgttaggattgcggtcatgagccaccacatctagcttttatcttcttttcataactttgtatgtgaatatccagttgagctagtaccttctattgagaagataattctttcttgcatttacttattgtggcacttttgttagaaatcacttggccatagttgggggggattacataccattgatttttgttcactgggctctgttcctgtcttcatatcaatacagattgtcttgattattacaattgtgaaatgaaattaaaaatcaggaagtctgagtcctctgagtcttttcatttcaatgcttttttgtatattgaagtaccttgttctaccgtatgaattttaaggtcagcttttccactcctggaggtagggaagccattggaatttttatcagggttgtatagaatctgcaatttaatccgccaatatcttactcatttattcacttattcattttcatgcttttataactgtaactgatctcttaatttccttttaagatgatttgtttgtagtatagagcactattcctgtttagttttaattgtgatgaaagttttacagttcagtagtatgtattcatagtaatatgaaaacactactaccatctgttttcattttttcattagccaaatagaagcctggaactaagtaagcactacctcacaaagtttccctactgcatcctggtacttagtaactttaagcttctttccttttctgtgctgtttacctattgtagatagtttgtgttgctggaatagtacaatacttgtccttttgtatctgccttcttccatttctatgttttcagggttcatccatgttgtacatatgaaaacttcattcctgtagtgttccattgtgtgtatatatgtatgatgtatgcctcacattttccaatctattcatctgctgatggaaacttgtttacatctttagccattatgaatgctgctttatacacaaggatccaagtatttgttctcagtgcttgtgaactgagtatacctaatagcagaattcctggctcatatggtaaggacatgtttaacaccttgaggacctctagtttaaagccaaccaaaggaacatagtaagacactattcaaacaaaaccaaaattatgattaatgtattaagaactcaaagtatccctttaatcccaacactcaagggggaaagatcggcagatggatctctgggtttgcagccagccagggatacacagtaagagcctatacctcaaaaagaaagaaagggaagggggagaaatcaactttcccacaatcctacaactattcaaaaagcttagagaagcacgaagaggcttgtcgaaagagctgcttgtgataagaaggcaccgtgcttccacctcctgtacctcccactaagctttttgaatagttgtaggattgtgggaaagttgatttctcccccttccctttctttctttttgaggtataggctcttactgtgtatccctggctggctgcaaacccagagatccatctgccgatctttcccccttgagtgttgggattaaagggatactttgagttcttaatacattaatcataattttggttttgtttgaatagtgtcttactatgttcctttggttggctttaaactagaggtcctcctgcatcactctctgagtcctgggattgcaggcaagaaccataatgccttgtttattcataggtattttaaattctttatgtgacagttctcaagtctgtgccatatcttcatctggttctgatacttcttttgtcaagttagatggttttcttgccctttgcatgccgtgtgtgtgtgtgcacactgggtttggtatatggggagatactaactgaaaaagtgggcctttagtaagggattttttttttatgttcctcagccaggaaccgaaccattaaactttttttattcattcattcagtttgtatgcattcatgcaagtgttgtggctgcacatatgtggtttggggacgatttgcagagattagttcttcgctgccacaatgtgagttcttggaggttaacttaggttctcagcgttggcaagcaaatacatgctaaactatgtcacctcactggcctgtttctaatgttagaagttactgccctcagtttcatctaatgcagtggttcgcaacctttttaatgctgtgtgactctttaatacagttccttatgttgtggtgaccaccccccagcataagattattgctatttcataactaattgtgttattcttatgaactgtaatgtaaacatgtaatatgcaacccccaaagggatcaagacacaggttgagaactactgctttagtgtcttttgtttgtttgttttctacttcttggtcctttcctttccctgagactgtcttgccagcatcacttttcagtggtgatcggtactggaaccctgttgaaatgatgggaaagagtgagatggggaagtgtttgtcacctatggcttcagctgggcaccagtccttggctatatccttcccaaacatttttagggctgctgtgtctctctcctccttttgttaagtaaaacaggaataacaactcggactggagctaattaattccccttcttccaaaatatatagcttctgatacattttgtttgagtgttacgttagcctttgttattgaagaacattctacacttatttgcactgggccagatggcacagacttgtaatcctagctatttgggaggctgaggcaggagattccaagtgtaaggtgggcctgggttacaaaaatgagtttatttgaaaattatactttgcatttcaaaagtacttacattctccatccctgaaggttttttattgtttggttttgtttgtgttgttgtttaattcgagacagggtctctgtgtagctctgggtgtccttgaactcccccagaccagtctggcctcaacattgcatctatgtctcaaatgctggcattaaaggcaagctccaccacgcctagcaaggaagagattctcattggctcttatgtcctggggatatttcagaatggttacttttcccctcctacaaaggggaggggatttcagatttccggaggccaagctgcaagagtaggagggtctcttctccttggagcgctcttccacaagctggtctcacttagcacttggcagatttattttcattgctaatattttactctagtgccttctgcctcaggtaagtgtcttgggtgtgatttcatgcatttgtccatctagagatagcaggctctcttgccctgtgtcctcgcttctctagcaggttggagcaaacttgctgacttgaaagttgctagggtctctcttgctgtaatgacaggaatgatgatatctaagctccgcatgtgttggagctgaaactggaagtcctacgtttatagtttaaaattagatcttgtccagtttaaaaataatgttctgcaagagggttttaaactttcgtgtgaaccatttgcttaacaaagatgactcattctcagttatttccatccttttgaatcttagatctctattttcatatggttagtaagaactttttcagaagaaaaaaaatttgaaaagcttaagaacttcatctagttcttgaaaattgctaagaactgtatcctggattaactaaaaatattatgactcttgatctgccagcattgttttttgacttgtcagctaccttttatagacttcgctgaagcaggtctggggatttgtcttcactatttcaccctatttgtttctgcaaaactatctctttctaaggcactttcaaatgtctagagatgaagatctttggaacatgaaaaatgaatgagaataaacttggaagtcttatactgccgttgacttgtactcaattagccttgaggaaggagctaattatacactctagatcttggtgacttttgcttaataggactacttttctaatctgtgcgacagaggacagttcatctaaaatgtgttagttatctagctgagaaagtacgctgtactttgaagccttgtaagttgataacttgctaaaaaatttaatttggggaagcttctgttcttacccttggataagagttgcaaacgatctcaggtgattgacacattgtaaattttgttaaccttgccctttttctagggttcattttaaattgtgtttttctcacagaaagtacagtgaggaatggccattaaaaatgaagaaacaaaatagtatttagatgtttcaaattgattattacttggcaaacacttaatgtgtttgtgttaagaaatactatttttctgttttattatacccaattatttccaatgactatttttacgaaaatgtttttgaagaaggcaaattcaaatattaagtatgatgaatatgattttaactcagcagatgaaaattactttataaatgatttgctgcattgaaaatatttaagtaaaaatattagttgttatgtaaaaattatcagtggtccaatcatggtgaaacacatttgtcttgctctgaattagaggcagaaagcccttcattctgcttttgctttgaggactttgtctcaaaaaatagaggctcttggaaggaaatggatgaagactagcaggtgttcagagctgtttggctcacattttgcatcataggagcttccacccacactcagtaggctagaggatggtagccatgctcctcctgaaaatgttttcatcttaagccctttgtgtatcctaattatctcctcctaactgctgggccatctctccaggtctccatcactcttgatagcctcttcacatttagtttccatcaaaactcgcttgctatctattagcacagacttcccatcctcttgctgatctatttgtccctgctctaatcctgtgctgtcagccctcccactcactctgcgaagcctcagataaccatttgtaatgtcttccaatgcctcagccttgtcctagtttcacagtgcaatctttgtttctgcacccaagtcttctcctcctattaagtggtgtctgtcatagctctctctcctgtgacctccacctttaacactgcccactgtgtcaacctttacacttcctgccttttagtgctttgaatacagagagttctttacctttaatttgtttgctctttctctctcatcaagcaataattttcttgcttcttgtgtggctatctttaatcagtgtggctggggttttcttaccttattctctgtcagtgtctcctggttgttatcgtctcagcatctacttacatgtgtaattactgtatatttacttgttcactgagccttcctttaattataacacttgcacacacacacacacacacacacacacacacacacacacacacatttttgaaattaagatgtaggatgtgtcttatactggatttcttgattcctctcagaattgaaacaattatttatcttttaatcaattatattgtagatttaataagatgctatagtttttaaagacaagatcccactctgtagctcaggataactcagtaggtagccctgactggcctagaactctcagtgatacttctccttaggccttctaagggcttgaggttactggcttgtaccagcaaaacaccatatttgaaatgatctatttttcccagttgattgcgagtttcaccagtatattctgttttactcaccagtaagagcccatgcctattatagtacatttcacctagtagacactgaataaataatggatgaatgaatatcgctgtctttttggaaactgttggcccaccctctgcagctgcatcaatcagtgtatgagtatgaattgttagtatgccaaacaaacagttgactcattatttttggcgattgttttatactgagaaagagacctttacatttatctgttctcccatttatgtaacttgtttcagtataggtacacatatgtaggagcacttaccatttatgaaaatgaattcacataagctttcacctggtgtcagcaattttctttcattagggggaatggggaaggtacgaaacagcagcaggcttttaaactttaggcaggtgtgcctcttgaacttactgtcttatttcacttcatcctccaaggtgtgcactcacttggggtgcccaccttttaagtgcaagaacagcgaacaggcaacatgagtgattggagtgccttacaccagctcctagaaaaggttcaaccctactccacagctggaggaaaggtatggatcaaggttcttttcattttccgcatcctgctcctgggcactgctatcgagtcggcttggagtgacgagcagtttgagttccattgcaacactcagcagcctggttgtgaaaatgtctgctatgaccatgccttcccaatctctcacgtgcgcctctgggtcctccaggtcattttcgtatctgtgcctattctcttatacctggcacatgtgtactatgtggttcgacagaataagaagttgaacaagcaagaggaagaactggaagctgctcattttaatgaggccagcgtggaaaggcacttggagacaattgcaggagagcagttcaagtgtggcagtgaagaacagagtaaggtgaaaatgagaggcagattgctgctaacctacatggccagcatcttcttcaagtctgtcttcgagatggccttcctcctgatccagtggtacatttatggatttactctgagtgccctttacatctgtgagcagtctccttgcccacgtcgggtggactgcttcctctctcgccccaccgagaaaaccatcttcatcctcttcatgtttgtggtgtcagtggtgtcttttgtcttggatatcattgagctgttctatgtcttatttaaggctattaagaatcgtatgagaaaagcggaggatgaggtttactgtgatgagctaccatgcccttcccatgtctcttcatcaactgttctcaccaccatagattctagtgagcaggcggttccagtggaactttcttcagtttgtatttaaagtgaacagaaccatgtcagttacaatgcgtggtcaaaagggggagggcaggcaggaagtatcctttctggcttatactcagcattccccccccccactgtgatgataaacagaattctcagagggttttaggtagaaaagcaaagcaaagatagtggacattaacattgtagagcaatctaacagtagccatgactgtacttaaacagcagcttcataacctagacattgtgacttgtgcttgaaagcattgtgaaagcaaattatcttttcccctaaaatatatcttccaatttattgaataatacataatagttttgttaattgcgatgagttttatttttctcttatatactatagcagtaatcctattgctatgtattttttgtaatcctcttgctatgtagacaatgtattttccttctccaaggtagatgtatatttaactaaatcaattgtactgaaaacagcacttgggaacactatacacttaaagaagtgcttagaggtaaactatgaaatgtgcctacatgaacttggcaataataggcattcttggctttgttctatgtaatgcatattaattcagatcttacattctgcagtgagttttacagtcttatgggatgactggcatttttcatgttcataattaagattttatttggagagcagaagaaggtgaagggggttgcctaattcctgtgtaattgacctgaaacatatacacgaaaaggtacccatttcttctaatgcctttaaaaatattccacaggtgattgaaagtgctgagctgcagacttttcactcttgcatgacagctccacataccattttatacaagaaatattaatttgtttaccatgtgatgttaagttactgttatgttctgcttcatttcacgcaatgcaggcttaatatatcttgttctagagaattctttattcaataaagccttttgagagtggtgcatatgtatttcttctccgagatcctctgagtgatctttggaactcttcattggggcatcttcatttaagcaaactaaggtgggtgtggtggtttgtggaagccaaggcaattgcagagtgtcctaggctctaggctagctcggactgcagtgtgagacacatccccatctcctgcccacaaaactcaatgcactgtaatcacagtttttggacttcaggttgaatgactgacactgttccaggaacagcatccttcatctcatgtaacagaatccatgactttgagatatgcaaaaagaatgtacttaggttttttcccttcccttttaagggatgcactcttcatcattaagtatcttcccactccagggaactcaggggaatggagaacacaggaacaaatcatcaaagctgcagtttataacatcttgttctgacagttggtacagtctcatttggaaaacccagtctcttagttaaatgatgagttctaggttttcttttagaagtacattgtgaagattaatcagttatgtagtaatggggcacttgtgccttttggacactgcaaaagttctaaagcgtttgaatcagggcactccctagtcctgtttcacagtcattttcccatgtagcttgcttgttttagttacacatttaccctgagataattacagattggaacataatagtaaggaataatcgattcggcattccctcaccatgtttcaacagtaaccttttttgagatagggtctctctatgtagccctatttggtttggaacttacattaaggaatttactatgtagataaagctggctttgaattcaaagagattcactggactttgcccctgtagtgtaaggattaaaagtgtgtacaaccatacctggccaaatacatggttttttgtttggttggttggttttgggtttttttgttttgcatttatttatttatttatttatttttacttattcactttacatcccactcacagcccccatcctagtcacccctcccacgttcctccctccctccccatccccttctcctctgggtgggtgaagggccccttgggtatcccccacactctggcactttaagtctttgtgaggctaggtgctttctctcccactgaggccagacaagtcagcccaactacaagaacacatctcacatacaggcaacagtttttgggatagtccctgctccaatttttcaggacccacataaaggccaagctgcacatctgctacatatgagtggggaggcctaggtccagcccatgtgtgatctttggttggtgcattcagactctgagagccccaagggtccaggttagttgactctgttgatcttcctgtggagacccagaaggaagtcatagaaccaagtattctatatcccaatctggtcttgaagctgtggttctttactgtgaaaccgaagatgacctcgaacttctgatcctcctatgtgctgggattacaagtgtatgcctccatgcctggcttatactatgctgggaatttgatccatagcttttacatagttggcaaaccactgagctacacccccaacttttactgtttgttttttttttgtttgtttgtttttgtttttgtttttttggtttttttttaataggatctcttgtaacccatgctggtcttgaactcaatatgtagccaaggtgattgtcttcctgtttctacctactatttaatagaattagaagtgcgcaccatcacgaccttcagatttcatcaattttatatgcactcattgcatttagttatgtatagctttataatttgtgtacagttgtgtgcccactacagtctaaatacacagcagttttggcaatattaccttttttagttgtgtcctttccttcttcctaacccttagtaactcctaatctttacttcacgtgtataattctttcatttcaagaatgctatttaaacaaaatagataggctagaatgccttttacgatggctcttttggcatttgttgtcgtttgtgtgtaatatgtgtagcattccatggtatgcctgcctgtggaagccagaggttgaaaccagctgggaaatttgagtggaatgagggcatcctttctggaccacagatagaagtcagtctctctctctctctctctctctctctctctctctctccctccctctctctctctctctctctctctctctctctctctctctctctctctgagtgtgtgtgtgtgttatggtgtagattccctaataaagtctgtaagtagcactttaaaaattatttttgaaagaggatcttactgtgtatctgtctgaaagagttcatagttttgtgacgtttagagacctatgatataagtgcaccatgcttgtgaccctaatggacaacttttgtttccttctttttggtttttgtgttgttctggtgattgaattgagggcctcatggacagttaattgattgcttgtgactgagtcttgcttgtgtgggggcatacattttggctactttattgggcttttatatatactacctttccccatcccaatcccttccaatacccaacactaggtaggcatgaaagaaggttagaggggagagggggctccagtcttgttagactacctcctactgattggggtgtcaagttccttgggataagtcctatcttagtcatcaggatatctccaacaggcaatccagcaaccatcaatctagaagtagcagaaggagcaaaagcaacaggaggaagcagcagcagcaggggcagcagcagaggcagcagctgcatccacaggcccacttgaggctctcacgtttgttccatgttaagagttcccaaaattccaaatgtaaaccatctgcagctggcagaaatcattcccctactagagcatgggacaaatcatagcagctgtgggaaacctgaagcagccccaatcccatacctgggattaaaacaaaaacataactggattttaaaagaaaccaaaattctcactacacttgtgtcctgaactgataattaaactttcaatcccctttctcacttttccaagtgctaggattctaagtgcactgccacactcagcttacaattctgtattttgaaaataaaactaagtttacatcccctgacttgtgatcctattgaaactctttccattcttattgcctgtcaagccatttgacccatgctaagaggccttgtgcttagtgccttgtagttatcttggttctcatgttttacttgggttatctttaagccttttgctgtctaacaggcagaacacacctggctggcttcagctccccaggccatgtgctttgtgatcagatggaaaaaaaaatctctgcaacaaacctccagtcagaagtcctggagccctgcatgccatgcaagtatagcatgcaagtatcatagccccatggcctgcccagtcctggtggtgactctgtggtttgttggacaaggatattccattccactgctgtcctaaggcttagcttagaaatagcagtaaggactggcattcttcctaaggggaagaggagccaggctttagaattagacctaggtcctctaaacttacttgggaacatacttaagatgtttaggaatacctacaagcagaacattttgtttaacttagatcaacactgaacttttcttttgtcttttcatttaatcctaatagtatcccaggaatatgagctcttgttaggcccagttttcctaacaaggaggctgagataccaagaagtcagtaatgcccttcaggccactcacttgggtagtaagtgctggaggcaaggtttaaatctctgcaggctggctctcaggctggtgatctcatccttcttagatagcatccttttggaagtgtgatggcctttgagttttatgtcaccattttcatttgcttggcatcaggagaggcagatatgtcagaaagaagatgccacagaattgaaggtttgttttcccctaactgcctaggaagccatataggtagacttggtagcattgttatgagaaaggacccaggacataacttacatttttttactgtttggaatatagccctctatatggagagttttcttttttgacttatttttgtaaataggaaacaaaatcttcttagtaaactgatttagtgcttcatagaaattttaacagtttctgatgtgtatttgttctgcgtcattttctttctactttctgatcgatcctgctgtaaccttagttttgtttaaatacagctagtagaatagctagaaggacaaaaatcaaagccagtatgtcaatattattcatagatttagaattttagctcaaggacttctgtaatgcagctagaagtcagccatgttcctctgtcagaaaagacccatgcttccctttaccttgccttttcagcaaaaactacttccacccccactttttgtaatgtaaactcaagtcccatttatatacatattccatggacttggtccaatgtcttaaatgtttgttctatgccacataaatacagagtattagatataaaatttctgctgttaagaaataatataatttctcctataatcatgttactttacatttttccaaaatttctcatttttctcttaaatttcttgaagcacttagccaaaccatgatgtttgtaaagcagatatttttcagatttatacggcttcatttttcatgcaatttgaatataatttattgatataaggagagtctttgtcctagttaaagacaaaccacaaggataaactttaaaacttcagaataattcattaagcagccatttggctgtggatttaggacaaatggcatgaaaggcatgcccggcatctatagaaagcttactagatagaatgaaagggctcacagcaatatagtaatggagtttgccctgtgtccttcagttcagtctgtcagagagtgaacaaaaggaagtcgccgtttttgaaggttagatccttttaacaaagatgtatttcaagtctttatttttggtagtgtttttagttacaattaaaatttttggtaaagattaattaattaattaattaattaatgtatttattcattatatgtgagtacactgtagcggtcttcagacactccagaagagggcatcagatctcattacagatggttgtaagccaccatgtggttgctgggatttgaactcaggaccttcgaaagagcagtcagtgctcttaaccactaagccatctctccaccccctacaactaaatcttatcccatttccttgtccaggatgtcctcggtctcattgcttcatgattactgaaaatttcatcagggttacttaaaatgtgtggactggtcagtcacagtggctcacacctacattcccagcacttgagaggccgaggctgggtgcaatcatgccacaaagcagaggccatcatgaactacacagtggggccctgcttcaaaacaaaacaaaacaaaacaaaacaaaacaaaacaccaaaacatcaatgaaactggcacgtccaactggtctagctcatccttttggagggcttttctgctaggtattgcagtacagagtcaaaatagggcccctatttttaccactattaattgttattttgcttgggaagtgaggcagtcatatggatgtcctttgccagaggtatagatagaatgctagggactgtaaaaagaggagtcacagaacaagctggaagtccctgcaaatgcttctcaaaggaggagactgaaggcaaagagaaatgaacttgctggcttagtatcatttaagtaaggctaaaatgtggtacttctttgaaatttcctatcggcacagataccctggagttgtctcaccttgttttcccataagctgttaacatcaccttattgtattgtattggggatcaaattctagacaagcattctactactaagccacatgcccaggcctattcttgctttgtttcttgctcttccttccagaatgtaacctccatgagaaaagagccccctttgcaatgttggttcctatcacacagtagaagcttgaaaaaaatgtcagtgaaatgaatgaatgaagaatgaatgcaaagtatgcacagttgagaaactgcaagtaattagatgtggcagaaaaggcacttttctttaaaagataaaaaatcctgatctcatggagacctttgataatggtatttgaagaggatttctaacattattacccactaatattgttttctgtataaggtccacattttatatccaaatataaatgaaattgtatggtactttctatgcctctcttatttcacttagcacaatgacttgtaattccttcaatgttgtcccaaatggcaagatttcttctctttatggctacatagtatttcattatgtatatgtacatatttattgtctatccatcctttgatgtacatttaccttcactattatgaatagtgttgcattacatctgagaatgcagatgtctatattccatattgatttcatttctttcccatatgtagctagtagtgaggctgctagacagtgtggaagatatgtttttaagatttttttgaggaatcttcattcagttctccatgctacctatactaatttacatttctatcaaaattgtatatgttttctttttttctccaggttgcttccagtacttcgtgtcctttgtctatttgatgataggggttcttatttgagtaaggtgatcatttcattgtagattttacattttataaaataattttatgtgtatggatggttgtctgtatgtctttggatcacatccattcctggtacctgtggaaaccttaagagagcaatggattccactgggactggagttttagacaattgtgagccaccatgtgggtgctgagaatcaaacctgggttctctagaagagcagtcagtattcttaaccaaagagccatctctccagccccatcagtgtaggtttgattgccatttctctgggaaatagtactgttgagcatttttcatattcatttttgtcttttgagagatgtttgtcaaagtctattgcccatgtttaaaaattcagttgttggagcttgttattgttttgctgttgggttgaactcctgatatgcagtggtatttggtaaccagacacaaaactttgattcaaaatatatactattatctggctgtttctctgacatcattgaacttctgaagactttcatgttggtgttgtttcattagtatcaccatgttggggaatttgtctttcttcttcctctttttatctttagcacttatgcgacatgacttacaatcattaagcttccatgtgtggttatggtaaatagtgcatcttccagattcttaatatgatgtagtacatatgtaagataaaatgatgtggaattggatatgaagaccacacactttttttaagaatgccacagactgctgctttgtttcatattctttgtgtggtaagagaatgcaaggctgaagttttctagtttatttttccatgatgcataatgaagtatgaagagttttcactaagacactttgaaagggtatttatgtatttcacatttacttgctttattttatgtgtatgaatgttttgcctgcatgtatatatgtgtaccacatgagtgcctagtgcctgagaagagcagaaaggacttgaggagatcagaagagagtgtggggtctagaactggaagtgagccactgtgggagcactgggaatcaccttcccattatcctttcttgttcaccttcaattcccagttgatacccttcccagctcatcttctgttttccttttctttttgacccattgttcttagggtttcttataagatcccaggtaaagggctatttataagaacattagctctctaccagtgattgtaccacctaagaatatgtctctccctcccccagatattcaggtggagatgaatcttcttgacaccctgccccagcgctattatctgccttttaggttctcttctaagctctatggcaggatactgacaggcctagtcttacacaggtaaacacaactgtcgtgagatgaagaacattgctgtactccaaagatgacatctacctcatcccatccctttctttggctttttttatttctgccctcttcttgccacattccttgagccttggagtgagtattgttgatgtcacttatggctgactcctttgccagccttatgattgcttacttcttattactttgaccatttataagtctttgcagttaccactgcccattgtaaatggagcttctctgaccagtgttgatggcagtactgctatataggtataaatataattgttgagagggtaatttcatggccacatcttgtttattttgtgaaacaacagcaatagcttcccacttaaggcctgtgacctcccaagccacccataattccaaagaattggaggaaaataaccattgacatattggccttatttaagaaagttcagtattcatattgtcatatttttatagagtataaacctagactagtatggtatttcccaaaatccagaatgaatagatcacacacaccatatacacaggatttatcagggtgttgatgaacaattacaaaacagacattaatttgcaaccactttaggtttttgtctctaacttcagcagaaggtgtgaatgtgtgggtacccctggatatttttgttgttagtattccctcagaaactgtgagccactttttccatgctaactaccttttgttattgccagttctttatacattgtttacctataaataactgcaaatataaagacatcagtgttatctacacagtgcacaggcaagttagacagtttctaccccttataaaggaatctgtataaagctactctcactatttagcagagaaataatgttttctctttagctgaaccattttaattttatgatttattttttattattttaaattatgtgtatgggtatctctctgtctaggtaaaatatatacatgagtacagttcatggccacacaggtcaggaggagcatcaaatcccctggagcagttttgaatggacctttgcaaaaggagtatgagctcttaaccactgaatcatatctccagccccaaggagcatgtatttttttaaaatattgatcatttgtccacagttataagattactttggttgttgttctatcagtacacctaaatttttcaaatttaatagggataataattttgaaatacatgctgctgtatctgtggtcaatatatgggaatttctctccttaaatttgctttttatcatagccccaggagagggctatggggagagaagcaaggatgctactttctaggagaattttctttgagaattaaagcagtgaaagagtgtcatttcaagtgataaaaccacatagaaagaagagggcaagttagagtgggtaactctatgctgacatttccaacatttccgcttcagaaaaatggatgtgttgaagttattgccaaaagtgaaggaagctcatttctcattcccttcttgaaagatgctccttccaagtttacctcattacagctggagcagcaacagcagaaaaaaaaagtctagggtggttaagtggctagaagcctcctgctcttcctttagcttgtgatcagtttctaaggatagcaaaagaacatttatcttaggtagttgggttgacagccagtggaactatcaatggggacattgtattgaggcagaggctgataacaatatagcagtcagtaaccaaggggagtcgtaaatgagattacagtctaggtgtctttagcaccaggaagccaagagggaactaatcagttggaccaaactcccatgttctgagctaagagagctctccagagttgattatatttcttgggacttaacagaggcaccaggggttcaagcccagaaagaaccttcttagagaccagagaacccctgccttactagagtgagcgcctttcagcttcacctactccatataatgcagcccttgtcttggcagaagcagggagaaagatctgaaaaatctgcacatttctctgaaagaatctataaactaggaaggaccaagtcactaacacatcatgcaagttcaaggtgaagtgaacactttaaaatttaagtgaacttgaattacataacagaaaattgaaaaactaccttttctcagtacaacttagatttagtgttagttaagttagtgttgctgccacagcaagataatctttgatgaaatatagtctgcatttaattttaaattttgtattctcccatcagagttgagtgtcccataagcctggtgattgtctgattgaggttgtagattgcctgcatttggcatgcccaattaatgccatctttatttttaattatttgatcaatacaagtggaactttcatttttatcattacatccttattgttataaaataagggtgcaatgaaatagtcacacaatttgcacaataactgcagtgcaggcagagacggttaatatcacttaactgaagtacatcccaacagccatcactactgcataatctctgaaattttcatgtacaaggcctcttgaggacatctgtagatatgtgtataaaggtgtggacagtatacaaattgaatatttcattttacacaatcttttactaaagagctagactattttgaaaggatgtttgtttctccacatcaccatccttcttttctcagaagatcttatgtcacactgaactcaagctatcgtccttcctcttcagcctcctgactagctgggattccaggctaccacacctagcttgtctctcccctttctatttaaagagatgctctttgctgtatgaaaggaattagggaaacttgtttgggcatcttattttttatcttgataactggatttcagtttttgaacattttattaattaccttccctgcacagccataatttagtaaatttgtattaatctataactatgagataaattcattttaaaagtggtttttaaatgatactagagattggacctagagccttgtgtatgctgggaaagcatgggctgcatctctctctaaccttaaatctactttcctgaggtataatatatagatacaaaagtgtaaacgtggcctacaacacactctaggtatagagggctataggtgtgtctcagtggtagaacacttgccaagcttgtgagtgaccccaagtcttatctctagcccatgaaaccaacaaaaggcatgcctatttccttgcacacaacaaaatgagcccattttcagtgcattgtttccctatagacatttctccttgcatcatctttcgacattgtcagccagtgtctgatctcgttgaacactgtcacatactaatgctcacagtagcttactttgttgtgtgggtttgtgttcatctttcaattaggcagtccaagatttttatgtcttccattctgatattcttagcaccaaaatatcaaccttcagctttctcagaaactttgatttttattgtagaaataaaaatagttcaactccattctaagtactctgagatgcccactgccctaagaacttagaaaggccatactgtacaagctccatagctgttagccggctagcaaacttatgactgttcctatactgagagcatcgcagatgtcacaagtgtgtgatagcagtagttagagctttatcattttcactggactaaagcatattgcacaactttgccacagactagaacacaggtgactgtggaagaaaaccttttatttttaattaattaattaattaattaattttccactccatattccattcctgctccttccttttttccaatttttattagatattttcttcatttacatttcaaatgttatcctaaaagtcccctataccctcccccccgccctgctccccaacccacccactctcagttcttggccctggcattcccctgtactggggcatatgatcttcgcaagaccaagggcccctcctcccattgatggccgaataggccattttctgctacatatgcaactagagacacagttctgtggggtactgattagctcatattgttgatcctcctatagggttgcagaccccttcagctccttgggtactttctctagctccttcattaggggccctgtgttcaatccaatagatgactatgaatatccacttctatatttgtcaggcactggcatagcctcacaagagactatatatatatcaggttcctgtctgcaaaatcttgctggtgtatgcaatagtgtctgggtttggtggttgtatatgggatggatttccgggtccccaccccttctatccaccctcctactgttccacatcccacacctcctcccaaccccaccccatctccatgtggatgtccccacccctgaccccacctgacctctaaactccctggagcctccaggctcttgagggtttggtgcaccatctctgaatgaacacagacccggaagtcctctactgtatgtgtgctgggggcctcatatcagctggtgtatgctgcctttttggtggtccagtgtttgagatatctcgggggtctggggcatgatgatacacacccttgatcccagtactctggaggcagaggttggcagatctatgtgagttccagaacagcctgttctacatacagagtaaattccaggacagcaataggctatctacatggtaaaaccatgtccttaaaaatattgtaagctgggcagtggtggcacacgcctttaatcccagcacttgggaggcagaggcaggtggatttctgagtttgaagccagcctggtctacaaagtgagttccaggacatccagggctatacagagaaaccctgtcttgaaaaaccaaaataaaaaacaaaaaaatagtgtgtgtgcaggtgtgtgtgtgtgtgtgtgtgtgtgtgtgtgtgtgtgtgtgtgtgtgcacgtgtatatgagggtgagaagggccactttgtgaagttggttttctattttcaccttttcttgcatactgaggattgaactccagtcactaggcttgtgtagcaagcgtgtttactcagccagctcactggcccaaaagcaaaccatgtgattgtttcagggagagaagcacaagatacacacacacacaaaacctagcacattcagtcatttcacagccttgttatgaaagcaatattaacagaggaaaacaacctcagtttcacagtgcatttggaagaccttccgggggtcagggcagtcaagtagcaaagcaggcgtttactgaggcagtatcatttttttctgcactttaagagctaatttaaattcctggtgagggccagggccagagatgagggatcttatgtctctttgaattgtcatttttgtaaatattctaaaggccagaagaacaaatctgttcaactgtgtttcctagggaatactgtgtccttttttttttctttttctctttctttcttttttttttttaagatgtatttattgtcttagtcagggtttctgttgctgcaacaaaacaccttgatcaaaaagcaagttggggaggaacgggtttatttggcttacacttccatattgctgttcatcattgaagaaagtcaggacaggatagggactcaaacagaacaggaatctggaagcaggagctgatgcagaggccatggaaggatagaacccaggaccagcagcccaggtatggcactacctaccatggactggtccctccctcagtgatcactaattgagaaaatgcctcacaactggatctcatggagacatttcttcaacagaagctccttcctctatgatgactctagcttgtttcaaaaccagccagtacaattgaccccttgtcaacttgactcaaaacagtcttttcttattcatcccaaatgtctcacagtaaaagcataaataactttaaaagtctcacagtctttccaaattcaaacatgttaaaatttcagtccctttctttttcctattaatgtagtcattcacttcgcatcctggttacagcccccctattctactagtcccacctcacagatccttcccccattatcccctccccttcttcttagagaaggggaagccccaccctcttgggtaccaccccatcctaggacatcaaattgcatctgaactaagcacattctctccatctgaggtcttatcaagcattccagctaggggaaggggatccaatggcagacatcagagtcatgaaacagcccctgctcctattgttagggaacccacaggagtaccaagctgcatatctgcttcacatgtgcaggaagcctacatccagtccttacatgctctttggttggtggttcagtctctgagagcccccttgggcccaggttagttgactctgtaggtcttgtgatgcccttgacccctccagctggctcaatcctatcctccactcttccacacagctccctgagctcaacctgatgttggctatgggtgtctgcatctgttttggtcagcttctgggtggagcctctcaaagaatagttatgctaggctcctgtctgcatgcaaagcagtgtatcattaatagtgtcaggaattgtctttctcacatgggatgggtctcaagttgggccagtcattggatggctattccctcaaactctgctccatcttgatccttatacatcttataggcaggacagatttggggttgaaggttttgtaggtggtttgatgtccctccttccctccactggaagtcctgcctggttacaggaggtggccacttcagtctacacacacacacacacacacacacgcacacacacacacacctactagtagtgtcagctagggctagcttattgactcccaggggcctcccctctcctgggactctggctagtctcagagatgcccgacacagatttctgttctccctcctgccttctgtcctcacacctgattcctcccctctctatccccagttctctccctccattcacctccaatgtattttatttccccttctgagtgacagtcacaaatcctctggtgaccccctcctaattgtgtagtttctttggatctgtggattataacatggttttccagtactttacggctaatgtctacttataagtgagtgcatgtccttttgtgtctgggttacctcactaaggatgatattttcactatccatccatttaaaatagccaatttcttttaaaggcccacatctttcaattgtgggctccagtaaaataaaaaataaaccaactacttactttaaaagggagaatcagggcacagtcacaagcaaatcaaatcaaaaccaaactccaattatgcaatgtctgagatctagtcacgatctctggacttctccaaggggcttggatcacttttccagctctgccctccgcagcaaacacagcttgtcttctagcctccagctggctccattgttgctgttcttggcagtcatcccatggtattggcatctccaaaacttctggggtctcttgctataattgggctgcacttttaccaataccctctcatgggttttcttcttgatgcctagccttaacttttctgcatgacttcttcagtcctgaatcttcaattctcactgaggctgcaccttcaccagtggcatctcctggcctcttacagtgccaaatctcagctgctctgtgaccccatcatgccttcaaaaccagtactacttgggtaattcttacacattaccaagtctgggtgctaataggaggtagagccatggcagccactggaacacaatttttctgtgctctcaggaaactcttcccagatttcactacaatgatgttgttctccctcttaatcactgctaaattctcagctccagctgccccgactatcccagcaacacaaaggtttcgtgctagtagttctggtatcttgttaatcacagctgattctttagctgcagctaaccagaaccacagaatcttaattcaaaatagcaaacaaccctgatagcgtctttaaacttccctctgaaactcttcacaccaggtctctccatcttctgcactgctctcaactttctcatcttccaaacttctaaagaatatcccacttagctgttaacattcagtggtttttctagcccaaagttccaaggtccttctacaatctttccaaaaatatggccaagtcagtcacagcaatacccaaccatgctgataaccaacttctgtcttagtttgggttttattgctgtgaagagacgccatgactaaggcaacttttataaaggaaaatagtttattagggttggcttacagtttcaaaggttttagtccattattgtcatcatgggacagatggtagagtgcaggcagacatggtgctggagaaagggcttagagttctacatcttgatccacaggcatcagggtaagattgccacacctagctcaagcccacctctacacacctcttccaacaagaccatacatactgcaagaaggtaacacctcttaatagtcccaacccctatgttccaagcatccaaatacatgagtctatctatgggtgtatgtgggggaggtcattcctatttaagccacaacattatgtaacagtactctgttgtgggccaccatgtggttactgggaattgaactcagaacctctggaagagcaatcaaatgctcataacactaaactatctctccaccccctaggaatactgtgtcttaaaaaataaaacaaagaaagccagaaatggtagaaaatgtattcagtattttcaaggccttgggcttgatgctcagcaccaagaaaaaaaaaaagaaatgaaaaaacaacctggaataaaaacaagtttagtgttcttgcttggttgatttgcttttcctggtgtgccaagacatgggtagctctttttcttcttatttttttaaattactgcaggaaagtagagggtttttttttgtttgttttgttttttgttgttgttgttactgttaaactagtaattgaagcccaatgagaaagatggcatgggttttcaatagacttggtacagataagcatttgcaatccttcaccgtttgcttgttttgctgaatgtctgtgtagagtggtcagagcttgatggtgcactgtaaccctggtgagcatttcatatgggttataactttccagaggctatgaaccatgcatgggaagctgagttgggtgggggcaagatgaatagccctgcagtgggaggttgagtctaaaaagtggctgcagcttgacaaacgcatgagacctggagagaggaagagagtaaagtgttgtcctgtgttctgatcacccagtggtcttgccaaccacctggggtggggctgtgatatagtttttaagtcagtggagtttggggactattttagggggtcattacattggatttctagttccaaagaggatcctgttggttgggggcaaacatgctagagtaggggtgctaaagacttgacccgtgatgggagcattcatatatatttggaaaaactcagatgatatgagcctctgtcacttgatgataaactagatatatttggaggtgcagatgtaggagattggaagaggaatcctaaatttctggctaccattcactgagattgagaattgggaacaggcccaggtttagtagaggaacattgagaatgattaggcattctgtctgaataaattatacttttatactcccattttatgtctcaactaaatattcacagagggcagatttgccttactgagagaagaaggtattctatgttttatggaactaaagaaaaaataagaatttgttacataggatttatcactgacttggcttgaagactgctttctccataggaagtgccactttaaaatgccattccttggctagagatgtgcttcagttggtagagtacttgcttagcatgcacaaagctcaaggttccatcacttgtaccacatttaacaaaagaacttgagtgtggggatgtggagatggtatagttggtaagttgatacttgccatatagtcataaaaacccgagtttggatccttagcacctacataaaagtgaaagacttaatggctgtgcccataacctcagcactgagggtaggttttgggaagcagagacagttgtatccctgaagcatattggccaatcagcctagccaaattgatgagtttgaagttctataacagaccctgtgtaaaaaggtgagggctagaaagatggctatgcaggtaagaacacttgctatgcagaggacagttccattactagcactcacatggtagcttacaactgtgtatgacttcatttccgggggatctggtgccttcttgtgttgtctacaggcactgcacacatgtagtctacttacatgcatgtaggcaaaacactcacaattatttttttaaaggtagaatattattgaggtaagacacccattatccaattctgatgtcagttttcacccttgcacaccaacaagcacacatatatatacccgcaggagcatatacatataacacgtgccctcaaaacactgccctaaacttcagggtaatggtacctatcaatgatccttgcaccttgaggatagaggcaggaagatcaaaggtacaaagtcatcctcagctacatagtatgtttgagggcagcctacactatgtgagacagcctgcaggggtcacaaagcaaagcaaagcaaagcaaacaaaaaacccaagaagaaacagaaaacattcttcatatctattttggctacatgcggttaataaagtattaatgttttcataaaactactcattttaaagtctgaacatgaagtagtaaatacgaagaagttgtcttattattccttactaaatattaaggttttcctgaaattacgcttagataaaagtaaattgaaactaagtgcagttctgagttgcactgaataccagtgcttgctgtgttactatcccaacagcatgagtcttaatagcagttctcttggcttttgctgtagatgatggtccttagctaaattgattcggccaaatgggaagtgttactgaattgttaacagaaaagtaaataatatgttttaatagattttaatatatgtgtgtgtttccataatgtgtatctgtgttcttgagtagtatgtatgctccaagtttgtgtatgtgcaccacatgtctgcagtgcccatggagaccagaaggcagctgtgagtcccctggaactagtgttataggtcattgggagccacctatgtggatggatgctgggagccaagctcccatcctctggaagagttctcacccactgtggcctctctccagcttcccttttgatatattttgtcatataaaattttactggagtcattgtaaaaataaccattattttgttaaaatgagtgtagatattttaatgccacaagtaatagttttaatacttttttgagacttgatcttttaacttttccatttgcaattaaaatttcactgagtcctatcccttatcaggcaactattgactgcctggaggagaaggagctagacaagatatggtttgctgctaagtatgaaaggagtatacatttttttctgtatatttgcatgactaaactgttttgagttcctgtggtatatcatacaacatctgtggtatttttcaacttctgtcatgcattttcaacttactatcatacagtgttaaacagcatctcatagataggcttcagtgtacaggagccagcttcattgactccctcatgtcaaacacagcagcagaaacctttagccatggcagagacccagcaggcatttgttaattgacagattgagatgtcttccttcctgcctacactcgattgttccctttctgatttggtatcacatatttaaatttagacataactagcttttaatatagacaaactatggtagttttcaagtaatccaatgtaggtcacatactctaacatttatcattgtatataatggataatagtttgtatttccaaggaaaaagcattacatatgtatcctacctgctgtgaaatatatctcatgcttcagtttgctttcattttatagttttactcataatgtaaaaagtaatttcagtctaagttatttttgaaggtgtttataaaaataagagtaatgatagaaataagtaaatatttatctatttattttaataaaaacattctttaatattgataatagcatctatgactagaaatacctgatggtgctaagatacatttcagaaaatcgaggaatagaaatagtgatcctggctgggcgtggtggcgcacgcctataatcccagcacttgggaggcagaggcaggtgaatttcttgagttcaaggccagccttgtctacagagtgagttccaggacagccagggctacacagagaaaccctgtctcgaaaaaccaaaaaaacaaaacaacaaaaaacaaagaaatagtgatccttccttggtaggtggtaagtgtactctgtgtgtgattgtgggggagaagtgcccacacacacactcacacacacacacacacacacacacacacacacacacgcatacctatctatgcgtacatgttagaacttatcttttcttacaatgcatattcatttattgcttgcaaaagccatattacactacaatgcttgagaaatgacacccagaatcaatttgggtttgaaatctcagttctactatcacttagctatggttttgtggtgcttttagcttctacttttgtacctggaaactcagcatccttatctctgctttaggttaacacatataataatggatttctgtatgacctcttcaaacctatgttgtattattttttctatttttttcattatcttcagcatcctcatctctaaagtgtacatgacaagatccttagtgtagtgatttgaggattgcctgaaataatttgtgggaaatacttagtatgagacttgtcataaaaattatttttaaaatggtaatctaaaataaagtttatataaataaagccttgtataatttgagaagtgaaagcaggatgattagaagttcaaggctagctttagctacatgagattcaaccttaaaaatgaaaacaaagtaagtttgcctttttgaatcccatactggccaataaagtttgtctgtgattaaaattttgtttcgactgagggggcatggggatgtgtgaacactgactgttggagatctttgcatataaaatgtggaatgacttaaaatactttggttatcaagatgtagcccttatgtagatgaagaaaagcatttctcaaaacaagagggggtttcctccgagaataattagaaaatgaattattgagtataatttttgaaatagcttagtctgtgactagaagactacgatagaaacagtgctttctttttcctgttgtttcctgctacatgctgtatattttaacatagaaagcaaaatgacttaggggctttcaacactgagcaataggagtgaatctgtagtccctgtccagtatggttagaggcttgtttgtttgtaatggagttgagaacttgtcgtaagaataactataagccttccagatcttctactgttaggtactactcataacacatttttcagttgtcttctcccaccacctcccctttttcttttttgagacagtgcctcatatgaaccagattggtctccaaactctcacctcctgcctctatgttctaaatgctgaaattacaagcctatagcaccatagcctgcttaatcttttttcctttcactgaaaaagaaaataaaaccttattctaggaaatgttgaatgcttcaatatagagatggtaaaatccagaaagctttatctaaaaattatttcatcctccttttgtgtattctgaagtaatcttgaatccaatttggaggtaaaaggaaggatgaggtagactgaaggatgagatctgtaatgaccattaatgaattgtggagatattttatctcattcttattttgctggttaaaatgtcttctttggacagcctcatttcaaaaataaagcaggacactgagacaagacaggatgatgtctatcttgctaactgcagctagtgacattctgttgcagacattgtgggggcaatggcatgctttggggaataaactgaatttaaagcccaggttctttagttattttcatgtagtttcttctttgcccacacctatattatgagtagcatcccaggatagtggtaaaactagtaatagtgtttggcatgtcacctcctgcctctctattaagtacctatgaagacatttaaacagaaaagcagaaactcttaatagttctgtgaatgtaaaagaaattcaaacactggtgacaaactctagggagaatttcattagcaagagaagattaaaaagcacccttgaatgccatgttatttattacactttctgaaaccagctgaggcaaaaataggcaaagggggctgggaaagacttgcacccatgtgtaaagtggccggcaggcaggcagtcatctcaccaaggagcttgggttcttgctttcctacgagcccacttagcatccatatttccagatcatttcagatataaagtaaggcaagaaatagtgaaggcttggaagagacagtatccacagagaattgtggctgccaccaataccaaggtaatgtgttctacagccagtacagccaagtactcatttggcttcttgtatagagaacccttcccacatagtccaaggtcaaactagccaagtccagtgaggacaaggatgttcaattgaaagcaggctctgagaactcaatctttatttgaacttcatgtggccgaaaaatccatctacctaatttgctgccaggttccaatcttgttgaatttctttccatcttggtaataagtatacgttttataagggctgtgggcagaggaggactacaaagagaggagtccagataaaatgttgccttgagatttcaaagcaacagcttgtcttgaaaatgacttttgtgtaccaagaaagtgaagtcaagacatctatgctatctcctgaaaggaaacagtagagatttgccctgtatagagcggaacagactggacaacaaattcaggacttttcttgagatagagaaggatgaagaaatctaaaatggaacaaatgaacagaattgatagcagtgcttttgagtagttcactcattgaatggtcactaaatattaactgcctacctgatacattagggattggtgctgtaatactgaacaaaatagattaagcagttatgggagacataccaggtttacagtgaatattactagaaaattttgagtagatacaatatttaaggctttcagaaaaaaaccctcctgaacatcaataattttcatattactttcagaacacaaacatggatttttttctacaatataggcatatgatttcaattttttcttatatcaaggaaaagaaatgacctaagagaatctagatgtaaaaattaataataataataaggtatccactttggaacaaaaaccaaatcagacttagacatttttctaaaaaaccagagaccatcatggcagatggaacagaggaaagaactctgtttagagccttctatgctatcactataatttctgttagaaagcagcaggcctttgtgggatgatgttggaggcacacatgtgtgggtgatacctgtgtgtgtgtgtgtgtgtgtgtgtgtgagagagagagagagagagagagagagagagagagagagagtgtgtgtgtgtgtgtgtgagagagagagagagagagagtgtgtgtgtgtgagagagagaggggggaggggaagggaggggaggagagggagggagggaggggagagagatctgtcaggtgccatccaccttgtttcttttagacagggtctctcttactggcatggagctcatcaagtaggttaggctagtcaatgggcctcaggaatatgcctgtctgtacctccccagagctgagcttacaaactcatgcacaacaccttcctttttgacatggattctggggattgagttcaaggactcatgtttgcatgacacagcactttaccaacttagctatttcctcagcaagaacaagcctaaattaaagactttaactttttttctcttgaaaaaaaaatagctactatgtgaatttcttgcaaagcatttcattcttaataagaatatggatttcttgtgttggtgatgtgaatggtacttctcagggttttttgtaagcatacagaaaatctgtgaatgcaggtttttcttcctccagattgatctaacctccctctttccctccctccttcctttccctctttctctctttctctctttccctctttctctctttccctctttctctctttcctgctttctccaattttttgttttagcctcatacacgctaaacatactatctaccacgatagaaatagaggatcaaccctcataaattgttctctgacctctacacatacagtgtggcaagcatgctcaaccacacaataaataaacaaatgtaattagtgaaaaaaattctctactaatatatagttgaaaaatattcttttaagtaatgccatttgttttggcactgcttgtggactagatagtatatactgctgaaggagcctggaaaggggtatacttgggtatgccagcttagttgtgtgtattaggaacgttcagcacttgtggcctttgaaccatctgtgcaactacagcattagctctgggaatgaagatgctcttggagtatgttgattgacagactatttaaataaccatctattacaaatggagctttaagcagtttttaccatcaggtataaatgttacttatataatgggaagtgacatgcacaaccatatacatatatatgcatataatatgtgtgtgtatgtatgtatattaaaaaaacaaggtatacagtattatgattccaagttgagaaaaaatactgaagaaatataccaaactggtaagagttatatgaatatttctggatgtcttctttattttgtttcttttgtgtcctgtacttttgaagacattgatagtgaagaattatgtttcatacatagcgtgccagtgtctgttctttgcccccttgctaccctctttcttaaccttccttggcaatgtctctagggcggtaagaggattctgaaacagagtagtgggtggatggagatgctctgtcttagctcctctgcccgcagataattgtgattcccagttgggactagagaatgattttccctctgcctctctttccttttcaggaaacacatgaaattgtggcaatcaagaaattcaaggacagcgaaggtatatgtacatttttacttctgtacttttttttgtaagtaaaatgtattagaggtaggttttagttgttagacctctagccctgtgattttaaaattataaccttggggagggaatgcaacttgtttattatcatgctaatttactttttaaaatatttcctatctcatgctattaaaacatctattttaatttacaatcaagggtggaatttttgctccaaaggccagatagaagttttcttaactacatgtttccacatagatgacaatggaagagatgattaaaagcaaatgcatgtgtagctcccataagtgtgagtgcagcatttggtcatggagttctctagcccctagtcacagcaaggaatacaagaagtggaaggcaggatggaaaggggaatttttatatttaggaccatttttttggagcaaataagattttcaataacagataccatatttggtgtggggtggggggtttggtcacacttttagagcattaaaattctctgctgggcaagaaagtttcaaacagccttagctgttaactcttacctaaccaaagacaaagaaagactgataatgaaagtctacatggcttttgagatttaggcagcagttcagagacctcagtaaaaagactttctaaatcctagcccagtttccatatcgacactatactataatgaagcaagtcctacaaattcgtgtgttaatgaggtactcaatcttctactttcactgctttatgtcaaatcttaaaaaaattctccagtgtgacattgacttgcaagctaccatatgaaaaataggtaagaaggtatcagcatcagcctctggatcgaatgtgaagcctgaagatacacaatgtagcctggcttcattggtgcacctttcctaagcacttgaaggcagtagcttctatatttatgaacagtctcatccccctaacctcagatatttagaaagcataaaataacagaaggcttgtaaacaaaaggttcctaggatagcttccatagcgtttgatgtaactaaactatgaagtaactaaactacttatgtggaactcttgcatattacctagggccctgagcagccattgtgaggacagtcactgaggacagtctaaaaggaaggcactgggaaatgctttatagcttattctgggagacagtgtgcttaaaaccatgcctatgtgcctttgatctaatgcaagcagttacccctgggtaacctactgtgaaaccattggaaataggctctttgaacagtgactctagactaatgacagatggtccagagacaaatggtgatctaaaaggagtgattgcaacaggaaatcaaagcagcactcttgcatgtgtatagagacatctgactctgtcttcacctttaaggtcacattggcaagctgcaaagtaataacggccagcagagcttcaaaaacttttttttggcacagggtctatgtagactaagcttgcttaaaaccctgttatctagtcttctatgtctttaccctgttcctctggcaaggatactcttaatagaaaggatggttcatatctggtgatcaactcttttacattatgaatcatgtataatagtttcatatagacgaagttgtctactaaactactatgtaaactatgatatataaaatctgttttattagctgggcgtggtggcacacgcctttaatcccagcacttgggaggcagaggcaggtgggtttttgagttcaaggccagcctggtctacagagtaagttccaggacagccagggcgatacagagaaaccctgtcttgaaaaaaacaacaacaaaaaaatctgttttattatctaaatttcaaccagtgtattataataaaaaataggagtattctaatattgttctcattgtctagtaactctcaaacattctctttattagttgccataaaattcatattatagtagtgaatattctaaatcatacatgtctaaatttttgtgaaagtaaatgaaatgattctataaaagcgttgataaacttaggctgaaatgaaaattgtgcttggtctgactgacattcgcattaatgtccctaaatattctctcagtgatgatgtgcagggagggcatgagaatatataccaccttttggtagctttaaaagattataataacatcctgctatcctgttaacttgatatagatccaaaaattatgtgaaatattttattttcaatttaaataaaagtgtatttgcttttaaatagaaataaaatgtgatttaaatttgaattatattttatgtaattttaaatctagataaaattgtatttaatttaaataaaatacattactattttatttaaaatatatttttaggtagaccactttttagtgcaaaatatcaaatatctttactatcccagaataactgattactgtttaaaagacccaaattttcatagtaaataaaagggttgttactttaactggaaaaattaaaactgaaattctgacaataagtttatttttatagtaaatacaaatttctattataatagcaactgtgtggtaatttagtttttagcacaattgggtattatcttttaagcaggagagtttttacagtaaagtttcataattagctcaataaaaacatagcaaaaggctttgtcagttttctctgtcttcatatgtgtgtcttcatgttctagaattaatgtattttgtatgtatgagtattttgctacaagtgtgtattgtaccatgtacaggtctggtgcctgtggaggtaaggacgttggatcccatttgtgctgagaatcaaactaggattcttcaagaacaaaaactcaaacctcggagccatctctccactctgttccacatttttaagttttttattccctggttgttagtggataaaactctaccagatcatttatcagtatctttgcctatgcatttccctgcaagattttaatactctagaggagttcagaaacttctgttaggagaaagtatataggctggggatgtggctcagtggtagtctttgctttaattcccagctgccagccccacccccaaacaaaaaggcatgtttaagtgataacaaatttttatcaaagacgatttcctttgttggtttttcttttattattttaacagcttccacttttggcatatcatcataaatctggcatctcagaattcatagcaacactctgaatgatgatataaatttctctatgtatacttccacagagaaaattaaatatcaaatacctaacaagttagtggtctctactgaattatttctgttcattatttggatcttctatgaataaaaaatgaccacagactccaaagatacaggggattctttggttaaaagaagttttgagattgtatatagtaaatattttagccaaattctctttaactttcctataactgtagtcttgaacattaatatttaataatcagatggtcatggttttttgtttgtttgtttgttttattggatattttatttatttacatttcaaatgttattccctttcccgatcccactcccctgtttctatgagggtgttgccccacccacccacccactcccacctccctgccctagcattcccctacactggggcattgagccttcactgaaccaagggcctgtcctcccattgaagcccaacaaggccatcctctgctacatacagggctggagccatgggtccctccatgtgcactccttggctggtggtttagaccctgggagctctgattgcttgatattgttgttcttcctatggagttgcaaaccccttcagctccttcagacctttctctaactcctccattgggaaccctgtgctcagtccagtggttggttgtgtattaataacagattatcattattagttacatttgtttgtttattgtatgtgttgttgtacaagtgccatatccggtatctggagatgagagaacagctgtgggcatcagttctctccttccagcttgtgggttctggggatcaaattcaggttgccaaatctcagaggcaaccccttcaccttctgagccatcttactggccccgggtcatcattcttacataaagacataaaccaaatttattgaagaatccaggagtgccaatttaaactaggtagttgtttaatagtaacaatgaaaaatactgtctattaaacatttatgttagggaaacatgtagtcagaaatttttaattaatattccttcttttaattctttgtaccattagctttctttgatgaatgaaaaattctctctgcttaccactaagccttcgtacatggctacctccagtgagctgcgcactcagctctgtgtcactggggtgacacagggatgcttttatatcaaaaaatgggtagcattttatctcctgttgtttgtttcctataaatgtttttctcttgaaatggacatatttatatctttaattcttatgaaatgtttagtaattgtatagtctttcctacagttgattccactcttatttttacctagagactagcaaactctgtactgatctcttagtttgcatgatgctgtaaaacaagaattcgtgaattgtaaactttaagagcctagattctgtataagagaggccttgaaacaaaatttccggccttgattatctaaagaatctgattatctgagctgcagcaccagctactcctgttactatcatactcccctttcctggacaaaccagatctctttcaaacctcagggattcttataagatttggcaacattttgcactttttgtgatttcataaattttctctgttctttaacttgtacttcatctctaaagactgaagggtcctcatctttttttggtacataaaacagtaagtaacatcaccattccaacctctggccacattgattgtcctgctgctgctgctgtcctgtcttcaatcagagcatggtaccctatggtttcgttcaaggatggattgacttctctttttcattctatctgtttaaaggtctgtttgggggcctctttggctatacaaagatgtcagatttgtggtttcataaagtaggttacagctattcctggatttcttttctaagcccacggctctttaaaaatagggttacaatagtttctgctgatctttagatttttcttttcatcactgacttatctttgaatttattttgctcctgtgagctttcttcttaaaaagctgctatcttttattttagtgaatctcttgatttttttttaggtgtgttaacttgactcagtggtaagcctgcagaagtaggccagagttttgtttgttcttactttgcatcctttcggttactgtcgctttgtcctgggtagggtggattgtatactgactgcatagaactttaacaaccagtccagtactgcttttgttttgtttgagataggatattggtatgtagcccaagatagcctgaaattaaagtttcatatattcattcattcaatcttcctactctccccctctccctcttcctctccccttccacccctgctctcctcctttccttctttctctctccctccctcttccctcttctctcttttttttaaccaccatgtggttgctgggatttgaactcgggaccttcggaagagcagtcggtgctcttaaccactgagccatctctccagctaccctcttctctttattttgaaaaattatcttattgtagcctaggctagcccagaactcatagtttagccacagatggttttgaacttgtagcaatcctcctgcctcagccttttgaatgctaagattacagctgtgaaccatcatgcttgactttcttcagcagtgcctaaggatgagattggctagcatggtcttaaaccagtatagaaacattgacttttataagtagaagatgcctttagaataaaccactgtaactccagtcagtctcagtttataggtgaggatctggtatgtgtttaatgtgactaaaatgcagaccttcactgacaagtcatgttatgctctttggctatgtggcgatagcaacaagccagatagctggatctaacgttacaaagtctaggcatcagtgtagggattgtgactcactctccaaagctcactcactgtaatacaccataccacctaaatccctctgttcaacttaggttgaatgtgactctgagtccatgtccccagagaaaattagctatccattttagatgtcagttatttatgaacagaagaaattagcacagatagcacacaaggattatctcaactcatggtgatttggggaggggaggatggaggatgcttgttttcatgcagtgtgctatggctcccaatgctttgctcctttttgcttgttttagaagcatgtgtgtcggtggagtgtgcgttacttttctccatcatctcattatttactaccacacttttcactgtccatggtaggctagaaaccttaaaagtactcacagaaagaaaattatagcatgttccaagtaatggtgagtgcttagtgtgcttgcactttgggaattaagcacttcacttcttgcctgttcccaatcattacagtcttaatgcataaggttattacttatggctggcataaagagcctcattttcataaaaggcagctcaaatgaggttgtgttggcacactacaccctaagtgatgttattgtgtgtacctccaacccccagcccatttgtgtgtgtgtgtgtgtgttcctgacaattgaacttaggacttgcacttgctcagaaagcactctaccacataggtatattccaggccctcttttttattttattttattttattttattttattttattttattttattttttgtttggagacagcttttcaggacattgtccaggctggccttggacttggaatcctcctgctatagccatctaagtagccacgattacaaagtgccaccaacctagttcactgtatgcttcctttcaaagaattacttattttctttctctctttataaacattcagaatccattatgattttataactccactgttaggtggagctagtatatatgaatggtatattttatcagctaccaaaaatcagtgaggctcaggtttataatcagaaagactttggctagagagatggctcagttgttaaagtctagactcaaaccagaaagacttcagtgaaaaaaaaattacagattattagatgtatttactgatgaaaaagtttataatcagaaatactttactgagaaaaatcataaatgattaggtttagttactgatgaaagtgtaactgctttgcctagagttgcatgttgcagcatgaattgcttaaaagacagaatccaaagtctagctctccagctcttttctggtgttccttccataattgctattttaatttggacataccaaggccaccttatctattagcacaatgaaactgtcccaacttgctaattagacacaacactgtatttttgtttgctttttaaatgcccagtgtgcccaagcatttgattagagaagaaacgccagctgtatctacttagtaaccttgtaactccactccatatagcttagtgatcctgttacagattttgtatgtagacacatatactgttggccctaagtactattagttttctggattccccattttcatagtctagaaacattcagggtcagagatgagtaaggggaaataaattctgtctttcacattacctcccaactagccctttcaaagttttcaaaagaaaaattgaaattactctactccgaactgagaagacagagtttatttgttgggcatattgttgggcatctcttacctggttcccacatctgaagttggggagagctaggcatatagatctcttcctgggcccagcgcaagcattcataacaggaagttgtgagtatttccagttctgccaagttgaatgtatgttggacagaagagcttagtcagtaagcagcctcaatcccaatccaaaggtccaaagtgtgaagtgtatccagatttacttgttgagggcttgtctgattctataagtaggaaatttcatacttgactttatgtaatatcttggagtcaaaaaataagcacattgaaaacattgtataaagttgtcttccatgatatggatatatgaaatgtaaatgaattttgtatttgaatttgaatccaaatcccaggagattattattacacacagctcgcttgctctctctctctctccgtatgtatgtgtgtgtgtgtgctctctctctctctctctctctctctcatgtacttacttatttcataatcgaatttctaaaatgttagacactccttggtcacaagcatttcagttcagggacactccacttgtagcaaggaaactgatgagctgttccgtgacaagagagccctgtatattgtggtaaggaatgggatgggaaggagttgtctacttatagggtctgataaatccccttgcggcatgaaattttacaacaaaacagtgaaaacctgaaagaactagtgccatcaagagccagggtagaagactgaaggtaccgagcttagaaaacaggtgaaatggccctctgctgacaaaggttagggctgttattgcaactgaaagattaagatgagagagacatgaaattggcatcctgatatagtttctgatggaggttggtgccttagtggctggaccactatagtagtcaagagcagaatttttgcacagcaacatccacaacctttcaaacctgtgttccagcaacctccaatgcttttctggctgaagagtgcctcattcatgtaaccaggtcacaaagaagtagtgactttatgtttcctggttgtcatcgatccaccagttccacaaagccctgtttctaccaacctcttctttaaactcattttgaagggagctgaatgtgggggctagatagaaaatcagctaataagcagtccttactctgcatttagaatctttcccttccctcatcatgacccccagtcagcttttccccttttgggtgcctttggtaaaaagcatgttttcttcaaagccataggtgttcttgtctttgtcccagaacttccagtttctttcgtttcagacttaaaggcatgcccgtatttgaggtccccacaacataatctcaacaagcctggattctggcccctaaccaaagcctgagaccaaatgtgttttagaattcatcattttgaagttttagaatggaaatatggcactctacatagcactctgtaatcaaggcatttttctatagcctagactatgaatattcatattaagtgggttaaacaaagaacataaatagtctcatatcaattccatgatccctctgaatgaatttgtcacaaacttagaaggggtttagttttccaactagggattttagaattatgagcctgtactcttgagcatacatattaaaaacacactacttagaatttctcagttacctcttaaactatcataagtagacaattaaagtaaaatcctagcttcttgcttgtctgcccattaatgtggcttctgtctcgcctccctgtccatggaggatatcacaagtgaaattgatggtatggaagggcagatactggtacagcacaggatctctatcccagaacagctataccatctgtgataaacagatggagatgccatgggaaggcagcaggaacccacagcagcttctgttcagagaaataaggcactcttaagaatttcctatgatttgaccatgaactgcggcgtcacagatacctgatgcacagcctgtgctcactgaggccattcgcaagcaagcctgaaaaaaatgaaatattctttttaagacaaaacttgaagctaaccttaggacatgaagtgctacacatactggacacaaagcttccagcacacattgatggggttggctctcataacccttttaaacagtttcttccccaacacagaatgttagaaccaaaatgatgatgaattcatgtgctatgtctataaatctgtggtttgatacaacaaaaaggaaaataaaatgcaagcaaaaaaatgggtttgatgtgttcaaggaaaccttttctttgttgtgtgttttgtttggggttctttgggtaccttatagcataggctggcctggaacttaccatccccagcctcaacctcctgagtgctggaattattataggtctgcactaagtcttttctttaaattttgtttgtttgttttctttctcttaccatgaaaatgtgttaatattctatctgtgaacatcttaagtagatgatgttgtcaatggtcttaaaattctttgaacggtacttttgaaagctttcatttattttctttcttcactgctgtctatattctagaaaatgaagaagtcaaggagacgaccttacgagagcttaaaatgcttcgcactctcaagcaggaaaacattgtggagctgaaggaagcttttcgtcggagaggaaaattatacctggtgtttgaatatgttgagaaggtaagtcctgaatgaatagccagcatgcagcctcacctgtttttttctgttgtttctgacctgagtgaagagtgtagtattacttagtatgccctatcggtgtacccataatctgagggtattaaatatgaaattatcttccgtagtcattagatgtcctgaaatagatttagggatttgatacaagttcgatgcattcagatgctcttgttaaacaacttctgaagtcttagactctataaacaacaagtggttttccgattagatttacttcaattaaacatgaacaatgtctctgtgggagaaataggtgaatgggcagtatgataaaggacggcagggtacacatctgtcctggcaagcaggagctagatccttcagtcagacctaggatgctgaatgaagaaagcagacgcagtcttttaagaacggccagcattctagctttcgtcggggaattgtaaggcaaggcctgaagcggctgttaagaatactagaaagcacttttaaaaggataactcattaatgaacattttaatattgtgacctaggggcaaaaggttaactgcctcagaattccttaaagcacagctgactgtgagcagctgattttagctgcttacattaggagagactgcaatcagaggagcctgttgaagggtttgttgctatgtgaataggggacttctgaagtgtgcgtgcacagcacagattaagccggagaggcttctgtttgctgtgcatcagtcccctggtgagtcttaggacatacggggcaagaaagcaatggtttgaagaacgctggctggtcatgtgactttgatttcattcaccatttacccagtatcttttaaatgaacagcacaaaataatgcctactaacacaatttaaaatatataggactcttattttatttctaatatttctttattaaaaataattttatataacatgttctgatcgtgagctttttctccctcaacccctcccagctcctcccctcctcctcatccacccaactccatgccctctttccctctctttaagaaacaaacgggcgagcactaacaagaacaacagaagtttaaaaagaaggaatgtacacatatacacacatacacaaacccaagacccataaaaatataaaattagaaaccataatttacaaccaaaagaccagtaagaaaaaaaaaatggctaaacaaagcaatactgagtaaaaagtctacaaaaataccattgagttcattggtgttggcaatctactgctgggcctggggcctacccttaaatgtggttaatatacccaaaaaaggctctgtcattgtaaaccagttattatatgctacttctctaaaatctgtttctctgtgtttgttttggtatttccctatcaaaataaaaccttaaaaaatggttgtttaagaaaaatattgctgtactaaggttacggaaagaaatcagattatgtttattttctagttagcacaaatatgtgtgcagttttcagctctccctggcgatgaaatttgtcacatctagtatttcactttgtcttttttatttctgttgtgttcgtggtggtggtttgtaataaataacactttagtatatcaactagagatatctcctctgtatattcatgttctctgggagaagcaatttgacatgcctgagttctctctgctcacaaagggcgatgctgcagccagtattataattttctgacaccgaggcctgggctgctttctctgcccctgtgattcttgaatggaagttaaccatcacacatgcccaccagtggcagtgcctggcaatctacagtgagtcccaggagtataaggagaaagatgctcaaacaaaattgggagttgttaactgagacccacaatggcagtgccttaaacaaaataggaatttctatcttcttcacaaacatagacaacaggagctagcacaggactgaaaggcaactctctgctcctttgtctgtagtgtcaacccaagctgtcacatccagttagctagtatatagtgacatggtcacacttggctgcaagacagaaaggaaatgtacccgtcattctgagtatttaaatctgtggttgaaaattgtattccctatagaataatgaaaggtggctggagggtaatagtctctctgccacttaggaaccttgagtagaacatgagctgagagcatcatcttttctggaccattcagctctctgtgctcccttgttcttggcatctcctgcatatctgttcattgaaaaagtgcaattagcatagcgattttttaaagctgaaaacattctttcaacattttattttaactgaaaccataaatatacatcgaatcctctctagagattggttgaggtgttttgcatattgatcttctgattaacgctcttattggcctttgttgcatatgacatgcccataaatgcatctttaaattggagcaaaggctccaaaacctggagagcagtctccatgcaaaacctgtcagtatttatgcttatcagtgccagcacctgttccttaccagtgctgtatgtatgcctctcaccgttgacatgcattttatgcctctcttttgttgtgtatttccaaactattaaacacgatttacatgtgcacagcaactctctttttaaagaaaccttatttcagtggttgataatgatacttaattatattgattgttgggagccttcacaacttctatggtgggttttatctagtagtgtttctcatattagacaaagttgagcagcgtaaaaaaatacttgtttggagctagagttgtagctcagtggtagaatgcttccctagcgatgcaaaactaaaacaacaaataacagcaagcccaataaggttaacataaatggattgcgcctcagttctttaataatgaaaatgaaacagcacagaatggctaggacagcctgcttctctgcacccagtgaggacagcagccatggttcagatggcatatgtgcaatagaaggactctgtatattcttcagttaacttgtagatttctttaaaaacaaacaaacaaacaagcaagcaaaaaaacatgtatcctagtttcattcatgttgctgtgacaacatatcctcacaaaaagcaacttagaggacaaaggggtttattttcccttgcaagtgtaggttatactctgtcagtgcagggaaatcacggagcaaagagcttgaagcaaactagtcttaccatatccacactcaggagcagagagaaatgaacgcatgcatagcaagtgctcagctagctctctgccctttttgtaccatttagagccccaaacccaggactaaggccacacattcaagctaggtcttttttccacatcaatgaaagcaatcatgacaatcccccacagacctgctcacaggccaaccaggtctaggcaatccttcattgaaactcctttccctttattatgtcaacttgacaattaaaacttaactattacaacatgtacaacaaaatttcataaacataattctttctgccatttcatcaaatgcatctttaactgctgttttgttctctctctctctctctttttaatggaatttcaagggtcagtaggcttaaagattccattaccttgattcatgttaatgttccagcaatttggccattgttgctgtgcaccattggtgtaaatggcagtagtgaaaaaggcaaaaagctgagcatttgcttcgggtggtgtgacttcttgaggctgtgagcagcatctgagcctctgtttatccccaggttatacttaagatccgtctctttgtgggcaccttcaaacaagctaaggctgtactgtgagccttattgattgggctttgcaaaaaagatggagaatctttggttaacttggtaatgcaatggagaccgagtaagggactaacctagcatttcttttaaatatatatttatttttatatatgtgagtgatctgtcttcatgctcgccagaagacagaattggatcccattgcagatgattgtgagccacatgtaggtgttgggtattgaactcaggacctctggaagagcagctggtaactgctgagccaactctccatcctcttaacttagttagcatttctgttaagtttatagctgggtctcactatgtaatgtcttctaagttctggaatgacagacatgcatcatggtacctgacaagagaaaattttgcatgaactttgtacaaaaatggtctctgactccagatggactgttttgaattgtttagggtttgtgtatttctttaacaatattttctttaatttgtgtgtgtgtgtgtgtgtgtgtgtgtgtctgctgctccagtgcacatatggcagtcaaaggacaaatttgttgagttagttatcaccttccacctttacatgagtttcaggatcacactcctgttgggaggtttatgtcattaagcagcaagtgtctttacccgctgagctatctcactggccctcaatattttctagcctgttttaatttttatagaaaatgtaaaaattaaccgtagagagatcccccttcttcccccctcctcttcctttccttcctttccccctccctctccaccctctcagtaaggcagcagtaaggagtagtaacaatataatttctcataaagtaaaatttttgtttaatgcactatcctgatctaccataagctaagttatagattaaattcagaccatagaaacaatgcatgttgtatatcagctgaatccttatctaaggtgctaatgattagtagttcataagtgatggtcttgcctactcttaaagatgaatggctttgcatttgcttttagaatatgcttgaattgctggaagaaatgccaaatggagttccacctgaaaaagtcaagagctatatctaccaactaatcaaagctatccactggtgccacaagaacgacatcgtccacagaggtgagtatagacttttgaaatggaaaaaaaaactaaatcagttggctaaaattaaagatctactgttttaagaatatctctatctaagttaatcatattttgaaagtaaatagatataaaaagccctttgctcttcaggtctcctataaccaacaaagggtaccatatttggctattgtgttgatatctctattagtatgaccaagtattctataaactgtagcaataactaatgagttagcagatacaaattttgaagcttattctggatggaattgagtggcaaaaggacaatttccataacctttggatcttatgaatagactagggaatgtgaaccacctcaaaaccaggctttgtaatggccttaaagtctagtatatatctatctccacttcctgagttttgctccctgttggcaaaaagtagccctttcctgtagtttgaagggataatcagccttttatgggccatgactatacttctctaaactatattactttttcttgagtatcacgaagtcaatggtttcagcaataaggaaaattatttgctctgtgttattttgactctgatatttgctttctaataatcttacactgtgaagttttacagcaatggggcacaatttgatacaataataaagctaaaatttttatcagaaaatattgataatatttttgtctaaaagaagtagatatgtcaatattatctttgtactatgctgttgtacagctaatgctgttgattgttattattattattactactattattattattatactagattcatctgtacaaatgtgcaaggataatcacctttaaactagtcttacttttcagaatagctgaaaggtattatgaagattttgaacacttactatttgactttcatagttaccatgttatcaagattgaaaatgtcataaataaatccccaggttaactagctatctagtggcttaggtgctagctctaaaaatagcccatgttacactttagcatgttaatgaggagttgtgttgggtgtgtttccattatgaggctgtgttttgtttaaatgtatagctgattaatgttgggaaaataggattctagtctggggctgcaaatggtagagtccttgactagcatgtgtaagacctttgattcagtctacctgattagaaaacataattctgtgacttcgagatctgtagattccactgtgctctcttcactttcccctccaccatagaatagagagactaagtacggaactcagaaaataaagttggagttgttctctgggcatttgggagctagaggccggaggattgggaattcagggccacctttgacgacataagagttgaaggcagtttcacatacatgagaccctagctcaacaaatacaattaaaaggttcctctcagtggaatagctcaactttattttttgcaaatttctgctcctcagttcctatcacatctttccatgatctactggaaaataatggaaatcttaacttgattcattagcataacttcagcattaaatgttgttttagttgtaaactacatggaaaagctaagtaggtatgtgaatataggaattatacagagcaacttttactttcctgttaaaaaataaaatatttatattattctgttcaactactgatgtgtgtattttcaaagatagcatgtagatataaaaatttgaggtttagtctccaaaattttgcattattaatgttttatgtagcaaaagtaattccttgaaatatattgatctaaatttaatcatttaaaaattccttaccgagtgtcctctatgtgttgtaggttctagccttagcagaggaagggaaagagcaggatttgggggggggccttagggctcttcttggtaagaagttaattgaaagttttatgtagcagcctagcatgtcttgctcttctgtacactgcacagttttctaggcagcctactcagatgagtttacccagaaaccattgcagtgctacaagtgtcaatcagcagaccacagaacattcttacttactattttttaatcttggtattctagatataaagcctgaaaatctcttaatcagccacaatgatgtcctgaaactatgtgactttggtgagttaaaaagaaattgagagtattaatttaataaaaccattaatgggtatcttttaaaggtatattaaaaccaatcttgttttgatttaaattagcagaaaagcattcagttgggtcatatgctgccaggtggtggctggggatggctttgcttcctctttgttgtatggtgtattatctacaattttaacaaattattcaggtacttgtctaacagaaaagagtttgaagcaaataattgcttgccgtataagagtaatgtaccaaattacctcagaattggagcttcctgggtttagtaggataaaatattttaaatattgacagaaaatgttctacatttagtcataactactagatctatgctcgtatatattcacagttatgtatggtatgcatacagtagttacatctataaggtcaaagccatttttaaagtacttctattcttccatttgtttctgttaaataataaatgaaaatggtaatttgtgtataatgctcttatttcttgaatatatagaaaaacttataaaattatactcctagtgaaaacctgtattgtttctcatgtaggtaattctattttaaatactgttaaatattttaaatagtttagaaaagttctgaaatcttgagttagagtgtttaggtcatggcttgtcaaaataggtcagaaaggagcatttatgaaatgaagcagataactagaaaactataatcaaattttgagttatctttagtacttaacagttgatttaattatttaaattattttattttaaaataggagctcgtgtatcccagattggcctctaagtcactatgtagctaaggatgtcttgaaacttctgatcctcctgcctccacttcttgagtgttggggttatgatcatgtgctaccacaccccgtttatataatgttagaggtagaacctacagctacctgtgtactaggcagagaccaccaactgggtgtattcccaggcatcaatatgacaactctttagaatattattggaaactggagagagatggctcggtgcttaaaagtacttgttgctcttgaaaaagacctgggttcagttcccagtacccacacaacagctcagaactgcctgtaactccatttccaggggatctgacttctgttttttggcccccactagtttccaggaatcttttctacttatgaattcctctctgtaattgtgatatgtcccaatgtttcagtagactctgtgtccctagaactctatttactatgcctccatgattctctgttaagatccaaggtgactaaagagtataaaacagataaaatacaaaggaaatgcctgcaaaatgattaatattaagaggaaaagagtactgtttctccagaactctttctttctttggtcaggaagttcctcctggcagcactacatgtggtgttctgtgtcctgtgggtcctatcaaggacttcctaattaattgccttccctggcagagaggcaaactcctttgtctgacttgaagagccctattcagaagttattcaacaaatgcttcaataagaagacttgattaactgaagttaggggctttgtctttttgctgttgtttttttaaattgtttcactttaagaaacacaaatttgggctggagagatggctcagccattaaagactcggctcacaaccaaagaagacaaaaaacgctaatttctcttctcacaggaaccttcatttttactccagttttaatgttttagttctatataaccctgatggtgaacctctatgacagttgatgagttagatgggtaattaatttatcttactgtttcattttgtagtcctaaacctttggaaagagtgagagacaaaaataatgctagtgtctgtaagataattaagatgcccctaagttgcttctacaacagtaagggctaagaataattttcagcccacttgtttctatcagtgccaactgttaattgtttacataatgactggaactgctcagcaacagtaaatacacaaatacaatgtaggtctcacttagcagaacgaatgcaggtgtgactgacttctagcctgagtgggcacttaattttactcctaaaaagagccactttgaaaatatggtctgaatgcttccaaaaacacagggtgaatttgaaaacatggatgggttcatagcaaattcatcctgtgctttaacatatgaacacaagtaactatttcaaataaagttgttcctaataaacagtcctttcaatattagtcattatgttcttttggtatctttttaaatatagctataagtaaaatatttggccaacaggaacttgctattctttcaggttttgctcgcaatctctcagagggcaataatgctaattatacagagtatgtggctacaaggtggtaccgatccccagaactgctacttgggtgagttatctttctcaaatagagtgacctatacacatttattgtttgtatatatatattcacttatggaaaataaggactctggttacttacatatattagttgcatatccactataaaagaaaaaagacacccaagaacttgatgctatgaaacaagcttcatttcatttatcatagttctgagtggctataacttgagttcagtggagtggcctttcttggagtcactgatggtagctagtgggccagaagattgactgggagttaattgatggagtgtacttcagctggtgtctgatagattccttttgtttttctcttcatgtatgtgtggttttgcagggagtggggagctgtgtgtatgtgcatatagaagccagatcatcattcctagactacaatccatcagttaggctaggtgccctggacagtcaaccccggggagtctgttctctctgcctctccagtgctgggattgcaagtgggtgccaccatgcctgacatttttatgtggattctagggactgaaagaatttgggtccttaatttttgtaagtcatgcattgccaccaatggatccattctcttagcccctggcagaccgtcatgaatccatcaggacttacctttagtaagctagtccgtttccaaaactgataggagaattctgtgcatcaggatgtttagccctaaaacaaaggtgctttccaagttcctattcctatggcatttgtcttattgaccacagcatgtctcatgaccaaagcataattcaaagtatggagaaaaaaatcttacctttttttttttctgttttggttttttcgagacaaggtttctctttatagccttgactgtcctggaactcactctgtagaccaggctggcctcaaactcagaaatccacctgcctctgcctcccaagtgctgggattaaaggtgtgcaccaccactgcccggcaagatcttacctcttgataaagaaaagtattaaagatgaattacaaggggacaatttgacattctggcttatctgttgctacattgaatacatacttaagtttctgttcagccactttgctagacaccgggtaaatactgaaccaattatcaactttcttctgaacaatgtaaatcttgttggatgataaatggctattcctagtaagcctacattgctgatttttttcagcaacatctatctccacactcaccccctttgcttacctcaccactttcagagccctgtcactcatctgttaatactagaaactcttgcaataatgttctttttttaatgcagcccaacaaggagcctgaagtctgcatctccatcacatgctcccattaataactttctacctattctaggttttgctcatttctacctatcctagtattttctcatgttttttcagtcgtaattccttccttggaacccaataacagagaaagaaaacatactcaaataaacaaataaaagtagtcatgttgataaataatgaaaagtacacaaattgttggttttgccacatttcgcttatgtaacatgcacatgtatctgggaaagtaggataccctttatgtaatagcaatgtaaatttctgtagttcttataccctaaggactacaggtattacccattgagagtttattggatgttaagtattcattttctaatgtttgccagccaccatctgatgtaattcttgatttattgataatctagagtcaataagaattattgatgttttaaaaatctttattctcttaaatcaaaaatttgctttatcctgcaaagtaaattatgattagtcactatcatttaaatggatcaagttttagatttctgcattcatttgtgtgcgtgtgtgtgtgtgtgtgtgtgcacccacatacatgagtgcatatggagaggtcagaagttgatactgtgtttcttcctctattgttctccttatttctttgaggtggggtcttttgctgaagctggagctcatttggttggctagactgactggccagtgagtcctccaggatccttttgtccctgcttcccagtgctggcattagaagtacccactgcaagacccaaatttgtatgtgggtgctggggggcccaactcatgttctcatgcttacgtagcaaacactttactcactgaaccatctccccagcttcttgttctaatttctgatcttggtcttagggttgttattctttatttttcatctgcatgtctcctgagtacctttgtagattcattgcactgtattatatttctctgagggatttgaaatttgaatttactggacactgtttgccaatgaagaaatgagtagcgagtaaatcattcttagaactgtaaccaagagcccaagtatggtagaaggactctttaaaatgtgtttttgtttttgttttgtttgcttttgagatggttttactatgtagaagccctggctgtcctagaactcactttgtagaccaggctggcctctaactcacagagattgcatgtttctgactctcaagtgttgggattaaaggtatatgccaccccccaacccctggctaaaatatgtttttttttcctataagatagtcccatggaggatattgtgagagtagctttattatgaatctttagagaacatttattctctaatggttcccattagaaaactgaggttttgaaaaactgaggttatgtttagatatgtgtgacagttgcccaaaatagaactcagcacagccaacttgagctaattgtcatggtctactttaagtaccatattatgtgtgtaaaaagtttactgaaattgattgatatttggttttatattaaaagtctacatgtttatacgttccaaggactttgcccttgatattcaaaaatagtttcagctgcataaaatattcaaattagatgataggattaaaatagcttgtcatgaatgtgtgaggtttttccataggtttctcaatccagtaccataggacaaagttttctttatctcaaatatttttgaaattagtatgcttcattgctcagaaagctaccaaagatgtctaaacgagctttcactgtggttttagattttttttttgtgagaaggaaatgagataaatgaaatactgatttattgttgcagtaacttattaacctaaatatattctgtatgctagcagtgcttagtttaaaatttttattatcataatggcattctagaatttcatttgagattatttttatatgttttatttcagatttattttaaggcttagattatttatttttgaaactgtatatatagtttttgtttaaaaactgtcataaataattttattctaggctttaggtactgagctataaggctctttggggagccttagatttttcatttatggcctccatttgtagcaaattctttgtagcagactctctaaaactctctactgattcaggtcctggaagagaactacaaggtcctaaatatattaaaacatggtttgagagcaatagctatcagaatgcctcatataatgtacagttataattaactccactgttggaaattatgatactaaacaaccagaagttaagtaacgttcagtatttgttcaacgtacacaaagcaatggcacgttctaccagactaaagctcaaaactggatataaattttgacacttagcaagctaaaaggataattatttgaaaatacacttcctgggaacattccattccataagtgaggtgctcttatccaatatgtatactacattagggtttattaaaaccattcatgttctagatatacactgatttctttatgagtgtgggttatggacttgtgagttgaatgtttgcttagatggctctaattctttatttgcagtcttattttttctttaagtgcattcatcctttacatcatgaattgctccaaaataagctagtaattgttaaacccttttgtgtctttagttgctaagaccatttcttcttttgcttttcagagccccctatggaaagtcagtggacatgtggtcagtgggctgtattcttggagagcttagtgatggccagcccttatttcctggagaaagtgaaattgaccaactctttactattcagaaggtgctaggaccacttccatctgagcaaatgaagctcttctacagtaaccctcgtttccatgggctccgggtaagaggctttgctaaaatcccaaatggaatcaatctagcagcatttcacttgctgttcattgcacaatggaatcctaagctatgcattgcacattcctcccttcccatcacagcggttttaatcctcactatactgactattatacagtatttgtgaaattaaaaaaaaaatagtcacaattctcaagtaggagttgctaatgtcttcttttctaatatgtaaagtttgagttttcaaaatcattttatcatgtacatcattatattccaaactttcattttacactctttattcaaactattaagcatctccaaagtatagaaatgtgcgagtagctgctgtttacttaggaaacttggtttgtgctggcttgaaggcagccatgaattcttgtattctgcagctttggagaggctgttgcacagatatttcttgtgcattgacagtgaaacattcaatctttgtagaagtcagaagccttgttacctttgagaatataatgaaaaacatttttgaggtcataaactttgcttaaatgaggagtgtgtaagtgccagaggtatgtcattggaatgacgactgatgtatagaatcctccttatttctgtctacccacaaaagcagtttttaaagttttgagccaacacatcaatttgtagtcattgtagaaactatcaaataatttcatcatcccatcttttattttcttttccaatgcaagtatatgattcttaaactatgatcttatcttttaaaatctatttttattctttaaaaatgtcggatattcaatatactgtatttcaatcatgtccaaccaccattacctctctccaactccctctagggtcccctcacctcaccttcctctaagctttctgtcctccattatttttatccctgttgttattaaaaatccagggtctagtaagtgctccccatgtatgtctgagtgacctaccagcagctatgtccgcaaatgaaaatgacttttctttcctcagcaaccataaactaacatggtatgagaaattcatggtgttgtcttgccatttgcaaagccctttggttttgatctttgactttctggatgtcagttagcttttgtttgagagcactactgcttacatgcacatgcgtaacacagtcccagctcctgcggagcccagcccacttgaaagaaatgaacccactgagacacacacagttcttcatacccctctctcctttatgctctcacgtcctcttccaaatgtgcctaagttgcttcagatttgtttttccttttatctttgcttctattagccaaaacaaaaaacaaaaaaaaccaaaaaaaaacaaaaccaaaccaaaaaacaacaacaaaaaacaaccattgattgggttataaatagcatgtaattcaacaagttaatttgacagttatggaacatttctcatcctagatgctgaaaatgtggcaacaaatagaacttgctcttggtctatcagaaagacaaatatattcacaagtaaaataaagatagtcctaattactgaatttctgtttcactgagaatccttccctaccccctgccatcacctgtgaggccctgcttggctgggcccttttgttacctgaccttgtctcatagctgtctccatacacctgccttcagagtctcaccacacttgcttattctttgacctctataggcatcccaaggttttcatactttctgaccttaggactaaggtttcttctcctgggagcattcttaccttgcatgatctctccttctactgtaatatcaacccaaagacaatctcctctcatacagctccttcttacccaccccaacttttttttctatgcttttagttagcatataaaataattttcattacattcatacatgcatatcattgtatctaacttttattcacagtcctcattgccctcattcctccttccctctcttgccagtccctttgacatccccctaaaaatagtcagtctctctctctctctctctctctctctctctctctctctcacacacacacacacacacacacacactcacacatctagatactgcatctgagataaagcatgtgatatgtcctttctttgttcactactttggctcaactcatctcccgctctatccagacggcttccttctgcctcagagtgaaatctgcattgcatgtatgagaggaaagcttgtactttctttcttgagtgtggcttattttgtttcacatggttatcttcagctcatccatttctctccagctgacgtggttcctttctcttgatgactgaatgagattccattgtgcttttatgtcaccttctctttatctgttcatctttgttaggcatccaggctggatccatatcttagctattgtgaatactgctgcattaagtatggatgttcaaataagtctgtggtatgccattgtcaattccttttgggcatatacatgttttttttttttaagttaggagtttgccttctctctctctctctctctctctctttctttctttgtttttttgtttgtttgtttttttgttttttgttttttggttttttatttgtttttcaagacagggtttctctatatagccctggctgttctggaacttactctatagaccaggatggcctcaaactcagaaatctgcctgcctctgcctcccaagtgatgggatcaaaggtgtgcaccaccactgcccagctggtcatttctttttatttattttttttatatttttaaaaattataatgtgattgcatggtttaccccttcccattcttccttccagatcctcccatgtaggtgtccttctgagctttctctctctcttctcactctctcccctccctctttctctctttgcttttcaagcagggtttctctgtgtgtcctggaactcactctgtagagcaggctggccttgaactcagagacctgcctgcctctgcctcccaagtgccgagattaaaggtgtacaccaccactgctcagtcaataaatattccatctatgacctgctcactctatatactcttacttgtatgtattatgttttctgggctggctgttaggtgttagataaccaattatgtgtgcttagctggaaaaatctatttctcctactctcagcattccttagttacctatagttccttgtgtagggttgaggtgataaaagctttacatgtccaatttagcatgtctgttggtgtcctccttattcaccttatgtttggacagtcatgttggtgagggtttgtgtgtgtagcttctgacattcctaagagacacaatctcacagcaaattccatgtcctggtccattttgtttattgcaacttttcctaaaagtttttagctttcaggattaactcttcaataaaatgttcttcctgaggaaagaaaagaaggatatgtagtacaataatataaaacagtgattcttagccaccctattgctgtggccctttaatacagttccttatgttgtggtgacctccattcagaaatttactgttgttgctatttcataattgaaattgtgttactgttaatgaatcacaatgttaatatccgatatggatacctgacatatgatccctttaaaagggtcactcaatccccaagggggttgtgagccacaggttgagacactgatatacaaagtcttaattaaaattgattggtggagggtcttttatcatggtatgacaggtgtcactccctctccgctgataggtaatgcttcagtagcatcaaaaggaacttctgcagctcccttgggagaggtactttgttttggaaagagtgtgcatttggatcacaggcttagatgcaaatagtacttctactccttaattatgtagctttccttgaaccagttatttgaactttctgatcattttccttatctctttaatggaaagataataatacttaaaatgccttgcacagcatcacatcactgtttttctttcaaagttgagttcaagatccccataggttcttctgtggccacagagtctggctgagtcctcatacccaagcccttcgtgcctcatcctcttgagtgccgccttgccaggctttagcttctcatttgtagatgcaccgttcatcaattccttttcaaccagacaacaaatttctcaagtttgtttcttgccttacccaatataacgtggggatggtaacacaaatatttattaatatcttgtttggtgttactacataattagtccttcggtccctttattcggcatatttaaggatttccatactttgaaatgtttctatgttagcctaaaagaaatatgcattgcaagcaaccagcactgaacatttgggaggtggatgagtgaatgtgttctgccggtatcttactcagtgcttcagtacactcaagagcctgtcaaatagactgctagaaggatacaacatcaaaataagcttcaacccctctttacttaaaaatgaatttgttggtctaggtgcctatatttgcccttggttacaacttcaagacttgataaacagatcattagaagagtatattaaaaaaaacaataatagaacaaaggcctaaatttagtatttcaaatagtctttcaggttctggctccttgctgcctttttcctttcttatgtctcaatttcaggagtaagttacaaattcttatggaaaagccaagacatttttatataatataatatcatggcccttctgttagttcttcagtctggcagtatttgtctgtaaattatttcagaacaactttgtgtaagcatacatgattcaagttatatagactcagacttttattcattttacaagcttcagtgttctctatctaactttaggtatcattcttcccctgtatgttttcccactatttaatacttagtcagtcctattaatcgataacctaagatatatagacaccaaaagttatgtgtaaatagtaatttaatttggattgacactagggcaatgatttctgtccagatgttgtcttgtgtaactttcacaaacatatgtacacatatccttcctcaaatgctaacattcatgctgtgttgttcttacagttcccagctgttaaccatcctcagtcattagagagaagataccttggaattttaaatagtgttttacttgacctaatgaaggtaagaaaagtatgcttgtaaaaaaaaaaaaaaagagtccgttggtttatggatgctcctctgcagacttcttagcatgcttttatgaattaaatgtcttcttagtacatgattaatggggagtatgtcatgttaaaaggcatgtaatttgtttataattgcaacaggaatctggtgttgtctcagaccatctagagaggagcatgtaatccctaaattactttcctaaaatgggcagaataatgaatatctgttggtactcaagaactactcgggcataggttttaaaacaaatcttaaagtgaatgttataagacaaaagattgtacaattatttctatataacattgactctatatcgtctatagagtttgaatcagtgaaccttttggtttttgttgtctgactgtgcctcttctccacaaggcaggttgctgtttctgacttttctttagatgtatcaggatcaacactaacatcctgatacatctgagtgttcctcctcatgttaacctttctatcaaaagatattctactccaaactactagaaacatcacttaaattctttttgtaaaagatttaattgtgtatgtgcacgtgtgtgtgtgtgttttctgcgtatctgcctgtacaccatgtcatgcagtgctcatggaagccaaaagaaggcatcaagtgtcctgaaactggagttacagactgttgtgagctatcaatcaaacccagatcctctggaaaagcagccagtgctttaactgctgagttctctctctagcctcaaaattctttattaaagattttcttgctgggcatggtgatacatgcttctaatgtcagcatttgagaggctgaaatgggaggactgctctaagtttgacagtagctaaaggtaccacgactctgtctaaagaactaagcaaggaaacaaagattctctacctcggtagacaatggtcccttgatgtacaggcaagcattgattgcttcagggtggaacgccaatggttgcttatggattagtttgctttatgcccattcgttaagctgtcatatgtacacaggctatactgtttgtagaaagtttatgacagatttagcacagtggcaagttactgagctgcgttcttaaaactttgctgtgttttagggtatgttcacctgtgtcccagggaacagtgtacataggtgtgaaggagggtctctgacattagggaaagatactgtgagatttctgaaatctcacagtaaagcctcaacatttccctaatttaattaaatatcaaatactacgttgtatgaaactctaatgaagcgctgatggtattagcacagattaagaactgctattttttttttttaatgaaccctcaacactctttcggtttaattagacagaaattactaggtaaatcagttgggttttgccagtaccttctttcatgtagtcaatacttaatcaatctgggccttactcatttagtagttttaaaaatataaatagatacagacataaatataaatagagtaaaaaaatgaaattaaatacaactttatatttcctgtcttttttgtgtgttttttccttagttaaaaatgcaatgatgattagtgacaaaaggggccatgaatttgaaggatggtttggaggaagaaaaggcttagaaagtaaacattataattccaattatttaatatgtttattgccactgttcttttttttttggtttttcgagacagggtttctctgtatagccctggctgtcttggaactcactttgtagaccaggctgtcctcgaactcagagatccacctgcctctgcctcccgagtgctgggtgttctttaataagcaaatgttttcattgaaatgcacatttagaggcctagagagatggctcagtgcactcactggctgctcttctagaggacccaggttcaatttccagcatccacatggcagctcacaagcatctttaactccagttctgggggatcagatgctctcttctgaccactgtaggcacttgtacacatataatgtacagacatattcatgcacaacacccatatacacacaaactatacagtcaagagtattcaaatcatatctaaatctctcagttttcataatataagcatatttttgttaccttacctggattgagacatagaaacgtagttaataagttagaagcctcctttggctccttcctagatcttaccttcctggcccactttgcctccttatgaaaccatcatttttatttctgtcactgattaatcttacctgattattattgaattatacatatatgaatatatatatatatatatatcaccattctttatctgattttgaagatgaatttttaaaatgaaaaccctccattgtccttttaattagtctctttgctgctccctaaatgtatgttgataattgtgtccacatctaatacttaaagcattcatctcatcttgtacctctgtataactaagctaccatttcagtagagagaaaacagtcactagaattaatgtgtgcctatgcctttagtcatttaaaaaatagctacaatagttctatttactttactttcatttttaaaaaaatctcccccccatgctaaattttaaaaactgttagctaggtaaatttcatactttattcataaggacttcatgctttatagtaatttttaaatggccatttgtgttcataacctataatttttttatttcagtaacttctacatggtatcaaataagttaaaacaaccccctctatcctgaaaggtcatgagtgctttgaatttaaaaaaactttttattggggtttgattttactttttaatgagcatcttatatttttaacccattttaatagtaactgttagaactgctagctaaagacatcatagtttttgttctataataagggagaaaaaaagaattgagatacatttgcaattgtgtctgaattaatatggatataaatccaaatgtaattagtggctgaatttcaatgattagagtctttggatcaaaatgaatatgtcagtatatggtagggccagaattgaaatgttctatggtattagattaaaattgaagtctggcttattggaaacaattttgctctcactgctcaactaaaggtattaattatggataagaccaaactgaactagaaatgaatttgtgaatagtggaattctacccatcttcctttttctgagagtaaaaaccaacacctaaaagagtgaattgcagaactttattatgtcttgttagggtatattgtttttttttttttttttgatatttgatcaacttataagtcaaaatcaaatacctgtccagctattaaagataaacaatttttggtgaaaatacttcagttgtcaaaatgctagtacattcaacataaaatatagctttaatgaacaaagagcacttagaaataagtaaggatagatgcaaaagcaggaaaaggattgaagagaatacataaggaacagcaaacatgtaaacgtgttcagtattgctaagcagagggactggagcagtgactcagtggttaaaggcacttactgttcttgaagtggacccatgtttggttcccagcaaccatagcagtggttcacaactacgtgtaactccagttccaggagattcatgtcctgttccagcctcagagggcaactggacatgtggtgcacatacatatgtacatacatacatacgtatgatacatatatacatacaaattgagatatcttttaaatatctgatttgcaactactaagaataagaatgcctgtggtcgatgagggtacctagaacttgatagacacatgtgctttttgagaggagtataatttgagataaccttcctaggaggtaatttagcagcatggagaaaaagactctttgatgctctgcagtaccagtaccacccttaagaatccattagacttcaagtgtttttggcatagcattaatcataatagtgaaaagtggctgtcaggaaactgtctagtagtaggaaataaataaataaataaataaataaataaataaataaataaataaatgataattgactctctgcaatcatgtaaagccttgttgtaaactctagagatatagctagttagtaatagttgtaatgcacttgcttagtgttcacaaggccttgccttcagtccccttccttcccaaaaagtattataagatgctgtgttctcatgctgttcagaataaaggaaacaataaatatttgtcatttgggaatttctgaaaacagcatataaagtatacacacagacttaaagctctgtacttatatggaatgctatcattgtatcgtaagtggaagggaaactaagtgcatacagttatgtgctcactactgttggggtaaagttaaaagaatcaggtgaaaggatatgaagaatgcacagggaaatggtaactgcactgtctccagagataataactgggtattttgaagatggtagaaagatgaagaatgcaaatacatgcttatttaaaagttttttaaatgcttaagttaaattgcaaaagtttttttcataaagtaagtgaaaagaatgggatataaaaacatgtatatatcatgagccaggtattatagaaggaagactatatatggtattcacaagcagagctagaaaacctcctaccaagaggactataattatgagattgtgggtgtttttttattaagttatttatttactttacatcccctactgatgcttcccctctatcctctccttcctgtccctccctctaacctccctcccttctcctcagaaaaagggaggcctcccatggatattaaccagccctggcatatcaagttttagtaagactagacacatcttctattgaaagtagacagggcagcctagttaggggaaagggatccaaaggcagacaggatatttctatagagacagcccctgcccctgttttaggagttccacataaagacccagctttacagcacttacatatttgcagaggtcctatgctgtggactggactcagttggtccctcaaccagaagtcagggtcccagtactcagttgggcagggagtcagagaatgacaaacagacacagacacaagggagtattgtatctgaatgtaatttctcaaaatgagcatcaaatttatattacagaagaaaacaaagaagttagatgacacatcagccaaggtacattgaagttatcccatgtataatgacacaaaacagagaaatgcatatataaaggactagcaggaaccaggcagtgactataactgagataaaaactgtccctatctaaagtcagctattctaggagccaggtgaggatttcacaccctagtcacaatttatgctattcctctgagccttgtgaaagcttgcaccagggggttctgctttcgctaactttttcattaataatgcaatactctagttcctccttaaaccacaaccctccttcttcctaggccattgtaaattcctgcatatgggagtgacttggctgctattttaagtatcgtagggaacctccaggagaccagtttccatgaaactgtttgcttcaggactgtggccaaacttttggacttgtcatatagactccactggagtgggtgtggcagtcttaggtctattccatacatactctctggcaattcagtctctatgagcgcctatgagctcaggttagtagattctataggtttccttgtgatgtccttgacccctctggtttcttcaatccctctgctccctcttccacaagattccccaagttccacttaatgtttggctgggggtccctgcatcagttgctggatgaagcctctctgatgacagttatgctaggcagaatatcattaaaagtgtcagggtttggctccctcccatggcatgggtctcaatctagcccaatcattctttggctcttccctcaaattctgctccatcatttattccctgcacatcttgtaggcagcacaaattgtgggtctaaagttttgtgtctgggttgatgtcccagtccctccattggaagtcttgcctgattacaggagatggtcagtttaggctctgtatcccccactgctaagagtcttagctagggtcaatcttatagattcctaagagtttccattttcctaggtttccatcatcccagagatgcctcccaaaaccagttgtctctcccattactctctcctccatcctccccaaccttatcctccctgttctcatccccatcccttcccttccctccctccagccaccctaatggtgattttgatggttttttccccctgagctattgttgctaggtattttgcagtgactgcatatttctcttctaggaagtaaagataagatttttggtagagtttaaattcaactttgttctttccattcctaaatttttatttcccaagaatttactgaagttggacccagctgacagatacttgacagagcagtgtttaaatcatcctacatttcagactcagagacttttggaccggtctccttcaagatcaacaaaaaggaaaccttatcatgtggaaagcagcaccctgtctaataggtaaatattccttcccttctaaggaaatacaaatgcaggcgtggtctcagaagtgggtggaggaggcggctgctaaaattatgcaattaaagaaaagaaggaaagccctcattattcaaaaatatctccctcatacttattacatgattcagaactataattaatgagttgtgtgggactattaaagacttttctatttaacaagtatatgatgaaagcctatgtattcccttggaaaggtagcattgagttagctactctggaggtttccagcatcacagacaacattaagacctagcagattttgtgtaaatgactagaggaagagagttcctggaaggaaaagaagatactgaatgtgtattggggaactgagccaaggcagcctttttaaaagggttttgtgattgtattgatcttgcccttcaatcactgagttgagaactgaccttattttataaaaataagcatagggaaatagtggtcaataattgaaagtagtacattttaaaatagctttttgaacataatattttaaaaatatttgtttcttgcctgaacatacctatagtcctagcattgaaaaactcattgggtagtcaaacaggcttcagggtttactcagtttctcctgagtgccaatcataggcccatctggctgaaaacttttcttgaatcaatcactcaatctctgtctctctctctctttcctttcctctctctctccctccctccctttctcccctttatttcccttttacccttcttcttcctcctcccctctattggatcagtcagattgcctttgtgtcctgacattccccaattctattgctgcatttacaggagaatggtgttccttcatcttccagctttggcatctgatgatttttatatatgggatttagaaatagtttgactgaggaaatgaaaagcaatgaagcttttaaaattttaatactacccccaataaacacacacacacaattttcccttctgtatgtggaaaattattcttaatagattcgaattttgaaaggtcaggacctaccacttttctgcttactccttggcacttggctggttgacatttttctcgtatctttgctgggattacaccaagcttggttcatgggttttagtctcccttctacttgaattgccacatgacttctctaatttacctttacaaagtaaattatcctaatgatgtaaagtttggtagaccaatgataaatctgtgagttgtactgtagtcatcagtgatataacctgtagtctgaaaggaagcctatggtgagtctcacagagactaacttgataggaattgtgagtaaataaaaatttctgaaaggattcatttttaggtcttggtgatattttaaatatatcaaagggaaagtcctaagagtttgtattttttagtaatcttctatcatctgaggcctttccaccactattgccttgtccagtatttactccatggaagcctatcttgccagggatgtgaattgtagctggtgtctccccacagggtttctaagacaattttttatatgtttacaacaccatatctattggttcccactcacatactactgtgccttgtccctagagagcacactgtcaccccacatcattttctctccagaagccagtgaactcagtcattacttcaggcttgtcaccttcagactcctctgaggttcctttcatggcatagtgtgatgccattttgactgtgctggtcctctcattgatcctgctttaccactcaccacatatgaaaatagttttgtgcctgtctccatttactcattggtttatggaatgtcccaggctggccatgccctcttcttgtagctatccttcagcctccagctgaattatctttcagctaggattatagggttgtgtcgccatgcctggctattttcacttttaaacttattttgagtatacgtattaactgtctatccatttatctactctgccaaccatatgagagtggttcttagccatacagtcatgtccacatgaaatcccagccctcatgaagtggaggcaggaaaatctggaatccaaggccagccttgagcaagtttgaggctaatgtagactacatgaggccctctctctaaaacaagcaaatgattgagtgattcatacattaatttgttttcaattgttagcaatttaacaaagattcttgggagttgtgtgtcaaagagatctatgaaattttcaaagctgctttttcttgttgtactctgccaaagctccaatgtgaagatgatgtgatgccctttctacatatgaattattatatgtctaaatctcagtagcttgcagttaaccctcagatggaaacacagagagtaactgcttaggatacatataaatacatacttatatacatgcatacatacatgatgaataaatatatacttatatacatgcatagatacatgatgaatctgggcatttaacagctgtttccaccttaactttatagcttcctttctcttctattgctgtgaatacataagatcacagtacgtttgtgtaacagtaattccaatggttctagaagctctagcaactttctacactcttttctgtcccttcctggtccttatttatggctaaagcatttctgtcattgctataccttcatctgcaaaggaaagggagaaaatatgatatcagggaaaactagagtttggcacaagaagccctgtggaagaattgaactaggacctgagtcagggcatgtggccaggaagaaacagggaagtctgtctccaccccccacccccaaccttctccctttttctgtggtacttctttctcctgttcaactctactagaagatagccagctaggaacctgagggatatagtctcctgtggtcttaaggcccaggactggagacagtattgagagtagccaacatatttactcagatctatctgtgtgtacgattatatatcataattgagtttttgaaaagtgctgacatattttgtttgccaagatataaataatcaggcagctctgatgcctgtggggtaggtagactggctggatgctgttgttggatggagaccacggctgagccgttctagaattagagcaggtggagctcagaaaaaggttgttgtctacaagcaggaccattatcttgtcagttataactagtcagccctagttatactctgtttgagatcaaagtatccagagcttggtgcctagtaactcatgatgttttatacaggtaaccaatcttaaggagaaagaacagctgagctggagagatagcttgactgttaagggctaggttcaaaaatcaaaaacataatttatttcttagccaattagggaattttccactagttatctagataggacatacagatggatcatccaataagacctagccactttcctttgactgctacaaaaagaacttctccttcgtctgaacactagattctctctgcccaggagtttgcccagtatactctatgcaatatatctcaataaaccaccctttctttctaccccctactgtgtatatatgtgtctgataaattattttaccatctctgtaatcagtcttacagatcctatcatgcatgcactgcactttattgatctggacatatgttctgtataacatctaacaaaacaaatgtaatttacctttgtgattcctttctaaatctggggaaatgaggaggcatagttttgttgccatttttattaaatagcaataacagcctaaaaggacttttcttccaactagtctctgatggaaaaaaatcttcaaatcaattgattttcaatagtagcaatacttgcaatgttttctaaattcacagtaaaaacaattggatagatcattcctaactctgaaacctatgtcaagccacaatctcatcctttgttacaacaagctgtcttttctagaatgtcatttgtggctttcaaactgaagacaaggtttctctctgggcaactatttgtatattacaataggtaggaaatgaagcttcgagtcctaaagaagtgctcagtcactttggaataatgaagtgtgaaatgaagaagtgactaaagtgtgcctttaccaagcaattagcactcaagactctgtgttccagtataggattcctgtttagttacacagaaatatctaaacagttagtgatgcatttctgtttaatgtacaaggagctatctcaagaggccaacgtaattgccacttctctaaggcataaacacagatcatcatgttttccaacaaacctcactagtcagttcccatttttctcagagtgtcattttctttacatcactagaattctccctcattgactctacgggctaaagagatgttggcatgtgtgtgtaactactgtgaatgtgtatctgaagcagcctacaggtttttacaaagaatgtgaagttcaaggaacacagtaaccttcaaatctaagtgttgcctcctgacattcaaacagaaaaggggattgtcagcgtcagcagtctgctagctctcttactcgtactagctattctgtaccaggcagtcatagccaaagcatactttacctgactctgcatcagcgactgtgttggcagccagcaagttagacaagcatttaaggatgccaaaacatcttcatcaggaagtgatttatctcattcagtgacttagtctgagaaacatgcctgttattgagagggacacatttgaggtagtgattttgtcatttgagtgcctgcttttttccctttttagaaaagtctcagtctctctctctctctctctctctctctctctctctctctctctctctcctttaatcaaaacactgctattatcttttcatccttttattccttccaacaaatttatcttttcatccttttattccttccaacaactttcttcccaagtcctgtgcctagcctaatgcatataactagggttgccttcatgaacacataagaggttgttgagtgggagcaatgtatcagtggctataccactaaagaatatgactacctctctctctctctctctctctctctctctctctctctctctctctctctctctctctttctctgcaacttttaagtgtctgtatagctcctctgggaggatagggccttgggtctcctgcattcaggatggagcattgatgggcccagtcttgtacaaggaaccactcctgcagtgaagatagcaaccgtgtcagatccagacaacagcagcccttcccattctccagctcttaaattctttatactccttccttccctgagccatgcaggtgttttaagaacggtctcatttagtttaccatgggtttgcttatctgttttaaacattatactgtttgcctcctattgaagggaactgatctgcatcttttgttttaaacatagaaaccaatccaccaagggtgctgccttacagactcaccacagatccaacagcaaggacattcagaacttaagtgtgggtctgcccagggctgaggaaggcctgcctgcaaacgaaagcttcctcaatggaaaccttgctggagcaactctcagcccaatgcacaccaaaacctaccaagcaagcacccagcctggctcttccagcaaagatctcacaaacaacaacataccacaccttctcagtccaaaagaagccaagtccaaaacagagtttgacttcaatattgacacaaagccttcagaaggtccaggcacaaagtacctcaagtccagcaccagatctcagcagaacaggcactcattcatggaaagctcccagagcaaagctgggaccctgcagcccagtgagaagcagagtcggcacagctatattgacaccattccccagtcctcccggagtccatcctacaggacaaaggccaaaagccatggggcgttgagtgactccaagtctgtgagcaacctttccgaagccagagcccaaatcacagagactaataccagtagatacttcccatccagttgtttggacttgaactctcccaccagcccaacccccaccaggcacactgatacgagaactttgctcagcccttccggtcgaaataatagaaatgaaggcactctggactcacggcgaaccaccactagacactcaaaaaccatggaggagttgaagctgcctgaacacatggacagcagccattcgcattcactgtctgcacctcatgaatcattttcttatgggctaggctacaccagccccttctcctctcagcagcgtcctcacaggcattccatgtacgtgacccgggacaaagtgagagcgaaaggccttgatggaagcttgagcataggacaagggatggcagccagagccaacagtttgcagctcttatcaccccaggtaccgcttggcattttggtctatcagcttatcttgggaaagggttacaaggaatatttataaggttgctatacagttccccctactacaatcagcctgactttcattggacagcgaaggaaagtactctttggattatttctgttaaaaataatcacaatttagctgtgtgtggtgacatagacacaggcatgtcctagcacttgggaagcagagacaggtagatctttgtgggctccaggctagccagggctacaaagtgaaacaccctgtttcaaaaaataatatttgtagtatttttaaatgttcatttctgacatatttttgatgactggccatttattgaaattagcaatatggactagctcttacttattttaaaatttgggttgcttttgtctgttctttctaaaccacatttgtttagactttttttcaaataccaagcatttttttattaatcactttacttgtttacatttcaaatgatacccccttcccagttacccctccataaacccccatctcatcccttctttccctctcccctttgcctctatgagggtgcccctccactcattcaccactccagcatccccccatgctggggcaccaagggcctcccttcccattgatgccagacaaggccattctctgctacacttgtatctggagctatgaatccctccatgtacaatcctcagtgggtggtccattccccggttctccaggtagtccagcctgtcaatactgttcttcctatggggctgcaatccccttcagctccttcggtctttcccctaactcctatattagggtccccaggctcaatcccatggttggctgtgagtatctacatctgtattggtcaggtgctggtagaagctctcagggaacagccatatcaggaccctgtcaggaagcgcttctgataccaagtatcctaactgaatttaatgatttaaattttttttgtaaactagataagtttaacttcaggctagagtaaatgatacttgcccacccagtctctaacattttaaaagatttttaaaattatatacatatctgtctgtatcttaagtatgagcacataagtataggtacctatagaagctacatacctttgaagctagagttataggaattgtgagctgcctgacatgggttctaggaaccaaacgcaggtcctctgcaaggatagtacatgcttttaactgctgagtgacctctcgggccccttgggttttttaattaagtatgtatgtatgtatgtatgtatgaatgaatgaatgaataacatggggcaagggatgtatatagacatgcacatgaaagggtgactttgtgcaactggttctctccagccatctttatgagggttttagggatctaactcaggtcatcaggtttgcatgctaagcagtttacctgctaacctacaaaatcattaaggcctgcattactagagcactggctatgaataggcatcgagaacagggagaggtcaccgtgaacaggaatagtctgaaatggcttcggtgcagctaacagcctgacctgtgtagacagatgaagaatgaagctgggctaagcaccacaagaagccttgattgggaagatgaaattaaagtgtccctgtcattctgaagtatgttaactgagaggggacacttggccacaaatgatttgttttaattctataaacctggacactggtaaccatgcagaggtgtgcttgcttgcgtgttgaaagaaagataatggaagcaatcctgtcagtccagcataggccctgttggaggctcccagaggagggagagtctgagcagatccttatgggaaggttgagatttcccttggggaggaaagtgagagcagcaggaaaaaggactaaaaagagggaaagtattccaggaagacatgatgctccatgggtcccaactggcttcccattggtggaatgaaaatgtaagagctgagcaattctcacatgagctgaggagagtattcaggattgaatgtcagtatgaaaccagagtggatcccgaggactgtgcagtagacgcaaccagacttgccaattgcactgttgaaggatttctttctgagagtttctttcctaagaggtccgttttggaattgggatggggatttttaagctctgtaattcaacattatccctctctgttgggactcataggagataggtaatctgcccaactttccccagctgctagtttaacgtagaactgggattctaaggcaatctacagatccccaagtataaaatggtggcaagatggcctggtccccagttaaaggtgggacaggaggtttttgcaggggctttaaatggagttataggaatggttggaaggagtcctgagaactcactatagagataagagaacccagagtgtctagaaacatctctagggcctgctcactgcctgtagaagagagttggagatcaaaaccaagcagattgttgttggcattgaggcaagtgttaaacaaaagaaaaacgaaaggcagcctcccttggaaaatggacaaatgacttgctctcagagaattcagaaaataaatatctctgaacactgtagtcctaaactaattataaacaattactggggcttagcacatatccagctgttacttcagtccagttcaggagtgcagcactgagccttaagaaaggccacaattaaaggctagaaggtggctggaaggcttgaaagagttgtgagtaaaccacagtgctcattctcatgggaagcattgtagccactttcaaaagcacgagaccactcactgagttgagtttaaatgtaaataactcatttcctttaaaaaaaatcttgctctgggcctttgtcaacagtacaggttggcaacttggaaagaagaaaggctgcaccaaattaatttctttccaaaattctctaaataatggtggtggggaggaaggtggtggggtaccagatcttatttgagtttttaaattaaatcattttatgtatatcacctaggctttaagataatacattttaagtataatgtgtagatgctgaaagcagccagctccttctaattgtgttccttaaccctcatagcccagggtagcaaatgtgatctctttttctcacttggacactgttaaggacccactgctgtgctgaggttatgtctcagcctacttgagagggatctaggtagcgggaccatctctagatataagcaccatcaggaccatgcattgaacaggtgagctactgtcctggagaagatgaagaagctagaagcagcagagactggaggagttggggactctgaagacaaaaatcattaacagggattattctattcctctttgtattcacaaagcatttcttttcatctgcatctgctgtgttaagtctcctggaaaaaatgcttttgcctctgcatatttcttttcagagaactcagcctaaaatctgtaagagcacgtttggattgactgatagactctctaagtatagtgatgcttagagctgttactgtctagatagaaaggtgatttcttttgtggttttaaataattaattgaactattttcagactaatgtagtccttactggccttaactttaatgagaatctcgctatctgttaaattttggggcttattttacattcgtcagatacttttagtcttttatggaatgagttatgttgaagtcatcccatgatttttatttcagcttgttaaggtcctagctgtattaaatgaagacagtgatgaattttcatccccagagacaggaagtttctataaatctgtttgaatttgacttgcagcctggagaacagctccctccagagatgactgtggcaagaccttctgttaaagagtcctcccgagaaggcgcctcttcattccacacccgtcagaagtctgaggtctgagctcttccaagttgctacatcttatagtgtggtctgtaaggaccattcactcggcagcattacaacctagcttttaaactttcttcatacccaatcttccataaattaattgaactgacttagaaaataagtacttttatttgtaacataagcctgagttttcctttaaaagatcaaaaaaaaatgaggcactggctgggctttgttgtaagctgcactatcatcaagccatggtttaactttcataaccttgtttcctgcctcagggtggagtataccatgacccacactctgacgacggcacagctcccaaagaaaatcggcatctgtacaatgaccctgtcccaaggagagttggtagcttttatagaggtaagccaccccactcctgtgtttgctgttgagtctatctcctttccttatccaccactatttcttcattactctagtggacctcagaccaacagcatcacctgcgttcccaccatctggcagttctccttgcccctagtcaccattgtcatttagtcccttgtctcttctggctgggaccctgattagtctctgtctccaaggcacccatccagacaatcctcagaatgatcctgaagctagatattgaccatgccgttcattcaacatttacctatgtcactttgtgcccagaagagtttagcctataaaaatcatggctgcatgatagctatgaagacagatccacaccaaattataaacatccataaaacatgagaacttttaaaattatatatacctattttcaggccgtggacacacaggccatggtatacctgtagagagaggtcaaaggatagcttatataggactcagttctttttgtttacaatgtaggtccaggagatcagtctcaggccatgatacctgatggcattctttcccctgatgagctatatgaaattataaatatatatatatgtgtgtatatatacatacatatacatatatgtgtatatagatatatattcatgtgtgtatacatatatatgtgtgtatgcatataatttttattttggaacaacgtctcactgtgtagacttaggctggcctagaactacaggtgtagactagactggcctaaaactttaaaatatttactatctctgcctcctgagtgttgtgtgtaaaggtgtgtgccaacacacccagtttaagatttttaaaaatattttgattgtgtatttgtatttgtattgtgtgaacattactcatggcaatgtgacattataataccagaaactcagacatgcctagaatatgttagtagataagacagataaaaatatccaccctcattcttgcctttacaaaggagattgccagcaagtataataattctctagggcagtcagataatggtactacaggagaaagaaatagagcaggcgtccattgtccaacagtacattgtccataattgtaccccaataccttagctctaacttgttgataggcctttggatgcttgataacagactgtttatggtcgaatccttgtagtccactctttctgttccccacccacttctacccacaagtctcaagcatacctggctctttcatggcctgggacacactgctttcctaatggcaccagttgttttcatgggacagttttccctttcctatgccagaagtatctcttctctgttctattcaatggtgccttgtctttgtccctgatacaagacagagcacactgcactggatctagtgtttctctgcaaggtttttgagcctcttgaatattctgagtttgaaggatggagatggagatggagatcagtgataagagtgtctgcctggcatgtgtgaaaccttgaatttgatcctggaagagagagatggaggaaaggaaagagagaggcaggaactggctgacacagctttataaatacttattaattgaattaaagaaaactttcaagagtagtttaaaaatagactttgttgttgaacagatgactaaaacatgttttttgggttctgttaatttagcagagaattaaagaaagacaaccctttgaggttgcacctgatggtaaagtgccaaatatttgagaatcccagtgctttggtggcaacatgaacaggaggctcgggtatataaagtccataaaacttagcacagccttgacttgtatgtccacattgcctgacttcctgctctttctgatgttatagacagctggagaggttcagtcagggtcagaggggacacaaaatactgtttggtaattaaaattaggaatctgagctaaataaatgcatacaagtgttattcgggaagaggtgtgcattgaatgattaggctactatgtggtctctcccacctctacctttagaaaaggactaggcataaaatatgcttcttaatgacccccacccaactccatggtaactgtagaatcttataaggctaaacttttttttattcatttaatatatatatatatatatatatatatatatatatatatatatatatatttgtgtgtatgtatatatatatgcatatatatatatatgaatgaatgaatgagtggtctgtcttcatgcacaccagaagagggaatctgatcccataacagatggttgtgagccacaatctggttgctgaaaataaattttggacctctgagccatctctccagcccaaggctaaacttttaattcagactaacattaattagttttcttgtcttctgcatgagtgaaaacatcttcagtgtaagtttttcttttaaaatcatctatattttgttgtttgtacatatgattggagaaaatatccttcttttggggaaagggtctatccatgtagaccaggctagcctccagctgacttgtatccttctgtttctatatttcagtgctggaactctaggtgtgtgctatcatgcccagtagaggaatgttttaatataagatggaagtggagttttaaattaataaaatagtcttttggctacactatttgggttacaaatagattgaattagttactatgggaaaaacattccctttatctatttcataatctactttgagagttggcaagtagaacattttaatttttaaaaattcagtaatagaaaggaaagtttaaactaaatgaaacacttggagacatctgtcatttcattgatactgctaagtcctagagaaaaagggtggtttttaaaactgacaaatgtttccagatatatctaaagagatgtttctagaataggttcatcctattttttttaatccaggtttcttatccagaggcaagtgaaatggtgtcagtttttgttgttgttgttgttgttgtgttgtggttttaattttatgtttgagattataattgcatttcttccttccctttcctccctccagagtctcccatatgcccccaccttgctctcattcaaattcatggcttcttttttcactaatttttattgcatacatatatgtgtacttacatatctattcctatcaataaccttctcactccttatgtgactgtatgtgtgttttcagggctgatcttttggcacctcccctgctcccagctttcctcagttgcctatagttctctgtggaggttcaggcctcctgggtttttttccctgtccactttgacatatcctttggtattatccttgttcaactcatatttggaaatgttgctaagactttatgggtgtagcttcttatattcctcagagacacagtctcatagcggatttcctgattcttcggctcttaaaatctgttcagtccttccctttcccacagtgctccctgagcattaggtgcagggtgtgttacagatgtctccagtaggactgggcgccacaactctgtattttcattagatggtgtttcctgtaatggtctccatctattgctaaggagtgaagactacacttacctatgggtataagaacaaatgtttatagattgttgttaggggttatgatgacttagtaaatcagtggttgtagattctcctccaaaaatcatgctttcactagcactgagtagttagctaggtttctagtaccagacatggtttccctcttgttgagcaggtcttcagtgtaattagaaatctgttggctactggcaaggtatacatgccactcctgtacccttggaattattgtgcctggtccctgatgtgggtccatcagcattatggctgggtaggtgtcttagttggggttttactgctgtggagagacaccatgatcacagcaactctcataaaggaaaatatttcattggggctagattacagttcagacatttagtccatttatggtcttggctggaaggatggccgcacacagactgacatgttactggagaggtagctgagagttctacatccagatcagcaggcaacaggaagagagagaaacttggcctagcttgagcatctgaaaaacctcaaaacccaccccagtgacatagctcctccaacaaaaatagtgcctcctaagagtgccactccctggtgaccaagcattccaatctatgagtctgtgggggcaacctcattcaaaacccccacagtaggaccgttgatgcctccctcctttgtaacgtgggtggcaccttctggcaccatgaaagcaagtcctcagagagggggcatgtaggtcagttccagttcagggatctctgggctctgtagagcaaacagaaaattaaaatgggatcattgccaagatagggggttagggaatagtagagaggggaatagcaggagataagtgatctgatcagagaaatgtgaaaggaggggaggcgaggtaagtacagaagcaggtgggagatggattaaataacattaagaatgtctgagaagtgacaagtaatcatactattaactgtttacctaaaaaactctaacacagagatgcaatgctgtgtatgaatatgtaggttttgtttcaacatcagtataagacaatgtcttatactgtaacccagtcaggatgacctggaactcactctaacctagtctgtccttgatctcattcagtcctcccacctgagcctcttgaacagtggaattacatctagcaagcacttcttgcttggtgtcactgatcttgatatacaatgtaaatataacttttgtgatgaaatttgtagagcggccaagtttagaaattgatgaaaacatggttaccccttcccccaaagcagaatcactcaatacatcatagtctatatttctgttcattttttgctctgagaatatatagaaaattaatattttgtgcaaatggcccaatttccttagagtttaaagatctaagtggcacacccttacattgccaaatcttaaactgtaatttgtgtgttccagtacacatattgttaagtatgctattggactaagaatggattttgcctaattagacctgtaatgagaaagcctcaacctcaaagaatgccaaaaacatggtatttggcggtggatgctacagtagtcatattttcaatgctgtccaatctaaaagtgtcctcaaatattctgcagccaatcagctgatatcccaggcttctgttttgaaatctttattacgtacccttgtaaccatgtaagcggttgaggagggaaatttgcctggaccacctccatactcaggcagcgaaggttctggaaaggcagaggaagactttttgttggtgttcaagaaatgcagtggaataatatcagaactatgcaacaaagtacttcagtaatggtttttctttcctaccccttcatttagtgccatctccacgaccagacaattctttccatgaaaataatgtgtccactcgagtttcttctctgccatctgatagcagttctggtacaaatcattcaaaaagacaaccaggatttgatccatggtgagtgttttggtttggtcttactcttccttttgctaattgtagatttgggaattcaaagatatacaaggtaaactttttagttttcttttccccactcggccattctttctttaagaataagaaaaacatgttcttggagggttttgtaactttttttcaaggacagaatttatattttaaataacatagcagaaaagtctttcatcatattcattcattcatttattgacagtgaacttggtcctgacactctgcatagccctctgtatccactgccgtagttctcatagttgccctttgagggaggagttactcccattccatacacagtgaagcttgaaagtcagaggatgtacctggtgctgaacacctgtaacatagagcagggacacaggacactagcacttccctctagaattgttaggatatttaagtgatacaatattaaaaaggcacctaaaatggtacctggcactgtaatggctcattgtattagtagctatggttattatatttatgtttccatggattgttgaccattttgcttttaacctagctcataaacttccatacctctttgtgactgtgttttcctccctagagtgtagaaaacataggaaaacagacttagcttttgttggttttcagtgttgaccattttcagatgttgcatggacaagccctgagaataatgtcaaagtgtcaaatacagatgcatagaatggactgtcttctcttggttgtttgcataacacagtggggacaatctaaaacagtatcaatttgagacttgcataatcctttgagaattaggttagtcagataaaaattaaatgaaagtatgaactggtcggcataatggtactagactgcaattccagcatttgggagactgagacaggaggattgccagttcaaagctaggctgagaaatgtagtgagattctatctcaatgccttgcccagggagtggggggaaccaaaagtaggatagacatcgttagcatggtgctgtctccaggggggggttgtgtgtgtgcatgttttagggggttgatttagtttggttgcagagactgaatgtagatgagtgtgtgtgtgtgtgtccgtccgtccgtccatgaaattggttgtttgcaaaacaatcaaaagtacagttgggctgttcatctttagccaagacatcaccaagtcatccttgttctaatgttgctattatgttaagaaggttcccgaatccctagctgtaaatgggctctcttcttttattctctacgcccccattatattcctatggtgtatcttgttcatgtatcatatctaacatcatttaatctttaattaaccttgacttgtcttgatttgtttcttgaccaagatctttgttttgctgtattctttatatctaagagaactatgcatttgctaacacaaacataaaagtcttgctaaattctgtaataataccactttacatttctttggggaagagaatatttgtacacggtacatattttctgcaatggaaagatcaagttgcaatatcatatttaaaaccaataaattgatattgtagtttaacacccagagctgttattctggccatcttagttgtattgaatccacctaagaaactggaaataagccaaaatatttcagaacaagaaaaatagacttaatacagccagactcatcttttactagtaggctcctcacttgtaagctatttattcctcctagtgtccagttttagtgggttagtactgaggtcattaggatgagatgtggttccagcccacaacacagtgtccaaaggggaggggaatcacaggcaatagctatggagcaaagcatgtgtgtggtttatcttttcacagacctgtgagaatcccatgcctcaatttagataggtatcagtttagagtgtgtgcctataaaatgaatagcaattcctttacaatagataaacaaatgacaaagtatggaactagtttagaaaaacttccatcaaaactgggctaaaaatggaggaatggactctgaaactcatttgaaaaatgaggttttttttttccacagtgttatgaatatattgtgtccattacagcttgtcagtctgtcttgcagtttttctcataaaatccttcactgactttcttagttacagccagggagggatgaggcaggggaatgacagcgcagtgtcccgcacccctcccacgcactctccatgcagctcccagagggcttgtcctaaagttcaagaggctctctgtacagtcctaccccactgctcttcattgtgaggctgggagcagttttgagtgagaggccaggctctttggttgatttctctctttatctctaatacctaatatgatactcagtaaatgctgattaactgtaagtcagtttttgttttcatgtcttccttccttgattacagtgagtctttgaacttccctcattcttcttgactcccttgggaagagttgttagtctagatgacaggagtcacagttttgtgtgagaccctgcctatttatcctttatctaaaagtgtgtctgtcctccctccaccttgtagccatactattttgatcaatgtgttccccaaggtgatgggctgggtcacactagatggataacccttctcaaagcttgcttgtctgaaatttatgtgacacccaaagctgcccactataccacgtgaaattatagaagccataaatccacatagggcaatagttgcctggtgctctcaatgctgcgtgttcaaggctccttcttcctttgtgtaacacaaagcttttcaagtacttgagttccaggcagctagctgctctctcttcctttctcttccaggcttttttctcttcgtgttttctgtgtgtgtttctgtgtagctctgcttagttctttccttttgtctccccttctttgttcaggcttgctttcttctggcttttttttttttggtgggggggtggtgagacagggtttctctgtgtagtcctggctgtcctggaactcactctgtagaccaggctggccttgaactcagaaatccacctgcctctgcctcccaagttctgggattaaaggcgtgcactaccactgcctggctcttctgccttttatgatgcaaacataatttctttcccctttccttttggcccctacactctttccctgcctacatctcaaccctaccacctggtctgcttcagcttagaaacgttgaagttaatcattcctcctgccccacctagactgtagtttctccagtgccttagagatcctagggagggtctttgatccttcatcttcccagtttcccaggaccaactctgcaatggcaaatgctgaactgttctcctgccccctctcttctaaccttccacttctccagcctctacctcatcctggtggaacttctatcttcccaggcagaattctgcttcctccaaggagtggtgtccccttctttccttcctgctagcactaaaattctgctctaatgccagtttgccttctaacatgtctcctcgccccacccttgactgcattcatgaagctatgaaggtcatattttccccagcagtacagcactgcatctacagacttgtaacttgccaccatcccatttgtacccatgcaaccacatcttaagcttctagctttcaaagtgatgaaggcactgctctgggttcccagactgaatcacagaacttgtacttcagaatttagaacttaagtggtgcttaactagcaagttctaatggatttcaagaatgcctggggtgctcctgggcactgaggagcacaggtgtatgccatcatgtcagggttatgtgggattgagggcagaggctttgtgcatgccaggtgcacattccaccagctgagtttcatcagcaccaactatatctctaaccccaaagtactctgggctgtataacaccttgttgatgacctatagcatactattggtatgtgttctcaaaaattaaaaaggatatcagaaattctgctacctagatagagcttgtaagggttttttgggggtggggggtgagggttctattttgagaagaggtaaaatttaaaacaagaatatcaataattctattacctagatagagcttttaagttttttgtttgtttgtttggttggttggttggttgtttggttggttggttggttggttggttggttggttggttggttggttggttggttcgagacagggtttctctgtgtagccctggctgtcctgaaactcactttgtagaccaggctggcctcgaactcagaaatccgcctgcctctgcctcccaagtgctgggattaaaggcctgcgtcaccaccaccaccaccaccacccggctaagattttttttagggggggggtggaggttcctttttgagaagtggtaatctacccactgttaaccactgttctcaaacacacgtgctaaatcgatcctcccactgtagtcacacacctaggactacaagcatatgccatgaggcttttcttattttttccccctagtgcattcaatggaacccagggtcttgtcaatattgtacaagtgcccttccgctgagctgcatctccagccaagatttctgttgcaatttcttcctgcattttaaaaaaagtgaatatagcagctagaggaatggttcaggagttaagagcactcattgttcctacaaaggatccagctttggttcccagtacaaatagtggctcacaccgatccataaccccagttccaaggagtcccacaccctcttctgacctccatgggctccaggcacacaagtggtacacacacagagactaattgctaaaacataagataaataaatctttaaaaaaaataaatgaatattaaaatgcattgtataacctatatgccttcttgccatatagttggatttatctggtatgaaaaaaacttgaaatcattatatttttacttactactatagtttaaatattcttttatgtcagtggattctttgaagctgtgatttatttttaatagcttcattgtgttttctgtcgtgcaaccaataatggtttatttagaatttttctggcttacatattttaatgaaaaaagctgggtgctgctttcttcatattttcttagatattataatcacgtcatcgctgtttggtattctgaaaccataaatataaattaactgttaattttaatgattctaccacttttactttagggaatatgtaaatatgtgagggtttttttttttcaagaataatagcagttgagttgctttttgaagagtgtaagtccaaaaccaaggtgtcccccaacccctctttttttgaaaagtgggtttttgtttcatggtcagtcttggaagacaacctgactggccttcaactcaaacattctgtttcagcctcctgagtgctgggattacaggcatatgccaccacacctggcttatttcctatttttgaacatcctctatttttattaaaatacctagtgttatctgtggtatcagtcttttaaattttttattctacttactcttctttcatttattacatcctaaatgcagtttactttcctcctaacccttcctctaaactccacccccgaccccccaccaccaaagtcattcctgtttcatttctcttcagaaaaggacagacctcccatggatatcaaacaaattcgacatattaagctgcagtcaagactaggcatgttgtatcaatctttctttcttttctaaattttaaaattacatttattttttatttatttttttacatcccaatcgctgtctccccccccccatagtccttcctctcaaactccctccccttctctgagatagaggcccccctaggtatctccatacccttgggagctctcagagactgaaccactaaccaaagaacatacatgggctggagctaggccctctgcacattatgtatcagatgtgcagcttgaccttcatgtgggttctgaacaactggagcagaggctatcccaaaaagctcttccccatgttggggtatgttctaccagctaggctgccttgtctagcctctgtgggagatgaagctgttccccatgttggggtatgttctaccagctaggctgccttgtctagcctctgtgggagatgaagctgttccccatgttggggtatgttctaccagctgccttgtctagcctctgggggggatgaagcacctaaccttgcagagacttgatgtggtatcaatcttaatgtcagtattttcagctagaatgattctttaacacacacacacacacacacacacacacacacacacaccttgagcatactgtgttagagcatacatcatgtctacattttttccttgagtatttttttatttaggtgtaatagattaaaggtttaataagtaggaattttccagtttggggcaatttttacttccattaataatgtttctatagcagcattgattttttttttatgttttgtaacttggcaagctactaataataaacttgttgagctggtttttagaaggtaaatagaaaaatgaaggtattggaaatgtttctgttctttcccttggagagttacagaggaagcatcctctaagccatgcattttacagaatttctaattcagagattttcagcagcaggaaaatggtcccagagagcagttacagatcatttataatagtgctcaaattgctagtgtgatcaagcctgtgccaaagaacagccattccctatgctgattagatttggttccctctgtgctttttagaggacctttacctgtgggctcaattcttcatggctgattgaatctggtatcacacattttcagccttcattatgtttgtcacactgtagcaagagaacgattcaaagatctatatgatttttaaaaaaaatgtcttctcatttaggaaaagtcctgaaaacattagtcatgccgatcaactcaaagaaaaggagaagcaaggttttttcaggtcaatgaaaaagaaaaagaagaaaactcaaacagtaagtacacgactaatgtctgtctatgtcacagggttctatgttattctgtggatacatgttaccctctacacggagcaatcagacttaatttcttagtatggatatattgtagacagctctttctgaagtctttcattaccattctctcacaaagcttttctagattcagcagaatctcaaggagtaaaagaaacttaaattggatgagaaaatacttttaagcctctctcaataaactacttatccatgtgaatttagattgctgtaaaaactatgaagacacgggatttgtttttctctgggagcatagagatatgcaaaaactttggaaatggttttggtttacatttaaatcctgaaattcataaataattatcatccttccctggcttctagtcacagaggtacaatttcatctgacatttcagggctggctttgagaagtaaagctatttcacttatggtggcgttgtgaagcaggctgcacctcagctcctaggagctttgcatctgaacaatgggccagccccacttgactggactcatcagtttgtggaactgctcaagtggaaattctaatctagctagtaacaagagaaaatggggaagaaagacaagcctccaagacagcagcaggggcagttaactcagaaagagcctgccttccttcattttattttaccctgatatctaagtgatgttgaattagccactttcaatagtcttgcgttttgactttagttttatttcacacaagatttattctcgttcatggcctaatcccattggctttatactattagtagactaaatgcttctggggcccttcaagccatcatgaaaattagaaaatagagcttagtggtaactaaagaagaagcagatgattgtaggaaagtatataactcatactaaggatattagtctcaaagatgtttgagaaaccttatatgtgtttttgtgttgattataacaaatgtataaacaaacacagtgtatagtgattttgcctgcatatgtttgttcactgcttgtatgcctggtgcccacagagaccagaagagggcattgggcattgggcattgggatccatggaactagagacatttgtgagctgctatgtgcgtgctgggactcaaaactgtatcctctggaagaacagctagtcctcttaaaagctgagccatttctccaacccctaagtgtatttttaaggcccctttacatctagacctgtggaaagcattctttcccttgcatattagatgcaagtatttcattccaaataaatgacttcaagctctgagttggtgtagagcatggtattataggcttttccttccagtactcaggagacagaagcagggagatctctgtgttcatgaccagcctgctctacaaagtgagtttcagagtagccagagctccatgagaaaaccttgcctcaaacggccaccaaaacatttcattatcaaaaagaaaatataaaaaagaaaacattgttcttgatcttgcccaacctaccacagacaggagctttgtagtctatgtatacatgtgtggaggaaagtttgtgtgtgtgtctgtgtgtgtgtgtgcgcgcgcgcgcatacacttgtctctgttttctgctttattttaatggttacatgatatttctgaaatgttcgtgggggtggaaaagggtacctatatatctctttctgaaacttgcctagactgaaatgtcaaatcaaaatgccactcaactatatttgttgctgaaactgtattaaaaagtgaagaatttaggattgactttgctttaggatgtttaaaataatttaagtgctaaaacattaaactctgcccgttgtctatagaatgtattgcctagcataagcattatccttccaacactccttcctggccactgttataaattttgtgggattttgttaactacatgcctaccaccctgtgatatgattgagttatagaaagtagtaagggtagaagaattgaggctgttttgtacataaatttacattttaatacatgtctgcctcagatcaacattaaacctaaagcccttgcctaactgtggctaaacgaagtatacacatcttgcctgacctgatttttcaagatttggataaaattctagatatgtaaatagtataggttagggtaataaaaattactgttctctagcatcctctctcttaaatgttttattaaatgtttatactaacctcagaaaagctttccacagatcatggggccttcagttttccaaactgaatttttttatacctctgcatttttaaattaagaataaaatgtaagtgttttgaaatctagagtcagatttccaaagaatactatagtgtgccagacctcaggcactgaggcctggcattaacttaactctgctttcttttaatgaatattcaaacgggaacttgcctttaccttctaaaattcaataaatagaaagctaagtaagacaaaccaaaaaattgatggggttgaaactttcacagaagactccaagaaacttaaatctgctgccagatgtacgtagtatagctaatcctaaatctcttttactagattaggagctgagccaggcaagtggttgacctgtccaaagtcgcacagagttagaactaaaactaaaactggctttccctgtaaaaggcctctgagtcagggtttctctcattaaaacgggaaacctcagatatttacacagccgtcttcacacttgcagcaatgaagggctgatcttactgcatctgtatacacttttgttctctgaccactgaggtagccaacagagaggaaagaggtgccaaaaatcatcctgcactgtaaaggtgccttctttgactccagcaagtctggaagctgccttggggaatctggctttgtctacccagggaattacataagtccccagagcctatggtggctttgccagcttggtaattggagcttacttagtatctcaacttgaaatgatactttaatataaagattgaacttttaaaaaatattgtgtgtgcatgatctggggaaggagtgcacaggggccatggtatatagaggtcagagggtaactttgtggagttgctcctcactgttgacttttatgtgagttcttggaattcagtctctggttgcaaagttctccactgatccatcttaccagccctgaagattaaacttgtatctctttgcttgaaacccagaaatctgaattgtaccagatattttaaatgaggcatatatttctaacagtgtaatgtagctctgctcacctagccttagtatcccagcaacactgctaatcatctcccaagtcatatttactggctctagataattgactaaaaagatccaaaggacttaaagtatattttctcttataaaaaataatccatgtggtagaatctcttcattactgaaatcctaacagttagtaatggctggagttcatcagcaactcattaaacacaattcttcaaaacagtcttatttttgacaatgaataaattcctaattgagcataatgtaagcagatgcctagaggtctcaggcatccctatactcttgctcataatcattgtagagactctgaaaaaatttgtacttgtgtaaacgtacactattgtttccaggtgaaaataataaataatctctctagatgcatagcacagagattctttccatgattgctaatatttaatcatttgagggttaccaagggctagtagtttcaattaaagcacctatttattttgcttaatatttttttttgttgcaattagctcatttgtatcttatattacagacagagtccagcaacggcgagaatccaagcatcaagaaatccctcttccctctttttaattcaaagaatcatttaaagcatagttcttctttgaaaaagctgcctgtagtcactccacccatggtacccgtttttcctatcgtagccctgagaactgctccagtaaacttgttttactgatgatgacagcatgtcttattttcatggggtcataatctttgtgctagttaagtacctgggccagttccataaattctctgggatatatgcatatatataatacatatactttatatatattatatatctattctgggttttctgcatcagttaaagatgttgtcgcataagcctactaaacaaactagtaaggctggtttggatgggctgattagccaattgttggcagacggcattcttgaaatcttttcatttctctaaagaatctgattaacatttacagtccacaaatgtcttttcacttggctcactgcatgcactttgttactattcggttggcagtttgtttctttaaaaccaactttaaattgaccaaatcatttgagctagcaggctccataagaaaagcagcttgtactagttgataacttgctcttccttacctgcctctagcttttgctagtcactaggtgtaaagccatggcttttgcttggcatttggcataactctccttttgtccactaaagccactgaatagaccaattgcattcatttggaatttgtggcataaatttcaagcagtttctaagcctacaatggcagacacagatttactgggcagtggtttgggactatgattcaaaccatacttccctacattttctctccttgaaagctccctagacgactttggcagcatcaaatacagattttgcatcatattcccagcatgagattttgtttttgtttttgttttattgaactggttcataacctaactacaatatgaaatgaggatgccacagcagttcctggtccagcccactttaactgctctctcttacagatactgaaactaacagcatgggaatgctttaagggttaaggttttaaccaagctgcatgaatctgccaatttttcctaatgcagggaaaattactaagaaggcagcagactttaactagcactacttgcatcatgaacatttggagaattttgatttacttactgggtctttttttttctctcttttgaaatttggtttagttcagtttacttttcagtttgggtctcttcttgggtgtggttgttgtctatgttcattaaggttattgatgtgcttgctgaatccttctccatctttccctctaggtgcccaacactgacggtcctgatctattgaccttacagaaagccattcattcttctagcactgcaagcagcagaccaaaggagtggcgacctgagaagctctcagatctacagacccaggtgagtgtagcttacatcactcccagattttcaggatgggaaatgaaggaagaaaaaaaatagctttctccaaatcgaccgtaataaatagccttggtgctattttgcaagtcaggatgattttcacagtgattcccactgtgaaaaaaagcaagcctccactacccttcacctagctggggaaagcagcggagcaatgtgcagagataaacaagaagtagtcctagaccacaagtaggctacagctcaggagacaagattcatgaagaccatactacaaagtaagttatgctatgaaatattggtgaggataaactgagattgtgagaagaataaggttaccttaaagatggtagcatataaatcgggccttgaaagccagatattagaagctttcttgaaagagtattataccttttgaaatctaagccatttttataaagaaaggtttattttattaggaactgcatatcctttttgtatttcttcaataccccgtaataagaacagtgacataatctaccatgtttattttaaccaaattttgggagtttagaagcagtggctctaatttttataggttttctgttttgttctttttttttcccctaagaatgcattttaccagttagtccaggtaatcagttagtcctgcaattttctatgtaatccaaactgacctaaaactagtaatccttatggctttatatcccacatgctaggactatagatctggcttctttcactataagctgttacttggagctataagcagaagttctccaaaattgccattctttttgcctggccatttatattttgtacttatagcataatctcttctaagggtaaagggggcatagggaatgagatatcctaatttggcgaggtggggatacttattcaaaataggaacacaaagatctgagagcctgatgctaaggggcccctttctagtaacttcatgtctccagctgattctggattattataattgcttgataattttctcaagttgactaggaatgacttgtttatatcattttaataaaaatgaaaaagtagtcaagaatgatgcctcagacctataatctcaacacttgagaattggaggtaggagtatgaataatttgaaactatactgggctatataaacagagattcagtccagcctgggctacataaaggcaaggagcaaggaggattaagagttggaggccaccctgggatacataaaaggaatgagggtagagaaagacaccctttgaatacctccagtgcatagaacactttgccacctcctatagagaccccacagctttctttgggacaaatgtcatagagctagtggcgagtgctttcctagaagctatgtctcccttagttgtttctcagctcatttaccgtggtggttagcaccctgtttcttcaaatcttacagttttcctagcgattatcaatgtgattcaaagttgaccaatagctggaatgcatgtggcttataccatggcactcaggataaaagtactcttgagttttgccagcctgtgttgcttcagtagtagattggtttatttatggtgtgtgtgtgtgtgtgtgtgtgtgtgtgtgtgtgtgtgtatgtgtgtgtgtgttgttttggtagtttcctaaactgtcctcaaatttgtgattctcttatctcagcctcccacacatctatctaggattgaattcatatactgccatacttggctttctatgcctcttctggtagtgattctcctgcatgttgtgcttaaggtagaggaagaagtgttgcctttcaccatggagaaacttgagtctcaggagttaactgaaaatagttggccagtgagggacagatctcatctaggtcttggccttctctttccacaccagtctcccttccaaggtgctataacctgtagggtctttgaccagcagccattctgtaggcaagaagtccactaaccagggtttctgtgagcagttgaaatgctttatatttttagtacccaaactgtaccattcctacatcaaaaagatgaaaatgagttagtaaaatacagcatagaacataaagatgtactatcaaaaagggaaactactatctaataattcactgcatcaatacctaaaactacatttttccagctactcttgcagctaggtatggttagatgttcaagttctatccagttgtatcaattacttctgccattgctgtggcaaaatatctttacagatgtagggtacagttcatcacaatggggaaggcatgacagcaggtcacactgtatccacaatcaggaaaaagagagatgagtaccagtgttaagcttactttcttctttcatttagcaggacaccagcttctggaatgttgctgcccacattcagagtgggtcttcccaccttagtaaaatctctttagaaacaccatcacaaacacacccagaggtatatttccacagggattctaaacctagccattccacaattaagattatccatagcactggcgaaatcgaagtgaagacttatttgggacgtcttctcaaaaaggagaggcacacccatgtctgctgttgtttctcctttctaggtctgaagcatgataaacatggtaaagacagagtgcagccagatcaaaggagccctgaccttcatatgctacctttggggccctagagttattttttccctagatttctaggcctttctttaaaaggcagtgactaaaatcttatttggaaaactgggagaccagatagagctggactggcacacccagccatgtggcctccctttctgcctctctttagcacctgatctctgtggccttccatctccttcacctactctaaattaaatcttgtgcatacctgaatctttctttcagagccaaccactaaaatctcttcgaaagctgttgcatctgtcttcatcaaccaatcatccagcttcttcagatcctcggttccagcccttaacagctcaacaagccaaaaattccttctcagaaattcggattcaccctctgagtcaggccactggtgggagcagcaacatccggcaggagcctacaccaaaaggcagaccagcccttcagttgccaggtcagatggatcctggttggcacgtgtcctctgtgaccaggagtgccacagaggggccttcctattctgaacagctgggtgccaagagtgggccaaacgggcatccttataacagaacaaatcgctcacgaatgcca

SEQ ID NO: 124 - DNA, 50673 bp, mus musculus
taagagcgcgcaggcgtcacggagggccaaagcctgggcggttaggctgagccggccgagcgggccgagcggccggagcgggcggagcaggcggcgggcggcgggcagtgtagggatgagctacggagcagggaaaactgccgactgagcggccgcttcggggccctcgcttgtcgtttccgtctttattccgtccagagtccctcctggctcgcggacccgcccacccttcccataccgtgggaggaagcgcggctgcttgacgagttaggggctgaatgtttagctctcttgctcccctaggtccccagagacaagctggattccgaggtcaagggctccctctcctcctgcgccccggcccgggccgaggagtccgaccgtggaggggcgagctcgggaggaaagcagatgaggatggctcaggtagttccacctgccactttccagggtttttccgattggacatctctttgttttgatgtccgttaagcatcttagggcttccggtgaggtcactgatttctgaaattcaggtccacgttgacactaggtaacccatcattttctcttttcagtccaacatgccccacaagtctgatgtgttgagtcaagatgaactgcgcaaaaagctataccagacgtttaaggatcggggtgtactggacacacttcaggtatcagatttaggcacaatcgtgtcgttatacttccacaagtgtaacctttaaccgcaggtggctccacatttaaattcattcattaaggtagcacataacctgtataatgaacacattgccataaaactaagctgctgttacaaatcttgttcccagtctcgctttgatcatgctacgtctatgtagtgagcaggagggggacttgcgaggaacggactgcagagggtaatgtgagcagagtactgtggtctacatgtctgagaacaacaaaatgaagcccagtctgtttcatgatactccctagaaaaaaatctatagtggaatggtaccaggtgtcttgtcacacgcctttatcccagttcttcggaagcagaggaaggcacatctcttgtgagggtagctgggccaaatagccagttccaggtcagccaagacttcatagtgataccctgtgtcagtaatagtaagtacacataagatattttagagtgtggatattttaaatgaatagcaactgtttattagaacatcttaagtttgggtagcagcaagggatggagttagttcaatgtgtttccttacaatataccttttagactatattttacatatagaattggaaattaaggaaaggtgagcccaatttttcccactcttgttttactacatacaaatatttaagacttgtccggaaaatacagaaaggcagaagagagaaaaatcatatattataactacaaactgctgttaggcgtgtatatcattttaaaatttagattatatgaggatccttttcctgtttcctcaggttgcctgaaatccttattttcagtggcagcagattcctcctggtcagtcagaggtcatggaggtcgctgcctcctattgactgaggcttctacctaggtctccacctcatctatttgttgtacctgtcattttctgcctagtatagagaactcccctgtctgaggaaaaaggcctgagcatgcttgggccagtttgcagggttctgcttccttcctgagtactggggtgttaggccagggccattatgtcttggggtaagagcgtttctagcaatgtgtccatatggctagggaaggattgttggtgtgtatttcacaggcagtttgggaatatttgtttcatccttcacgtctcagtttgatttggtcttaagcaatggatatcattatctgtaagccctttgtgcaagtcttgttcccagtttcagcatgactgcttattcagtccattagcccaattggaggaaaagcagggcatgttttcattttctcaaatttagataatttttactttcttagttcaatgactgatagaggtgagttaataatgtaaattttatggaatttagtgcttaatttatactctccttttatttgaaatgaatttgtacttatagtcaattacaaagtcatttatgtctaggtacttttgttccctttgtgggtcttgtcataacttttgtggttttgaaacagtgtctcactctactgcctcaagcttaggtgatgtcctgactctaccttcctaggattagcattacaggcatcttctacatccaactcagtgataaaatgaaacttgtcaaatcatctgtttctttctttttgctctagttaagaccatttctgagatgtgtgttaagattggcaaatttttgtctcatgctttgagtttcaccaactttgtgaaaactgtccttccgtgctatatatttttaaaagattttatttatgtctgcctgagtgtgtgcacctgtgtagtttgtgtgcctgtacttgcatggaggcctgaacaggctgtctgattcctcgtgttagcaggacacccagctggcttattgcacagctcctaggatttaaactctaatcctcatgattacgcaacagatactcttaaccacttttttttttttttttgagacagggtttttgtagcccagactggccttgaactatgtatagagccaagggctaccttaaactccccattttatttgaatcacctgtttatttggtgctggagatcaaacctgaggtcttatgcatgaaaggaaaactactctaccaactgagatacatcactagcccccaaactgtttaggagcgtcatgtatatggagggggagtgcgctctctaatatatggtgtggaggccagatgttgatgtcaggtgccttcctcagttgcattttccctcagtgttttgagacaggttccgcattgaacctggagctctcttctaattcaggtagactagctggactgtgagccccagggatcttcctgtctttaccttctcagctctgggataacaattgttcaccattgtgcctggctttatgtgggttctggggaccaaattcaggtctttttgtttgtaaggcaaactactgactgagctctctcttcagcctgcaaaatttaattttgagtagatttccctagtgtattggctgttgggaagctctaagtcaattttgtgtctctactagtaagtattttttgttttttgtgattgtcaagagagcagttcatttataattgccgttttagtttttcttgctcttattttcctttcagcacacaccaccactaattttttcctttaggcaagttatcgtaaattcttctattggttaagctaggactgaatagaccatttcctcggtgtattacgcatttaattaagctacttctaaatttgattggtggaagatgctgcactttcccttttttttccttctttcttttttgctttactatgtcaggttgtgaatggtagataatgccgagtgtgtgtattttgttcagtgtaaatgtctttttaagtagagggttttagatatatgttctgtcatggtgcttatatataccatgccaaactcccaccatctttaggaattgagctggatctgcttacagaagatcatcatagccacgcttgttgactgttgatattccttcctaactgttgggtgggtagaatcatgggacctcctctggagtatccagtcactcctccctgatagttgtttgcagttctgctctgattgtacatggccccattctcaggcaggggctagagtatatagattggggaaggagtcgtcataatgggtgcggaattcatttgttgtggctgcttgctttaagggcatctacactgatacacataaaacctcactcatttctctgtaagcaaacctaataagctcagtcgctcccagagtgaacttcaatacgtcatatgtccttgggactggagcaggagggtagatgctgtttttgttttctaggaaagaggttttagcagcattctcccatactcaaggatagcagaaagagctaaagtaaagacccctttcggtgcttccttgtattaaataagttactacattttgtttcatccagagcctcaagcaacttgcttctaagttaagcacaattgtacatctccaaactatatgtcaaaactgtttaaacgtttagtagtctcgttaatttaggagatttttttcaagttcaaatgaatagtgccggtgttgtaatgtgaagaaaattatgtactctgaccctttatttcatcatttatcaatggtgaaaaatctatcttccagtgacttgacatatgaatgaataccctaagtgatagtgcattgttttttaaagaatgcttgggtacacgaatggctgtgcacatttccatatgtgaccctcagagacaactttttgggagtgcattctctccctccatctctgatcccaggtgtcagaagacccaggttatctggcctacctggcaagtgccttttttctttgagccatcttgccaacccgaaagtatatttttgatcatcttcttgggatatactagtttccctcctgtatgttatttctttattaagaactaaattttaaactgagtgtggtggctcacacctttattcccagcacttgggtggtagaggcaggtagatctctgagttggaggccagcctgatccatctatagagtgagttccagcacaaccaagcctgcacagagaaaccctgtactgggaaacgaacaagtgaaaaacagctaaactttattttgatcagtattatgcccaagaactggattgagccaatactttcatagaccaccacaatccacagttgaaatgaagtggcagaatatcctctttggcttgatttcctgataacaagcagttgaaattgcttttagggaagtcaagttataatctgtggacagtggttttgggagctgggaaagaaagcttttgcccaagtctactgagggggtaagagaaattgtgaaagaagtggtttctaccttctgcccctagacccagggtcattttgaaaattagaaagaattcagtgaataggacagatgtgtgtatatttctattctggtgaaatgtaactccttttgccttttttcctgtttttacactagacccaactccgaaaccagctaattcatgaattgatgcatcctgtattgagtggagaagtgaagccgccatccatttcagtggaagggagtgccctcctaataggggcttctaactcgctggtggcagaccacttacaaagatgtggctatgaatattcactctctgttttctttccagaaagtggtttggcaaaagaaaaggtaaagcctggtggtttggagtttcctttgacaatttcttcctctagtaactcaagtccgacgtaattaccctgcttgccccttgactgcatagcttcatttcttgttcatctttgatgcaatgcctgaacaaaacatatttgttagatgacaaatgagtaccaaaagtggctgttgttaaggctttggtatttcagtcttttgtaaaatagtgataagtgcaatcactaaatattttggagctaaaagtaatgttacattccatgtggtttaaattagactggtaactgccatttccgtaatgttaactgtgaaactgatactgtgctaggtacactgcagggagcacatgtgtttcaaatgaagactcagactgtagacaggtgaaatgattttgatttatacacagtgaatagcttctaaatagcattacagggcggaacattttgatttctaatgtgttagattgctgcagatatttctctgctttatagttacattagagaagtgcaaaatgcataatttaagaaaatctataaagttcccaactgtgaaagcacatgtcttaatcactctgatgattttaactagttctcatcaccactgaacgtaataatccattttattaattactttaaagtgattcttaacattctcagtacttgtcttagttagggttttactgctgtgaacagacaccatgaccaaggcaagtcttataaaaacaacttttaattggggctggcttacaggttcagaggttcagtccattatcatcaaggtgggagcatggcagtatccaggcaggcatggcacaggcagagctgagagttctatgtcttcatccaaaggctgctagtggaagactgacttccaggcacccagggtgtgattgttaagcccacacccacagtgacacgcctactccaaccaggtcacacctattccaaccaagtcacacctccaaatggtgccactccctggtccaagaatatacaaaccatgacattccactccctggcccccatagacttgttcaaacacatgagtctatggtgggccatacttaaacatagcataatgcaaaatgcatttagtccaactttcaaagtcctcatagtctatagcagttgcaacaatgttaaaagtccaaagttcaaggtctcttctgagattcattcaacttaattaactgtaatccccaaagcaaagcaggaaaccagctgggcaaactccaaactctgcatctccatggctgatgtcaaagtggtcttcagatctccactcctttttcatctttgttgactgcaacaaactgctttctcctgggctggttccactccctgttagcagctttcctcagcatgtatcccatggctctggcatctttaacatctttgactctccaaggcaatttcaatgttacagcttcttgtttcagtgtctgggattctacttgatcttttggactcctcctaagggctggcatcacttctccagctctgccctctgtagcactctaagcttaggttgatccacttcactgttgttgctgtgagttctacatctttatccaaaggctgctagtggaagactgacttccaggcaactagggtgaggatcttaaactagcacccacagtgacacacctactctaaccaggtcacacctccaaatggtgccactccctggtccaagaatataaaaaccatcacagtacttgtatattatctaagatagaattttgtttttggaatggttttaggtttgcagtagaattgagtgtggttttcgtaatactctcctccccccatgcagagtcccacactgtcaagatcccacatctagggatatattggatgcagtcaactatcccaaaatgacccataattgtcaatcaagtctgtcttttacaatagggttcattcctggtgttttctgtgtgtacgtgttgtttgtaattgtccaaaagttttaagaaataagaacagtgttggtgttctaaaggaagattggactttgaatatgctatactttattaacaactagattcaacttgatagcataaataatttatttttttaaactaggcatggggacacacatgtgtaatctcagcaatagacaacagacgaaaatcacaagttttaggtcagcttggtgagtcctaggctaaccagatatacatatataaccagatatagatatactgtcattaaaaagaattcacttttagctcatcttctttctaatgatatgttttataattttctttactgtgtaatagttatatagttatagtaataattaaacaagttcacatcactagtagtttctaataatataaatgccaaccagaactttttctttaaaaagaaaccacttgaaaatacattgtatcagtattctaagggtagttctagcacataatacatagaatagcagaaatacattatattaagaatatttgtgtgattaaaaatattcaggcatgcagtagtcattcatcataagaatagtaaaacctagagtttgtttacagttttaaataactaaggatcatgaaattcattcatatagccactggttcaccagataggtgaatgttatctataaggcattaatcatttctttcattcctgttagtatttggaggttaattacttcatttaagatattttatctaggcagggaagatcacttagtagataaagggactggttatgaaggtttgatggcctgagttggagtcccaggatccatacagtggaaggattaaactaatttctacaaattgtcctctgatctccacatgtatatcatagcatgttcataccctcctaacacatatacactaaataaatgtaatttaaaaaataacaaactgtttgatcttttgacctcaatatatttattgtaatttgttaacaacataaaagctttactttttcattattgggttaactgtaatattattttaaatctgaaatgagttttagttttatattcagtaacatcttaatcatttaaacttgtccacaagtttgtcttagttaggatttccattactgtgaagagacactgtgacactgtgacggaggcaactcttaaaaactacaacatttcattgggggctggatcacagtttcagaggttcagtccattatcattatggcaggagcatggcagcatccaggcagacatagtgcaggagaaggagttgagagtcttctgtcttgatctgaaggcagctaggagggaactttgttcagcaggaagctcttttcctccctgggtagagcttaagcataggacctcaaagcccttagtgagaaacttcctccagcaaggccacacctactccaacaaggctattactcctactagtgtcacttcccatgggccaagcatattcaaaccaccacagctacttaatcttttttttccttttttttctctttaagatatttactatgcaggatctactacaactcattcggattaacccctcatccagtctctataaatcattggtaagattgtttttatgatctactttgatttgctacttttataaatgagcagttaataagagtaaatattttcttttaacagatttcaggatttgataaagaaaataaaaaaggtaggagtcttcatctttgtggggaatagcaagatatttatatgtgctgctgcttacaaaaatgcaaaccttgtgcttatcagggagaagaattacatattatcttcataaagatgggttatttctcttatatttctctttgtaataagtcttagatattcaggtatgaacactgcagacagtagtcaagagcctagcatatgaaaatgctatttacagaatacctgctgtttagaacatttatacagtaactccctcccctgaaaaacaacaaaactagtaacaggagctcactatcttttttatattagatagccccctcaaatggaacttatgaaggggtacaaatggaatttatgaagtggtaaatgtattagtagtttctttaaactattaatgctttcttattaattgagtttttatactttcttgataaattgccgcacgcctggccttgataacggccttttatatagtatattgttacagttgccagactgtattttagacttggtaatgagctttgtgtcctaacctggcaacttagctgctagtgatagttcctttgctctttttaagtactctgtgacatgctgctgtggtccttttgtgtttgaatttttgccttgccatccaggctaggatgtttataagttggtacttaatgaacaaatatttgcatgtctactttcaactagccattagtctttgacttaattgtcagttaatgctcgtagttggtaagtaaattggcttacaaggtgttgtaggcttcctgcaacagagatcctccctattgaattccactatggcaactgagcctacattccacagtgagacagattccaaaggctaacgctggatcagtctggacaacaaaatacaagtgaatcattactcaaaataaaagatggctatcttttattccattctgctaaggaaatgaatagataagaccctacattctgaactctaaggcagtatgctatttagtgtaagtatgctttattggaaatgcccatctctgctgtctcatgtggtagccactaaggtcatgtgatgcttaaatagggctatttactctgaacagtgaacttaatttttgttgaatttaaattcagttacccacatggctgccatactagaaagcactgttccaaactatataccactaatagctgttgccaaaatattgagaaggaaatttagagcttgaagtaatatttaggaataatccactgtactatagcttaaataatattgcccatgtttccatattttcttaagtgtttctggtacaaaaaacatctgactaacacttgctaccggcttactgagatagcatttctgggacatggagaaactgagtagcaattgtgttaagcatccaagtgccaaaatttgggtagagctctgtggataaccagtaatcttttgttaattttggcaaaaatgagtacaaagagaactacagttgaaatttaggagattaggtgatccctggatggaatctagactgtggccaaacagtgttactgttatggtctcccgtgggcttgagtgctgagcttcttaactttgaaagttagtggagcctaacagttgaattggactggactgtgtttgatagttatgtgcatagtaggacttagtaattattgtgaagttgcagttaagtctatagggagcagatagtaagagccagctttcttactgttggaatgttcccatctcactgttagaatgacccatcgagatgggtcagcacataaagttccctgttgtcaatcctgaccatgtgagttccatttccaggatccacatggtggaaggagaaaacggactcccattatgattgagagtttacatagttagtgtgtgatttttagataagggagtagtgtgtttggaaggagaagttaaaggaagctacagttgtgggagtagaattttaaaatctttaatagaaagggataaaaggttgtacttaggctgatgaagcaggagtcctttcaacttgtttacatcattcttgaagaacatatttaaatcccttttttttttttgttttgttttcgagacagggtttctctgtgtagcccttgctgtcctagaactcactttgtagaccaggctggcctcaaactcagaaatccgccttcctctgcctcacgagtgctgggattaaaggtgtgcgccaccatgcctggcacatatttaaatccttattgaaggagatcagttgttgcttgctttttgctataagaagcaattaagtgcgcatcatgtatactttgtgcccttacttaaaggtaggatagcggtgtaagctgaaaatgactaggttaaaatatgagcacactaacaaattgctctccttgattcccatgtcagcacttgacattatcattgatttaatcttaatagtgttatgtggaaaatatggtctctcttttattaatttgcacttatttatgggttttgtgtatttgtttaacatttaaaaggtattcatttttttctatttaaattttcttcctgtgaactttgtccttgtcttttcctactttttttttttttttttaaagatttatttatttattatatgtaagtacactgtagctgtcctcagatactccagaagaggggatcagatttcgttacggatggttgtgagccaccatgtggttgctgggatttgaactcacgaccttcggaagagcagttggcactcttaaccactgagccatctcgccagccccccttttcctacttttttttactgatttgtaagagttctttgacattacaatgagacttctccttctttcctgatatatcatttgtcttttgagtttatcttatgccatatgtaaatttatgtattttttttgtggttatagtgatctctatttcttttcaggtttatatcatgcttggaaagaccttcccttggtaatcaaatgatgatgctataaatcaagactcataaacaacaataaaaaatagctgaatgatgttcttaaacaaaactatgtatgttacacttttaggttttcttatgagtttcttaaaggagttggcagaatattatcaagctaaagagagctgtgatgcggaaactcagacaagcaccacatttcccagccaagtgtccctaggtaattagagctttcttcaattctgctagctagcttgttaatatttttgtgtttgcctgattattttacaatcagggtctcactatttagccctgcctggatttgaattcactgtgtagatggaactggcctcaaactgttgattgtcttgcctctacctcctctgaatgctggtatttacaaatgcataccacctcacttccttacttgtggaggttaacttctcttaactaggaaactcatgacttctctgactatatttttagtcattaaattagtatatgtttttgttagtgttgtgttgctgtgaagaaatgtattttacatggggcttgcttaccgtttgagaggtttagtccattgtcatggtgaggaggagcatgggaacatccaggcaggcattgtgctggagaagtagttgagaattctacagtaagatctgcaggcagtaggaagagagagctcctgggcctggcttgggtgtttgcaaccataaagcccatcctcagtgacacaattgtgcctgccacaaactctcaatattttaatctactcctgctatccctttctttccctgtgtaccctttggtgatgtgtgtgtgtgtgtgtgtgtgtgtgtgtgtgtgtgcgcgtgcagctgtactccatgttgaagtttcttctctgcttcacagttggtttggctctctgtttggtttaagggctaagggtcttgggaaaagagatctggtatgagaaagttagcaggcctcaacttgagcctggttgtgctatagtcgcttaaccccctggaagtcactcagactctgtggccatttgttctttatctgtagaaggcaagaattagagtacatagtttttatacttttaaagttcttgttttgaatgtgtgtcaagcttaattcaagtccagttcaagctttctgcacttaaaaaccgagaagaggattactttgtatttttccccctccaatttattatcattttcaaacatgcagaacagttgaaacaatgttaacagtgactacatagatgctactgtggaatttgcattatacttgttcatcacttatctgttcacttatctcaggttttaaatatatttcaaagtaggtagcagacatctctacacctttcttttagtgtagtctgctttgggcctcttgcatagcttactgagttgattttatatttcctaattggctgtgttatttttttaatagccgagaagtttcagcttattgacgctcaatttgcagatggttttcctcaccgttccaagctagaatctttagagacaaagttaaacgagtataagaaagaagtacaacaccagcttcaggtagaaatgtgtcataaggtaagctgtagtccttgctgctcttgatgagagccaggcccacttatcttctactagcttaaccttggctatgtggaggccagctacagccttttattaagaaatgaagtgaatgaagagtgaatttatactgtttttaaggaactatttttagtctttgtgctcaattcatagctgaagtattttagagaagctgaaataacaaaagttaagatggaagagagaagaaagtatgaaaaggaattggctgagttccagaatgaatttgaaagaacttgtcaagcaaaaaatgaagccctcatttctcaggagaagaattctctggaaagaattaaaaaacaccgagaggtaatatataggcacaagttactgggtgtttgtgtcctgctgctgttagtagctttgtggaagatctagataggacagtggatggaacaaggctcttgaggggcaggtagggctgctatcaggaatacagacaagctcatggagactttgctcagcagtggtcaaaaagaaagcactggggtgaatgtcctcactgattaagagacactcagcacacaggctcaaaacttgtcaggcaaattggagaggacttcaaggagaggcttggaggtaagtagtttctatggatgagggggagtagcagaaaggatgttaacattgtcacacccagctgaagcagcagtagccaggaaggggcagagcaagccatgtgctcttgtgacaagaggtttctgttctggctctggggaggactgaggggaggactgatcatctatgagcacctgctcacccctttctgtgggatgagaaagtagaagggattgagcaatggtgttttgctaaacttcatttgacctgagaaaggcagcctcaggaattaaagaccttggtgctctgctcatggatgaagaaagcaaagagaagcaggtaaaaacgggagtggcccccatcctgaaggaaatgaagggatacatggcagtctcagaagtaggagtagggtctgagtggctgtgttcagagttgcccgtttgtttgctaagagaatgtcttcagtcaaacaggacttgcagcactgttttcagtgttcatccagagcagttgttagaaaatgttcgaaataggaatccttccccttagatttcatccttgctggcgcttttcagtaagagctgttatccagcatgatataggactcttgtactatgtatctagtgtatctgggaaatgaactattttcatctatgaagacaggcatagatatttaagatactggttatgtttagactaataactttatttttcatgtaggtgactgccaaggtccccatttagttaatattacctgcaagtattaaagattatcatcatctttgcctataccatgcctttggacgcttgtccatatctgtccctgataaggctgtattgttcttcaaagacctagccatctcaagtggcttcttacccagctcactgagcgactcatacatgtgctattcctatatgtgctctttgtatacttcagttatgaaatcatttcatcttttcgtgattgtttctctctccctcaaccaaattgtgagctctgtaaagatgaggaacttacctactcctcgtggtgtctgttcacggatggggtggcccattcactgggagttcacctaagcctgtaactggactcagaatgatctggaaacaaacatttaggcatcaccatcaatcaccaaggagattatcttctttgggaattttattgctgaatgtgcatatttaaagtttttcttcctgtacttacaaatttttgagtaagggaatatgagggatgctaaagagctagattctatattcctaacaatggcaatgtagtttaccattcattgagggactcatttttttgtgtggacaggaagtatatttttgtgcaaaagcaatcttcatcgaaatatcttccaggagaaagtgttcctctaagtatctgtagctttcattgtgttctagaataaggaagcaatgtctgagttccagggtttcatttaacgttgcttgcttgctaaaagtaaatgctttcctatgcagatggaatcaaaagaaatttatgctcaaagacagcttctactaaatgatatagctttgcttagaggtagagaagcagagctgaaggagcgaatcgaaacttttgaattgtaagtaataaatgtgttctttttggacatgaaaaagttatactaagtattatgtctaagttttctagctttttctaaatgtgttctttttggatatgaaaaagttatactaagtattatgtctaagttttctagctttttctaagagattgtgtgtgtgtggtctgcaaggttacatgcaggtgccttacccatgtgtgtctctaaggtcagaggtcaacgtgaggtggtttcctttatcagtcatctccatatttttgggggggggtggtctgtcttacattggtaggctcagtgattgactagactatctggacagcaagctttgggcatccaagtgtctctgtcatctcccacaccatgcctggcttttttgtggtgctggggatctgaatgcaggtcctcatgctttcacagcaaacactttatttagtgagttatctccccaggcaaagaaaagcccagtgtggtagtgcatgtctctaatcccagcactctgcgagggggaggcaggatggtagtgcagtgtggtagtgcatgtctctaatcccagcactctgggagggggaggcaggatgatttccaagagtttgagaccagcttaagcttcatggtaagttctaggcctgcctagatatttgaatcaggtgttcagacctgctactatactgaaaaagaaaaaaccaaaatagaatagtccacttgacttgtcatggatggagctatttctcatggtgttaataccctgtctaaaaacaaaacaaaatttccagggagagttcctggctctgaaggtgatatcaactgatttagaaggtataacttgggatttttcttgtaaagtattagataattagttggaaactatggaaatatttctgtcagactgccctgaggctggacaacttggctattctcctgatgtttctatagctcgtgtgctttgctgctcccttagttatcagacctgatagtctcatatacgtagctgaacaccaggcaccctggcctactccatttacctactttgtactcccgtaaggaactctgttctaagttggctcatctgctatggagatatttctcatgatgggggcagaggtgctacttaatgttttctaagtgctcaggatgcttcatccttcagttcttacctgggactgctagcaaactcagaatctgtagtgtatatatcctttttttcctaattagaatttgctattagcattcatatgttctttagaagtcttgctacattaaagaaattctttttatttgtttttgtttttttttttttttttgtttttgtttttttgagacagggtttctctgtgtagccctggctgtcctggaactcactctgtagaccaggctggcctcgaactcagaaatccacctacctctgtctcccaagtgctgggattaaaggcgtgcgccaccactgcccagcattttttttttttacttttttaaagatttatttattattatatctaagtacactgtagctgtcttcagatgcactagaagagggcatcagatctcattacagacggttgtgagccaccatgtggttgctgggatttgtactcaggacctttggaagaatagttggtgctcttaaccactgagccatctctccagccctaaagaaattctttattggtgttttctcacttctgtacgcacagttcatttgatttcttttctacttaacttttaaattttttattagatatttactttatttacatttcaaatgttgtcccctttcctggtttcccgtctgaaaaccccctatcccttcccctctccccctgctcctcaacccacccactcccacttcctggcccagtcattcccctacactggggcatagagccttcagaggaccaagggcctctcctcccattgatgaccaactaggccatcctctgctacatatgcagctagagccatgagtcccaccatgtgtattctctagtcccagggagctctggaggtactggttagttcatattgttgttcctactgtggagctgcaaaccccttcagctccttgggtcctttctctagctccttcattggggaccctgtgctcagtccaatggtacatttacacaatggagtacttactactcagctattaaaaacaatgattttatgaaatttttaggcaaattgatggaactagaaaatattatcctgagtgaggtaacccaatcacaaagaacacacatgatatgcactctatttaacttttttttcccattttttattaggtatttagctcatttacatttccaatgctataccaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaactctaaggaggggcatagtgtccacacttcagtcttcattcttcttgagtttcatgtgtttagcaaactatatcttatatcttgggtatcctaggtttggggctaatatccacttatcagtgagtacatattgtgtgagttactttgtgaatgtgttacctcactcaggatgatgccctccaggtccatccatttggctaggaatttcataaattcattctttttaatagctgagtagtactccattgtgtagatgtaccacattttctgtatccattcctctgttgagggacatctaggttctttccagcttctggctattataaataaggctgctatgaacatagtggagcatgtgtccttcttaccagttggggcatcttctggatatatgcccaggagaggtattgctggatcctccggtagtactatgtccagttttctgaggaaccaccagactgatttccagagtggttgtacaagcctgcactcccaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacattttttcaggtgcttctctgccatttggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaatgttgatggggattgcattgaatctgtagattgcttttggcaatatagccatttttacaatgttgatcctgccaatccatgagcatgggagatctttccatcttctgagatcttccttaatttctttcttcagagatttgaagtttttatcatacagatctttcacttccttagttagagtcgcaccaagatattttatattatttgtgactattgagaagggtgttgtttccctaatttctttctcagcctgtttattcttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcacccttgtctagtccctgattttagtgggattgctttcagcttctctccatttactttgatgttggctactggtttgctgtagattgcttttatcatgtttaggtatgggccttgaattcctgatctttccaacacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaagcctacttggtcaggatggatgattgctttaatgtgttcctggattcggttagcgagaattttattgaggatttttgcatcgatattcataagagaaattggtctgaagttctctatctttgttgggtctttctgtggtttaggtatcagagtaatagtggcttcataaaatgagttgggtagagtaccttctacttctattttgtgaaatagtttgtgcagaactggaattagatcttctttgaaggtctgatagaactctgcactaaacccatctggtcctgggctttttttggttgggagactattaataactgcttctatttctttaggtgatatgggactgtttagatgatcaacttgatcctgattcaactttggtacctggtatctgtccagaaatttgtccatttcgtccaggttttccagtttcgttgagtatagccttttgtagaaggatctgatggtgttttggatttcttcaggatctgttgttatgtctcccttttcatttttgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagagctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagtcttaggccatggtggtctgataggatacatgggacaatttctatatttttgtatctattgaggcctgttttgtgaccaattatatggtcaattttggagaaggtcccgtgaggtgctaagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgctttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtctatttgcttggaaaattgttttccagcctttcactctgaggtagtgtctgtctttttccctgagatgtgtttcctgtaagcagcagaatgttgggtcctgtttgtgtagccaatctgtaagtctatgtctttttattggggaattgagtccattgatattaagagatattaaggaaaaatagttgttgcttccttttatttttgttgttagagttggcattctgtttttgtggctgtctcctttttggtttgttgaatgattactttcttggttgttctagggcgtgatttccgtccttgtattgcttcttttctgttattatcctttgaagggctggattcgtggaaagatattgtgtgaatttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctgcattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgttttgggttttctttattgtgtctacttccccttttagttctaatatggttttgttcatttccatcacctgtttggatgtgttttcctgtttttctttaatgatttctacctgtttggctgtgttttcctgcttttctgtaagggcctgtaactctttagcagtgctctcctgtaattctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttaagagcttgttcttcaggtgactctgttagcctctataagcagacctggagggtagcactctccttagtttcagtgggcagagtattctctgcaggcaagctctctttttgcagggcaggtacccagatatctggtgttcgaaccagactcctggcagaagttgtgttccactcactagaggtcttaggatctcgtgtggaatcctgtgtgggcccttgcgggtgtcaggcgactccactggcaaggtagcccggggctcaagtggagtggaaggggtttgtgccccagatcaagcccgggtagcctgcttccctatgtaccgcagtctcaggttccacgcgattggattggggcaggtgctgtgttccactcactagaggtcttaggatcccgtggggagtcccgtgtgggcccttgcgggtgttgggcaagactctgctggcaaggtagcccggagctcgagtcgagcggaagggacttgtgccccagatcaggcccgggtagcctgcttcctctatttaactttttaaatgcacttctctcccctccttctaagcattcatgtaaattaagtgtaatttcccagctccatgcctttccaggttagccagcagagggtgctagtgctgatacctggagcttttgcttaattcttgaagcagtgagctttaggtagtggttctcagaatggcttgttctctgcagtacctgggaggtagagaactgctagtactacccacttaaatctcactaggaaggccttgtaggctcaatgtatagaggaataggacttctcctcaccccgtccttccctccctctctccctctattccttccttcttaactcccttctgtcaccccctcttttgattattaaatgttgaaagcaggtcttaagcctttatctgtgaactagtgaattagatccagcagtggtaaagaatattatagaacaaacagttatgtgtgtaagctaacttgtttgtgcttttgtaactttattctttacttctaaattgattgtggccacttaccatctatagccaggtttttgttatgctttagggtttgttttttttttttttttggttttgttgctgctgttttgtttgtttgtttgtttgacatatgttttcattttgtttttaaccctggctgacctcaaactcactatgtacaccaggctagccttagacttgcaatgattcttctgcctgtctagtgttagaattataagcatgggctcacgatgtaactagtttgttttgtgtgtgtgtgtgtgtgtgtgtgtgtgtgtgtgtgtgtgtgtttaattttaaaactaggggttggagagatggctcagcggttaagagcactagctgctcttctagaggttctgggttcaatgtgagtaaccacatggtggctcacaaccatttgtaatgggatccgatgccctcttgtggtgctgtctgaagacagctacagtgtgctcataaaataaataactcttttttaaaaattaaaaaaataaaactaattaaaacttattggtgtgtgattgggttcatgcatgtcacagcagtggaggttagaggacaacttgtaagagtcagttcttttccttctatcatgtggatgtgggtcctgggtatcaaactcagacttggcaccaactgcaaaaagctgccctcctaggcagttttgaaatgttagctctctcctgtaagaaaggactatggcgttggctccttcccacttctttaggccaggtacccctgttctgctccctcttcagtctgacatacagtaacgaggtcagtttgtaaaatacagggagactttttcctttacttcctagttaggacagtcacagaaattgtagtctgctttcttacaaaatttttttgggttaatttcaggacccagaagctccaagaagaaaaaattaaaagtgaggctgaggcacttgagagacgggaacagaatctgaagaatattgaagacacctatgatcagaaactcaaaactgaactgctaaagtaattgttgggtgttttaaaaagagtaatatgtttgaattaagttggtgaaaatgtagccaaaattgatgaagtaataagacgaatatttacatgacaaaattcagtgtttgagaaaaactattttctttgacaaatcatagctttgtgataaatatttaagaggtttctaaagcttacagtgtagagaattacatcagatactcttattcataactcctcgggctgtgaggaattgtgaggactttaaccttacatatgtaagtgtgtattagattatataattattccattgttttaacccttggatgttatacacattttattttatttttgagtctcttttttttctttttccaattttttattaggtgttttcttcatttacatttcaaatgctatcccgaaagtcccctataccctccccctgccctgctccccaacccacccacacccacttcttagccctggtgctcttctgtactgggccatataagtaaccttagggcaccatatgtcttgcttagtttgtgtagctgatcaactgtaaaattggaattcggattactttagtcatcgttgtcatgctgccactgagatgaatgtcagtaacaattgcaagttgtttaaggtagaatttgattgagaacttgagctttgttctctcaagactccataaagccagaatcaaaagaagggagctaaagtaaactatatgaagcaaaaggtgatgcagggaaatgaaaaatgacagctacagttaatttggtccaccccccttctcttctgcttcttgctatgtagctcaggttgacccaaaattcttgattcttttgctctgtactcccaagatcagtgatagcaaatgtgtgccaccatatctaggtactctagtctgaattttatgggccagtgactagaaccccagagcaaggataattggatggaaatttttctcaatggcaggtgtatttgtcccatctaataacctttaatatttgtctttggtttcagcaatggtaggggtgagggatatttattacaggagggtttgtctttctttttgtccatctctgactagtgataactgaagaaaataagtaaaactccatggtaacatcccctttgctattgctgatatggatctaataccagtaggctctcaattgtaataaaccctaagaacaaaagttcttgacttggttggaattggggagattgcacaggcagattacaaatgactgaatgccttgccatctctggggacacagaatctgttgcatgttaggtaagcttttcattgtttccttttatactctctgtataaattgagaccagtggaaaagtagttgtttccagtaaccccacgataacatccttcattttgtgtaattgagtttgggactatatttttataggatggagggtttattggacctttgatgtttaaagttctcttgcctggccttagaactgagactttgaagtttctcctaagccatgttggtagtggggatgctgggccacagataagctcctcaggattagtggtctctccaggtagatggcaaggacctcattttagtcattctgattctcaggtaccaactggagctaaaggatgactacatcactaggacaaataaactcctggaagaggaaaggaagaataaaggtgatgtggatggatggctcattgcagttctgatacaggctactagcctcctaagttacatctgtgctatattctttttggttgtttcttgttttggtttctcaagatagggtttctgtatcctggttgtcctgaaactcattctgtagaacaggttggtctcgaattcagagatccatttgcctctgcctcctatgtgctgggattaaaggtgtgtgccaccactccctggcatctcttgtatatatctcttgttcttaaatttggcttccacttattatgaaacatttatttacatatttatttgttagggggcgttgtatgtgttaaatagtgtgcatgtagaggtcacagaacttaatgggacttggtttttgtcattctacagttgggtccctagcattgaaattgggttgtcagacatagcagcaggtgtttttacccactagtccatctcactggctcttcatttcttttttaaagatttatttattttgattttatgtgtgtgagtgttttgcctgcatatatgtctgcaccatgtgcatgcagtgtccgtgaggtcagtaaagcatattggatcccctggagctggagttacagattgtgagccgccatgtgggtgctgggaattgagcccaggtcctctgaaagaacagccagtgctcttaactgctgagccatctctccacctccattatagaaaatgttactttctctgtcctgtgaccaggtttcattgtcctttttttcttacatatctttatacttcctaagcttcaagtttatgttgatttgagtctatgaaaattgaataagtttttaattttcacatattttactttttagtatatttgtaggaaattgtgaaaagagcatgatctttggaaatttcaaacatttttgaagtaaactagagctgcttattttattgactagataccaactgtgtggctccttttgctcctgtcttacagaagcagatgcatcttatagtttagtgccctggtgtatttagatttagtaaattttcttttgatatatatctgcatagagttttgttacaggaaggaaaaactacagaaggaaaacagatctttgcttttaaggaaagtaggcactcttaacattaaggtctcatgcccttctcagagagagtaactggttagcatgtagtaggaattttaccgcatatatggcagttgtaatttggcatcactcatgggtaatggaacttacttcttatttgctcactatgattttggctgataaacttgttgctttaaactatgagacagtggtgattaggtctcacagagtggccaaaaattattaaatgtcttttatgttcagtaggaaatcattatttaattggttcttctttattctccagaaaaaactattcatttgcaagaggagctcacagttattaattcaaaaaaggaagaactcagtaaatctgttaagcatatgaaagaagttgaggtaattgttaaaccttaactttccttaatgacatgttagggttaatgcttttttatttatagagaatatagaggtgttttaagatgtatttatttttattttatgtgtatgggagttttgtctgcatgtatgtctgtgcaacacacgtgtacagtgtctgtggagggcaggagatccccttggactggagctacccagggttcttagctgccacgagggaatctccactctgggaatggagctctggttctttggaagaacactcagtgctcttgacattgaactatgtctctacctccttatgccatctttttcatctgcttggactgattattttatcactaagaaggtgatagctgaagttagtagagtgggttctaattttaagcaaatagaaaaagagcttggatctaagaatcctgctgcttaaattatctctcccttcttaactgcttatgtgcctttaggcaagttctgtgactaatcttagagatattactaacaaagcatgatcgttgggggagttgggtgatgtacccataacaagtgaccagtagatcttattttctatcttaccagcaagggataagtgagaccccatctaaaacaaaatgaagtggattctgtaggtgaagtttacctttgcatccttgggacacattagactaagaaaatgaaagcacctcacaacagtagagactgtattcaccttttatctgtttaggttttttaaatgtcttgttatatcatgcagttgtattggtggcattttggagttgactccaaattgcgttcaccatatacccttccctcacttcataggacagatatctattgctataggttctgagctgctggcctaccactagtgcagaagagatcctgttgcagagatcttgttacccatgtctggtagtcactgtcattcatttgtaatgctcagattcagatagccttccagccttaacttttgcagtgctgtgaacgtttcagatacaagttttcccttttcaattttagctggaactggagtctgtgaaagctcagtttttagcaatatcaaaacaaaaccacttgctgaatgaaaaggtgagagagatgagtgattactcacaactgaaagaagagaaagtggagcttcaggcacaaaataaactacttaaactgcaactggaagagactaggaatgaaaacttacgactcctagaccgtaagtctttttctgtgatctgcatgtttctgtaatttcgactaggtcaggattatagaagtactacctatctgtaagggaggcttacattgggagaatattttaatatcctgacattgaagttgcttacgttttgtttgctattgtatagttaggagtttcatttaagtaatatttgttaagtaactgcctctgcgggtatcttcagggttcatgccctctgactgttgcctcaggaaggccagtaagcacttggagcaaggcagggagaagaggttaaaattgtaatcatttctattcctagccttggcctccaggtacaacagtctggactgcctgcctactgtgattctcaaccaagagggctcatagtcccttcttggtgccttccaccagtgctctgtgcctttgcttactcagtgtacctctggaagttgctccctctcctaagcccctagttctaagagagtcctaacattctgacccagtttctactacattatcctttatgattaccctacataaggcacactttacgaaaggggcctttgggtgacccagatggagagcaccatcaaccttatttctggagcttaaatgccatgggctgctgttcatatgacatgaaaccaaggaccgcactgacaggttggcgagctctttgttagaataccttctgcatgtggtatgagaaagagataggctattgggttaatttaagaatttgaaagaattctttatcttagagggctttcagaggaatccaattatattaacatgcattaaattattctgaaatttgtgactcaagatggttcttaggtcacttaataggattagtagaatattaattgcatgagtacaaagaaagaaaactattttaaacctctctagctgctttttctttttagtgagataggcaaattgaagattgataatgactaggaatttttttctttttcttttttttcccttaaaccttcttaggcataactcagccacctcctgagcttgtgatttttcagaaggaattacagaaaacagaaaaggctatggaactggagcacaaggactttgaaactcataggcaggctcttgagaaacagctgcagagtgaagtgagtgttggtctttattcttatgggaattatgccaggctggtttatagtagttatagaaagcttatacgtatcgagccagtgaaatcagattattggagtacaaataattccttaccccaacattgcaaaagagcctttctcatgtgaggaaattctctggtgattttgacttcatgttcctaatgataatagcactggaagggaagcaaacttatgtaggtagacctaaacttctcagaaatcctggtaattcccatttgtggcttacacacatctactgtgtcactgtaatttcttcctgcgagcaataaatagaatagctgattttagacaggtggcacacacatttaatcccagcactcaggaggcagaggtagatgaatctccttgagctctacaatagagagagaccttgtctcaaaaacacaaaacttgtttgggtggagtttttttgtttggttggtttttggtttttattttgttttgtttttgtttttgaggcaggctatttctctgtgtagccctggctgtcctggaattcactctgtagaccaggctggcctcgaactcagaaatctgcctgcctctgcctctgcctctgcctcccaagtgctgggattaaaggtgtgcgccaccatgcccggctgggtgttgttttagtaagggtcatcctattgattgttggtgtaaagggttcttagaattgacaaaataaagaatataagtacaataaaagacattttctttttagagcaagctgtaattgtatgtatttctttttcagattgaaaattctgcacagctaaggacccagatagcagaatatgatgcttctgtcaaaaggttaactgttcaggtggctgagttaaagtcacaactaaaacaaactcagataggttggagactttttaaaaaaataaattgtttattatgtgtgcatgtgcatgtgtaagagagagaaacagatactgagaacagcagagcactgtggcactctggtggaggttataggacttttcaaggcttagttctctgcttctcccttagtgggacagtgagtctcttgttttagtgtctgcactgcctactccaggctagctaacctgtgcagtacttacccattgtcctgctgctcctacctctaacttgccataggaatgcagatgtgtgcgcctacatgtagcttttttctttaattctttgactatttcctagatgtataaagtatatcttgatcatatccacccttctctctctttctagcttctgcctcccatcattatattttcctttcagcttcaatcctctttgttccttatgtaacccactgagtccaggtagtgttatccatatgtacatggttatgaggtcattccctgtggtataggcagcctgtcaatgccaccaccccaaaacaactgctaatcactcctcagctaggagtgccccacccagcccccagtgctggtattgttaattgtcttgttgttgtgcagataatcatagttactctgagtttacatgtgcaacagctatgtcatggtccaggagacagcattttacagcacttgttgtcatctgccagggtttacattcttttcataccctcttccctgagcttctgggatgtgctgttagagatgtcgctcctatgggtcagcatttgcaattgcttattcttggcactttgaacatttatgagtctctgcattaaccattacccactgcaataggaaacttctctaaccaaggttgtgagcagaacaactttatgctcatatttagattgcagtttgacatcatagccgtttaaccaacatcataagcaacattaaaagatttcctcttggacctatgatttctctacccactttttttttttgaaataaggtctctctacatcgtcctggctgtcctggaacttactatgtagaccaggatggcctcagactcacatagatccccttgcctctgcctccatagtgttggcattaaaggcataaaccaccatatctagctacctgtttttgttgatgtttgttttttgaagatttattctttttaattttttatgattataattattttaattttatgtatagggccatttcaccttgttccttacaccttcactagtttatttctaggtctttattcacttctaaactcttttccaatgccttgttttctgttagcagttgtttgccagactgtctgccactgaagttataatggtcttgtaatgcgaaagtcattcagtgaagctaggccctcctgcagtccttcacatacgtggcctacctctagcccattgtacacttggttttgtagcatcataaggggctgttgcagggttagaggtgacatagacacgtgctaggaaatttcagcagctctaggaattgctgaccatgtggttcccatgtcaggaagaccctgtcccctttcccagcagagagcagtggcattttttggccagtttggccaggttatttgacacttgggcttggcaagagactaaatatattgcagtcagatgtgtgaatattctcatgctggttggaataaacaaagattaaatgtgtttgctatagttcagctctggctagactgtatgtagtaaattatatattttcacttctcagacgtagttattgtagactcatgtgtaacagattatgaaatttatcgtgtttataaaggcttggtacatgaaggcagctttcagtaaatattaatgagtatgactatggattcagaaactgtttaatatgtaggcttgtttttaccacttgaaaaaatattcctaagtataatgtaattttattcatagcctttttgccccatttctcaaattttctttttgtgatctgcagccctagagaatgaagtgtaccgaaatccaaaacactctctgattcattccctgagtggcctcctattgagcggcaagatggcaccccacagtgaagataaaagtggggatttcttgaatgtaccccttgaacagaacaaggttatagcaggtgcagttatgtcaagggtcccaccttatgtaaatacagcaacagaagctagttccccagagtctgactttgagtttatagccagtagtactaaagccaaagtaagagagctagagcaagaggctgaacgcttggaaaaggcattcagaacttactatcaaagagctactcagaatccttctacgagccctcagccggcaaagagtcctccatctgtaaactcggtggcagctctcagaagcatagcttccagttccatggacagacctgtttctgcagaggacagagttgtctcggaacagcctcttggggacatgctgaaggaagaaatgagtgatatgtccaaagcattcatgggcagtgtggtttcacggccacgcaggacctcttcctccacacgcctctcctctacaccccatccaaaatcgagaagaagtcttgataatgaaatgtatctggaaggtaagccactgtgcagagggttgtgccatagatgctttagacttgggcagcctggggaagtgagctccagcactggtggctgttctcatcctgccatactctggtcaacagtactagcccttccatgtcacaggatagctgtggaagggtgtgaaggtctagtttctttagcacgcagaagtgttgagggagcacatggcccttgtcttgctgctgattagttctctatgctccatgttacttgtacagtttgattttggtgcttgaacctttttggttctcatacatcaagcttggctatttgcaaggattatgtagaatttatttcaaattaatagagccttaaaaaaaccactttgctatcttctctatgcagtttgtaatgcttttgccctgattcatccttcctcataggtctcgggagattacacatgacttcctccagccctcttcttgacagagtttctgcatcacctgctgcttcccctagtccttgtcctgagagaacagcccaggcgtcacctgttccatctaggcacagcttctctggtcttccagagcaaaatgcctggtaagttattttcccctcatcttctgttgaatcaggctactgacctgctcttttgacctttactcctttggtctttttaaggcaatgacaaagatcatgtgacagtctggaatttacagttagactgttgagtcatttgtggtctttgaaaggcatttgaattagagagagagtgtgataattgtgtgaataaatatcttcctgggtctgtgaatggatttggttcataaagataaatagttgcttataaagtttgtcacagcaaataaattgggctcattttgagacttggagaaatttcacacatcaaaatgtcatttaaaaatatgttttgagggtcaggagtggtggcacacaactttattcccagcactcataaggcagaggtagatggatctctgcgttcaaggccagcctggtctacagactgagtaccaggactgccagggctatatagacagaccctgtctcaaaaacaaacaatgacaaaaaatgttttggcatttaaatgtaaacaaggtttcagttcgtgtatcattgaatcaaattgttcagcaatgatggacactagggtataactgtcaatgtaggaagaagttgatcaggccagcaggctgcctgagctgtaattcccaggcaggactacagtagaagattctcaatccctacctgtgggctccagttgggtacctgatgcttataaatgctgcctgtacatacttgaaaaactgctctatgtgtctaccatggtcctagggcatttatattctttaatatcttttagattgtagttttattttgttttcagacagactcatttgctatattgcctgggctggcttcaaactttcagtgatcctcctgcctgactgcttcttgaactctgaggtagcaggcatgagaccccacgcccagcttgtattgaattttcttatgaggaagtcaaaaagagcatcaagacccatattatgtaaagtcagtgtacgttgatacatcgtttggctgtgcagttgcatcttttttgtgctgatggcatatggaatgtgtctttagagaaaatgttttgttgttactggaaaactaccctaggaatagtattgagagtatgttattctttgcaacaatgtcttcttcaggggatagggtggtaacaagggagatgactgagtaaatatagactagttgccaagaacaatgcctggtggcaggctctgtcctctgaagccattctctctctcacaccacacacacacacacatttttcttttcatttttcttctcttttgaaatatattgcaatagaaactaggatctcatacatgctgggcaagcatttaatgtgtatgggtgttttgcttccatgtaagtctataccacatgccttcctggtgtctacagaggccagaagaaggtgtgagatcccctagaactggagttacaggctgttgcgagaagccatgtgggtgctgggaattgaaccaaggtcctctagtagagtggccagtgcaacacgtagagagccattctttataagccagtgaaaaaatgagtggcaaagccaaacatccttgctttccatataatccctatattcgggagtctgagatagaattgccaggagtttgaggtcactttggtctaccatagttctagtccagccaaagagaactatctttaataaaagcagaacgttctataaattatttttaacaactagacaacctattctcggctttttatgttgttattaacacttcatattcatgtatttattctttcaatctagtttatatcagagacaaactgaaacgcaagataaaagtgagctttcaaatgtggacaagcaatctttgaaagatgagaaatttgaaccacctttcagatgtaagttttgaatattaggttttgtgtatatatgttcatgtttacatatgtgccaagatacctgtgtagaggtcagaggacaacttcagatggcatatttcatctagcacctttaaagcagggtcttatcattccattgtataccagtattccaggttacctggcctgtgagttaactaatggatactctcctgtcttagccctccatcgtgctttagtcatgctgggattacagacacctactttcatgaccctttttatgtgggttctggggattctaactcaggtgcttcctccccttgcaaagcaagcattttattcatggagccagtctccctaaacacatagcattttttaaaaaacatatttacttttatgtgtagaggtgttttgcctgcctgcatgtttctgtgtcttgtgcccatagggcccagaagagggtgtcagatattctggggctagaattacagatgattgttaactgtcatgagagtgctgggtgctaggaattgaccttgggtcctccttaagagcagccagtgtactttttactgatgagctgtctccccgccccccaaccctagcacacacctatccgtttttataagtagaaatataggaacgctttcttttagcaaaatactcaaatgttgggacatgtctattttgtgacatggtacagatgcattgcttgatttttttccttttaaacagttttattgcactgttattatgtgtgtatgcacatgtaacatgtatgtgtatctgtgtagcacagcacacatgtgaaaatgagaggacaacttgcatgtgtcagttttcttggttcactctgtgtgtcccaggcattgaactcagtagtcaagcttagtggtaggcacctttacttgctgagctgtcttgacagccttgcttcatttcatctttctgtgacagaattttagggtgcacttgaatttcctttgaaaacaattggtatagctcatagtttccaagtaaagactaatgccataaagtgaatctttaatatttcaaggctggggttacttcaataagtaagtttttcattgttcactctttttcctttgtgtggaatatgaagatattttctttcagttatattgaccttggtgattcttcagatttaagcaaacttcatcttcattggtagaatggaggtgaaggaatgttcaaatgaggggctggggcagtggctcagtctataaagcacactcacgtaataaaggctgggtaagtggtgcaccctggaagcagaggcaggaggatgccctgggggttcactagccagccagcctagccaagtcagtgaactttcaggttgagtgataaactttgttacaaaacataagatggatgactgagaaagacactgagtgttgacctgacctccacatgactacacaaaaattaagatgagagtcaagacaatggtggcctggctatatagccttatatagtatcaccctactttatgagtataataaggatatagggtccattacctctgagacactttctagcttgagaatcttttacatttgtatataatttcaatgtcagatctgaaagaatcatattctgcatagttaaatgaaacaacttagtacattttgtcaattttttaacgcaacagttatgactttgttaaatcattatttttattctttgagaatttcatacacgtatacaatgtatttggatcatagccactgtctgttccccctcacctccttcttttttttttttttttttttaagcagttctttttttttttaagatttatttattatttattatatgtaagtacactgtagctgtcttcagacactccagaaggagtcagatctcgttacagatggttgtgagccaccatgtggttgctgggatttgaactctggaccttcggaagagcagtcgggtgctcttacctgctgagccatctcaccagccccctcacctccttcttgactcccctgccacgactccctccaacccccaggtccagttagagctgtctacatgtgcaccagtatacgggtgtaggatcaactactagagcagcagtaacccagtaggagtctgtttccttaaaaaattacaaaaactgactccctactccagtagctttcagctaccaaagttctctgataatgtaccagagtgctgactagctttccattattgatgtttaaattgattcaaagggttttatccacaaacccaaatgaattctctattgctctattgatttattttttgcaaacaaatataattctttaaaatataaagaaacttgagagttaaatactttgtaagtggttggatttagaactctgtaggaaagagcagttttagtgttccatggtctatccctaccacttcctaactcccaagcactccccactcctgcactgcatagcactccctacacttgctactgttactaaggactcatggcacaattaattgtacctcatatggatgcagggaacaagacagaacagtttgaagcagaaggactccaccctgctggtgacatgcctggaatagattttgctgtggctactcagtcttcaagactcatttcatacgactacccaagtaagtggttccttacttaaactagcaataaacaatagctacatattgcatgctgatctatgtgctctgtaacttatttcctacatgacttctattattacatttatttattaaattatatatattggtgtatgtctgtatatatgcatgagtgtgcctgagagtacctggggaggccagaagaagacattatattctttggtgttacagctacaggcagttgtgagctgcctggtcataggttctgggacccaaatgctggtcatctggaagagtagcaaatacatttaacccctgagccatctctctaggcccaacattaattgtttgtttcgatttttgtttttgtgtgtttgtctatggaggtcaaaggacaacttgtggcagtcagttctcatggatcaagctggggtttgtagcaagtgcttttatctgctgaggcatctctggttctataggactttcataaatatagatagaggcttgggctagtggcattatcattcttaagggactttccctgtgtgaacatgtacaaactgctaaggaaaacctccaagagaagacttctcatttagtcttgattggagttggacagagcacttatactttttgctcctcttctgcaaaatctgtcccataaggaaccttatcatctttagaaattgtgttaaaaacgtgaagtagggggacacagctacccaggaactctgccccaccagtggcacaggtttcttctggtctgggccggtcccctgagcagaccttgggctcgaactccagccagtcccacaacatccagaggaagatctgttcccaggtgctccaatactcccagaatcataggatcagagccagtcccacaacagccagaggaagctccaattccaaatgtgctaccacacccaggatcataggatcagaggtgaggaagatacaacatctaacctaacaccaggagtgacagaaaccagcaggacccaggcactcaggttccttccagtctgagccagtgccctgagcagacgttgggtatgaactctgcagccagtcccacaacacccagaggaagctccactcccaggcgctccaacacttctaggatcataacacccagaggaatatccactctcagatgctccaacactcccaggatcataggatcagaggtgttctgagcagaccttgggcgctaactccacagccagtcccacaacacccagaagaagctgcactcccagggccctaacatgcccaggaccacgggatcccaggagtttgaccaaacaccaggatctcagggtcccagagggattcctaggagctctgacacatccaggatctcaggatcacaggatcacagagacagctgaactctgagaagttctgacacaaccaggatcacaggaaggacagtccccagtcagatgtagcaagggcaggcagaactagggataatcagattgcaggaggcaagcataagaacagaagcaacagaaaacaaggttacttggcatcaccagaacccaattctcccaccataacaagtcctggatacaccatcacattagaaaagcaagatttggatctaaaaatcacttctcatgatggtgatagaggactttaagaaggtcataaataactcccttaaagaaatacaagagaacctaggtagacagctagaagaccttaaagaggaagcacaaaaatcacttaaagaactacaggaaaacacaatcagagaggtgaaggaaatgaactaaaccatccaagatctaaaaatggaaatagaaacaataaagaaatcacaaagggagacaaccttggagatagaaatcctaggaaagagatcaggagtcataggtgcaagcatcactaacagactacaagagatagaagagagaatcgcaggtgcagaagataccatagaaaacattgacacaacagtgaaagaaaatgcaaaatgcaaaaaatctaacccaaaaacatccaggaaatccaggacacaatgagaagaccaaacctaaggataataggtatagaagagagtgaagattcccaaattaaagggccagtaaatcccttcaacaaaagtatagaagaaaacttccgtaacctaaagaaagagatatccatgaacacacaagaagcctacagaactccaaatagattggaccagaaaagaaattcctcctgtcacataataatcaaaataccaaatgcactagacaaagaatattaaaagcaataagggaaaatggtcaagtaacgtataaaggcagacctatcagaattacaacacacttctcaccagagactataaaatcctgggcagatgtcatacagaccctaagagaacacaaatgccagcccagacgactatattcagcaaaactctcaattaccatagatggagaaaccaagatattccatgacagaaacacacttatacaatatctttacataaatccaaccctacaaaggataatagatagaaaacaccaacacaaggagggaaagaacaagaaagtaatctttcaacaaacctaaaagaagccacataaacataattccacctctaacaacaaaaataacaggaagtaacaatcacttttccttaatgtctcttaacattaatggactcaattccccaataaaaacacatagactaacaaacagactggatatgtaaacaggacccagcattttgctgcatacaggaaatgcacctcagtgtcaaagacaaacactacctcagagtaaaggtctggaaatcaattttccaagcaaatgattccaagaaacaagctggagtagccattctaataatggataaaatcgactttcaaccaaaagtcatccaaaaagataaggaagaacacttcatactcatcaaaggaaaaaaaaatgtaccaagaattctcaattcttaacatctatgcttcagatgcaagggcagccacattcataaaagaaactttactgaagctcaaagcacacatcgcaccccacacaataatagtgggagacttcaacacgcaactctcagcattggacagatcatggaaacagaaactaaacagggacacagtgaaactaacagaagttatgaaccaaatggatctagcaggtatttatagaacatttcatcctaaagcaaaataatataccttcttctcagcacctcacgggaccttctccaaaattgaccatataattggtcacaaaacagccctcaacagatacaagaagattgaaataatcccatgcatcccatcagatcacgacagactaaggctgctcttaaataccaacaaaaacaatggaaagcacacatatacatagaagctgaataacgctctactcaatgataacttggtcaaggaagaaatatagaaattaaaagctttttagaatttaatgaaaatgaggacagttcatacccaaacttatgggacacaatgaaagcaatgctaagaggaaaactcacagctctaagtgcctccaaaaagaaactggagagagcttacactaacagcttgacagcacacctgaaagctctagaacaaaaagaagcaaattcacccaagaggagtagacagcaggaaataatcaaactcagggctgaaatcaaccaagtggaaacaaaaagaactattcaaagaatcaagaaaaccaggagctgattctttgagaaaatcaacaagatagataaaccttttgctagactaaccagagggcacagagacagtatccaaattagtaaaatcagaaatgaaaagggagatataacaacagaaaccaggaaatccaaaaatcatatatatcttaaaacagttattcctcttgttgaatattaacagttgaaaataataaaattatgttctacaaacatcatggaaatattattgataatttgtctcactgcttgaaattagcattttcttaatgtttaacttcaaggagcttttgctattttgaaaaatttaaaatatactttctgataaaataatttctctcctataaacactgataatcttttttaaataaactgattgttagacaatgtacacagatatataatgtattttaaatactctcactatgtcaggtggtatcatataagggcttttgaatatatttcttaatgattcatttttaatattttatgctcttttactgtgcttaactcccaatgaatattttgtatgttttgaaacaatttagtattcaacattagatataggatcctcagttatgggtagtattacatattcattaatgatatttttaggataaggatatgaatataaaagctgaacaattttttacctattatttgattctcaaaatactcaatattattatgtttgatgtataaaatgcatttaaataagaaaaaataagaaaaaaaaccctgaagtaatggtcaagcccactgtatagctttactgttgcaacattttagtatttattgtcttactggcttcatttatttcataaattaggatagaaaaacatatttcaatcttcagaaaagtcatatgttatattgtcaccgaaagaaagtggtcatcagacttctgcctggctatgcttttttctcttcttcagtttatctacttctccctcaggtggtagagggagcagagagcagaattgagaggaagtttgtcctttcttccagcccagtcaacagccaggtccctttcttctcagccacaaacttgagaggaaatgtcttactttaggttgcctatctgcccaaataggaacaccattaacattcctgtactgactgttgttgtgtgtcaacttgacacagctggagttaccacagagaaaggagcttcagttgaggaaatgcctccatgagatccaactgtaaggcattttctcaattagtgatcaagtggggagggccccttgtgggtggtgccatctctggactggtagtcttggttctataagagagcaggctgagcaagccaggggaagcaagccagtaaagaacatccctccatggcctctgcatcagctcctgtttcctgacctgcttaggtcctagtcctgacttcttttgttgatgaacagcagtacggaagtgtaagctgaataaaccctttcctctccaacttgcttcttagtcatgatgttttgtgcaggaatagaaactctgactaagacaaccccacacacaacataactcaaagccactccatagtagtttcatggtctctggaagtactctagaagtcacagtactcaggaaggagaggagctactgaaaaggagcaagagattttgattatacttattcctgagtaagtaagtgtgctttgggagacaattcatttaactagacccaagcaagcaccttctctctgttgggcattgcctaagggctaggtatattcattgagccaaatcaagctcctgccttcatggagagtgtgggttaagaaggtggggcaatgaaggagtctaaaggctatcactgagcagacggtgcacctggccatgttcaaagccgaaggaagtagccaaaatactagctaagggaaatcagtgagtagctagatgttctgccttgagatgtataagcaatcatggctcttgaaatagttgataagtagcattggttatgttttggtcatttgagaaatgcttatatattcatttctgcctcttcatctaagaacaacccccccccaaaaaaaaaaacaaaaataaacaaacaagaaacagtaaaaatgtgatgtccttgaggttcctaatgcttctggtcttggcttttgtgtccaacacgtttctatataattctgccacttcctctctcttccctcttcccacttttttcatcctgctctgcatcttgtttttcttcctttccctgccttttttcctttcttctttttcctttatctcaacaataatcttattttgtcattgctcttccctgtgggaaagtagagccatttgaagtaatctctcctctactggaagggagggacagggtaagtgtgtctctggaaagaagtgtgacttttgggtattttaattgtatgaaaaacatatattgaatggctggctggctggatagatagatagagagatgtgtggccttttttcagtaaagctagttcttattcctgctaagcatctgggacaaggcacaacaccagagtctgaaatcctttggtgaacctgtggcattgttgctgattagcattttttgagtgaaaaaaaatgtaggtcatgggctggagctgaaagaatggccagcatcatcatctgtgaaactgagacttatttaaaaggcagggacctgtgccaagaatgaaagggaacaacagacaaataaaacatgaagcttgctaagaagaaatagaagtgggaaaaatacgcacacatgatttttttctttcttttcttttttttttttagagagggggtataatgtattggcaaatgatgtgctggcatatttatgtatcacttggagggtaaggaggacctcacagaggaactgtctgtagcagcaagatgaattggataagcacacaagtactggtggctcagtggatctgggataaactctgatgcctgggctgctctttaacttgtgggctcagcctcttgagttgctaacatcatagatgtgtatttccatggcttacctagacagagatgatgaaagaaccagtgtaacctggggaggaggctagcattttgggatttctccatttctgtgaccagaatcccattaaaaacatgattgttaggctggggaaaatggtcagaaatgaagaaagacatggaaatgattaggggttagagatgggttagtggctaagagcactaaatgctcttctagaagacccagcttcaattcctatcatccatatggcagctcaccactgtcggtaactctagtcccaagtgatctgatgctctctactggccttctcaggcattgcatgcatgtggtgcagatacacatgtaagcaaagcacctgtacacattgagtaacaatggagagaaaaaaaaggatgacccctagcaaggaccaggatcagtatagcttgaactgaatagtggtggtagtgccagaggataaaggggaggagggagagttttgttctgtttggggataggaatgtctcgagcatcttttttaggcgtagggagaaagggttttgaaattactgtgtttatgaaacccctattgatgcgctaatagttctaaagataggggatggattgtaatgaaacatgaaggcagaactgtagaatttgctatggagaggctgaagcatggagagaagagatgaatgaagaggatatggtatggaaggacgactgttggggtcattcatcgtgtggtggcttatatccatctcaggaaagtaaaagtctaggagggttgctaggtgtcagtctgtgagctagaagataataaaaatagaccagcagcttagagcaggtcattagaatcagtagaaaatcaagcaggcctgcagaagactagatttgaaaaatctgatgctggtagctactcactcactctgttttctgtcctttaaggtgctgttcagagccaaactggagaacaagacgaacaggagctatgggagcttcacatgaaagaacgcaggcagagagaagaacaaaggcataatgaacggcaagaagctttagagagggaaagaagagagctgggaaaactagagcaggagcgggtacggtgtcccttaaatctctgtatacatttttccagtgggcacggcaccttcagcaggtaccttgagctcaaggctgggagccagtaatgctgtgagatcagagaagcagcaggtgacctcaaaggcattctctttcccttcctgttgtgctccttctgagcaacttggttttgaaaagacatccacatgtattctcatctgttgtataccttccctctgtatgtgcactccaggagagccagcttgccagttggaagaactagggcaagaaggtgcatctagtcaatctacagtgacgtctaggcacatacagcttttctacctctctccttgccgtttttgttctgattttagtgctaggcagatggattactcttggctagttaacatgccttaaaaatgttccttggcctcctggttaatcccttccttccttgaaatgacatgtttgtctgatgatagcaatgactttaattttaagcactttctctggtatgcaagttatgctaccagaataaggatcttattagtatgatttttaagactgagaagcttataaactatgttcatatatttcttcttttgccgctggtctgtttctagaggatgattgaagagtcactgaagatggagatggaagaagaattagaaaagagtgttcaagaccagaaagacaaatcagctcattgtgaaaatactttagaaaaatacatgaaaattatccagcagagacaggaagaatcaaatgcagataaggtgcctatgctgtggctagcagtcagatggcagaggagaggggaggcactgggagccttattctgacaccttgggacatgtattctttattgaagacacaaagattaaaggccataaagtgaatacttgaaatagaaccaggattctgtaaaatatatacactgttgacaaaatttcagccttagtttaggtaaaacattgaagagattctaatttttaattttgtacctaataggatattttattgagttatagattgtgaaacattttttctgtctgaattatgaatactgaaaatacatgctatgtgttattttgatgtacttgctaagtttcactttaaagtggctcttaaatatgtttccaaaataattattagagaaatcaaagtgtactatttcttggcctttttctgaagttaacttgtttcaaaatttttctttctccattctgtgtcagagctccaaaaaatcgggcaaagaatgctcactagtggacatgatgatgcctagtgacaaggatgaaaggtatggcttccttcaaacatgtccctcaggcaaatcagtattgctcatgttaccagataaaaatgatcagatacttgagcttgccttaaagaaaccattggattagtaaaaattactccttttgaaagttagtatatgatagtatattctggtaattccagcactctgctgcctgagacaggaagatcaagagtttgaagctaccttgggctacatagtaagactctcaaaagttatgaatttaaaagggatggaggtttacttcagttagcagagtgttgaactaaaaggtagaagtccctgggttcaatcccagacactcataaacagggcatggtgccacatgcctgtaattccattactcaggtagaagcaggaggtatttaaaaatttaaggtaagttttgtttacataggccagcctgaggcacaggaggcctttattaaaaaataaaacagaacaaaataaaaagccactggcctcaaaaagtcgattgtgatttgacttgtgaaattgaccctaatactaattgtaagtgagagcaaaaacacgacaagaaaggaggaggaccattctgaagatgtagagcagtgcttcttagccttcccaatgccgtgaccctttaatacagtgcctcatgctgtggtcaccccaaccaggaagttattttcattgctacttcttaactgtaattttgctactgtaggaattgtaaatatatgttttccgatggtcttaggtgacccctgtgaagggttgtgacctacagattaagaacctgatgatgtagaagttggcatgaattttttaaacatctaatttttctctttagttctccaggattttctcatgaagaaccagatgacatgtggtaataacattagctgtctagtttctcacaagaagtcacgtaatatgtgttcttgtttttctggaattaaagttgtcaaaaaaactttgtgtatttttttaacattgttttaattttataccataatgtctgagacaacagtaacagagtcagctgaacccttcccccctccccttttatttttggagacaagatctctgtgaagccctggctggccttgaagtcacagattcgcctgcctctgcctccctttgaaggcatgcaccaccacacttggcccatgtagtcctctagccatggcatgtattcattgttttaaaatgacattcctctctctggctttgtcttaagttacatctatttgaaaacttatcttgtcaccttccaggcttgcatttgctaagtttaagctgtgtgcctcctgctccacacttgggctataatgtgtaaaacaggaagccatcctcccagcacagttttgtccctggacatgaacacaaatcttttcattgtaatgtctataaataatattttgcatctggtgtggttaaacttgtaggttctccagtattcatatgtttgaaccctagtgtgatggtattagctggtgggcctctggggcgtgatgccatgaaagcagaccctcctacatagaatgaatgagagcgcagtcatccctttcagaagtaccaagaacttgacactgtacaaaccaaggcctgacccttaccaggcactgaacttgccagcactttgttactgagattctcagtctccagaactgtaaaaatgaaacaaaaactccaaagttctattctttactccctaccttgtctaagattatttttgtagcaggagtaagccagcatctttactgtagaatcctttaatcttatttataatggataatgggtgaacttgttgatttttaaatatttaggttactaaatattttaaatattttaaaatataataaaaaggtaactt

SEQ ID NO: 125 - DNA, 134 bp, mus musculus
caccccgggggacggccctgaggccgtacagccatggcggcgcgccttccggcccgctccaatgacagcacctaaagggaggaggaaatcaaccttcgagcagcctgggcacggggagcaccagagcgcccctg

SEQ ID NO: 126 - DNA, 597 bp, mus musculus
tgaggaagtgcgatcgggaacctcctatatacttccgtttgcctcgcggtttctttctttccgcgccgatagcgctcacgcaagcatggtaggacttgctggtgggggccgagtaacatccagcttaatctttcccccccttcgtcgcccgtgctatgccgggatgggtccaggctcctgtgtggactcgatatatcagagcaacccaatcttgccgggatcaaccctaaagggaccgggctacggggccaggaattgaagtgatgggttcaaagaggtagagttagccgggggtggagttaatgaggtctcttccctctttggggctcgacggagggaggaagctctgcttgaagcacatggggctggcccaccctgtagtcagaggtagcaagtaatgaggagtcctcctggagtgcctcagctttagctgggtaaggtagggcgttgtgccattgtggtcaaataacattgcacgttctgaactgtttctttactaggttaacgtccctaaaacccgccggactttctgtaagaagtgtggcaagcaccaaccccataaagtgacacagtacaagaagggcaaggattctctgt

SEQ ID NO: 127 - DNA, 10983 bp, mus musculus
gggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctggtaaggaccaagttgggaccctgactagacctcacctgcccaggcggcagagtataggagggatggggtcgccgcttgagctcaaacagactgggggttggggggagagggtgcagctctgtgactagcctaccccacgggctgtttccgttattttacctctcgcgggagggtcacgttcattcttaccgtgcggtggggtggagtcaaaagatggagtgtgaggcgaagcttctgcgtttgagggcaagggctgggggacccaatagatagtggctgcatagagcgacgagaggggaccgacgcttagccagggcggtagggacacgtggcttggctttgctgttgagccacccaggctggactgggttgcttcagctcttagactagcttgcatttagagagcctacctgcgtactgagctctcctggtctttcttttcctagagtccaataagcagctttttgattcgaaatggtgttggtccgttcggcttggtgttgagggaaactgacattatatactgcaggcgccaaaattattacgacttcccttagatcagcaagcgttggcttttctcatcttatgaatcatctacctgagtaattggagccataaatctagttgatttgttaaagtgatgcgttgactctgcatccttgatagccagcatctcagcttgagccatccaaaaaatcttggaaatctcaattctggaatgtttgaccttccccagtgcagctagtggtacagataatgcaaaagcgtatttttcagtaaccgagtccatcctggacttggctccttctttaagctctgtgtagggaatttaggaaacaattttatacctgaatgttaaagataattgaggacaggcaatgtagtggaagactaggattggacagtgcattgcaacttgcgttttttccattgccttgccagtaaaacttgcttcctcgactccgacttacaccctctaccggcaccatgggactgttttagagatgacttggttacctgattatttcagtgccccttccacctaagtgtgggatctttagtttctgataggtgtaatttgtattttattgttaccctatcgattaaatcagagccctgcccacaatcttacagatttgttaaggggaaagttttcacctaataatcagataagaatatttcgaatattttttcctaaatgtttttgcttacttttttgctttctttggactgatttccaagtttaactcgccttatctcttttagacccagctgataaagtaatgtcaccgataatggacagcttcttcccgaattattgtgctactgattgtgatgcaaatgatagtgtaaacattgccatctgtaaccaggcaataccttagttaaaagaggcttacaaactgctgtctttagatttttccaaaccattatggctcatgggccttaataaagaatacaaaacaggactagactttgtgattggcaatatagttaggggacaagaatgtttttcatttagaggttttctttggcccctgtggatatttaatccttttcctatgcgtctaggaaaaatgtgaaggcatgaaagctttattttctccttgtgttaatccttctgccctctgcataatgcagcaccccagaacctgaggctatattgggagaggagagggggaggacaacttagttttctactgattgatttctattaagtccaacatggataattgctgactggttagattttcttgtttctggcttaatcattagcttcttgtttcctagatattctgaaatcttcattgaacataatcacatttttttttatggagttccccctatctttgtttttcctatactgaagaaatggtaactgctccctataactgctcccccaggtgactcttggttgatgctctcttgagcagagtagcttttcttctaacataaggatcatccttggctgtctggttatttaggaaacacacacacacacacacacacacacacacacacacggagggggtgggtgttaaaagtgctgaaatcagagaacttggatctgaatccttaacctttctttgccccaataatctaatctgtaaagtagtacctacccatactgttgttatgaggattaaatgagatagaagtaaagttcttaggatcttgtccaaaacataataagtacaacagtaaatgttgacaagaaggggtggtgataatattgcagaaaatgtggaaaatttagaacacggaagggagaagatatgcctcttaattctgccacctgacataaatgtcacattatcatttctgacctcccagatatttgtgtaagatacactttttcaagaatgtttaatacatttatagctctcttcacttagcaatatattttgaacagtttctccctttaatatttagtatatatgattttctttttttattattaaagattttaatttattttttagagatgaggtctcactatgttgcccaggctggagtccaatagctactcacaggcacaatcatagcacactgcatcctcaaactcgcgggctcaagtgatctgcctgcctctgcctctcaagtagttgagaatacaggcatgcaccactgaggtgggctagttcatgtaattttaaatagctatatagtcttaccttatggttatgccataattttatataaccaaattcttattggacatttccagtttttgatctaatgcttttatatgaaaatccatgaacataaatctttgaccatttctgattatttccttagaataaatccctaggaaggtaattattaagttaaagggtagataccatttttcaggcttttgatacctgttgccaaattattccccagaaaagttgaacaaatctgtctcatcagcagtaatacaatattaataatatttatttatgtatttattttttgagacggagtttcactcttactgcccaggagtgcagtggtgcgatctcagctcactgcaacctccgccacccaggttcaagcagttctcctgcctcagcctcccgagtagctgggattacaggcacgtgccaccacgcccagctaatattttgtatttttagtagagacagggtttcaccatgttggccaggctggtttcaaactcctgacctcaggtgatcccccacaccttggcctcccaaagtgctgggattataggtgtgagctaccgtgcccggctataatatttaatgtatagtgaatgcctaagatgtgctagtttccatgctaagcatttagtatacattgtgtttaatcccctcaaaactgctatgaggaataactcttactatccctattttacagagaagagaactacagtaagatgcagagtaacttgcccagctctgggtattattgttcctttaaatttttgctgacaagatctctcacctggctttaaaaacttagatattctaaaattttgactctattctcttcaatatttgtaaataactttggtttatttggttattctgtactagctgagaggaggaagacttgaactttggttgcctagggttttcctgagaactgtatcttctggttgtggttagttaatcccatgtattttgcacatgccaatatctccataatctaaattcttcagattttcttaagactactatccaccttttagattcacttttggtgtttcctgacattccatttcaattggatacacttatgcctgaccttaaaggaaagggaaaagagaagctagttttttcactcattggatagacatagccagtcttctggcctcaccaaaacagctgagagaatgattggcccaaagccatttggagaacactccattaactagagggagagaacaaggagtattactctctaaattgctgaattaggtttttccacttaatagattatgttaggagcaaacaggttttaggcacaaatattcttctcgatcactgccataacttagaagaagccataagaataaggttaagatttttagaggacttgttgaaccaagctgtataatcagagtgcaattcacggactttttaagactttgtcaaacaaagtctgtatgttatagtactactatagggaaagattggttttaataagtgaaattagaattatacacattaaaacaaggcagtatcacctagtttacttgcaccaccttattttatttatgtatttgctttctaagtttctctacttttatttcatttttgtaagatcttttcaaaagccccacattttttaaacagttaaataaccttttcaagttattagatacatgccttataacaaacaccttctatgctgaaggtagcttttaattttaaaaagtttgagccgggtgcggtggctcacgtctgtaatcccagcactttgggaggccgaggcgggtggatcacgaggtcaggagatcgagaccatcctggctaacacggtgaaaccctgtctctactaaaaatacaaaaaattagctgggcatggtggcagacgcctgtagtcccagctactcgggaggctgagacaggagaatggtgtgaacccaggaggcggagcttgcagtgagctgagatcctgccactgcactccagcctgggcaacagagcgagactccatctcaaaaaaaaaaaaaaaaaaaagtttggctttgagaaatagctgagctgttgattgattattaagtgatataataacaaaaatggtactagcgactgtattgggtggtaagctgataagtgatttttatttatttttattttttgtttgataagtgatttataaaaaattattattcaagccttatgtgatgttagaatatgtatattttaaaaataatcaccttggctgggtgcggtggctcacacctgtaattccagcactttgggaggccaaggcaggcggatcacctgaggtcaggagtttgagaccagcctggccaatgtggcaaaaccccatctctactaaaaatacaaaaattagccaggcgtggtggcacacacctgtagtcccagctacttgggtggctgaggcaggagaatcacttgaacctgggaggcagaggttgcagtgagcagagatcacaccattgcactccagcctgggtgacagagtgagattccgtctcaaaaaaaataaatacaatttaaaaaataaaataatcaactctattaaagctatatatttatcagatgccctttgatgttttaattagcagtgataatttaatttttaaatagtatctcacctgctttcaagaaaggatttgaagtatgtttgatagtcactagtacaaaccgtttgttaaggtaggtatcagaagccttatagaaccatggactacagtaattgtggcaactatttggcataaaacaatttctaaagtttagtgttactttttattttatttatgtatttatttatttatttttttgagatggagtctagctctgtctcccaggctggagtgcagtggcgcgatctcggttcactgcaagctctgtctctcgggttcacgccattctcctgcctcagcctcccgagtagctgggactataagcgcccaccaccacgcccagctaatggctaattttttttttttttttgtatttttagtagagacggggtttcaccatgttagccaggatggtctcgatctcctgacctcaggtgatctgcccacctcggcctcctaaagtgctgggattacaggcgtgagccaccgccccagcctagtgttacatttttttaactgtatcccttggcttcctgacagccagagggataaaggcatatgcaatcgattatgtggtttttattttcataaagttatttagaaacttccaggcaaaaaatcctaagaattttatgggtgagacctctaaatagtgatatcgagtaacatcatggacaatataacaattttgtgggtattttttatattgactgatagttgaggcatttgtaaagggagataagccactgtggtctaagaatgttgttttctggtcttacttgataatgataaagttttttgttttttttttttttgagacagagtctcgctctctcgctctgtctcccaggctggagtgcaatgacttgatctcggttcactgcaagctctgcctcccaggttcacgccattcccctgcctcagcctcccgagtagctgggactacaggcgcccgccaccacacctggctaatttttttgtattttttagtagagacggggtttcaccgtgttagccaggatggtctcgatcacctgacctcgtgatccgcccgcctcggcctcccaaagtgctgggattacaggcgtgagccaccgtgcccagcgataatgataaagttttaaaaacatagcagaatagcttgtcccttatactgtctgatatcaattgtcaaactacatttgttcatttgttctccaacttttaatcaaacatcctgactctggcaagtgaatgtctggagcacagatgatactctgtgttcttgactgaaacaagagccataggcttctgatacatgattggaaatcaatatgcctgcctgactttcattctcctccagggaaatgcatattttggtcaaggagctgatatatggaggatgaatgtgagcagcattaaaattttctgattttttttttttttgagacagtgtctcactctgtcacccaggctggagtgcagtggcatgatcatggctcctaactcctgggctgaagcaatcctcccacctcagtctccccagtagctgcaatcacaggcacttgccaccatgcctaatttttaaattgttttgtagagaggaggtctctttatgttacccaggctggtctcaaactcttgggctcaagcggtcctcctgcctctgcctcccaaccacagacttgtttaacataaaacctaaaagtgactcttttagcttgaaatctctcgaagggcagagctagtagtaaagaaagatctgggccagacatggtggctcacacctgtaatcccagcactttgggaggtcaaggcgggcagatcacgaggtcaagagatcgagaccatcctggccaacatggtgaaaccccatctctactaaaaatacaaaaaattagctgggcgtggtggcgtgcggctgtagttccagctactcgggaggctgaggcaggagaatcacttgaacccgggaggtggaggtcgcagtgagccaagatcgtgccactgcactccagcctggcgacagagcgagactgtctcaaaaaaaaaaaaaaaaaaaaactgaaaacgtcccaaaagtcccttgaaatgaccactgcctgtttgttttgttttgtttggtttgagacggagtcccgctctgtcacccaggctggagtgcagcggcttcatctccccatactgcaacctccgcctcccaggttcaagcgattctcctgcctcagccccctgagtagctgggactacagatgcatgtccccacgcctaatttttgtgttttttggtagagacggggtttcgccatgttgccaaggttggtcttgaaatggggagctcaggcagtctgcctgccttggcctcccaaagtgctgggattacaggcatgagccactgcgtccagtcttaaaaaaggtttatcctaaactagtgcattttcttttttgttctggctgccaggaatctcagcttccttgattttaattggtttctagtttgattttttttcacttgcttttatttttcttgctttacaacataaactaaccccatttgtcttttcttgcttttgagatgagggtcttcctgtgttgtccaggctagacttgaactcctgggctcaagcagtcctcctgcttcagcctcctgagtagctgggattacaggtgtgtgccaccactcccagctccctttcatcttgggttagaaaggaataaataagtaattatctcctatgtcagcttcttctggcaatagaattgcctctgccagttttcatataagtcccttttggagttctccttgaagttttgtttggggagagaagggtgggtaaaagtgatcttgacagaaataggacagtaggtagttcctgaagccacacagaagatagtgcttagagtgagatagaagtatggatcttttatttaataactctattgccttttgatttgaactgaagttttctcttgttcaataggtattgtcagccattctgatctacttgtctatatacacacatacacctctccttcacctagaggattagttggaatataatgttgtttgaggtatcactaaggtgatttttaaaaatttttaaattattttcttttttttttcttaaacctggtgaacaggagaggtgatttttttttcttggtagagacccgagtatgggcactgaaactttcgtggtaaaatatagccctacttcatacttagagtaaattcctatggagttacttagtaattggaccagagtacagttaacacagaatgagggcaaggaccacattttattcaccattgtttccctagcatctagtacagtgatgagcatatgaacatttaatatttactgggtaaattgccagtatggtagaggtggtactgtcttttgttaaagtgtcattatagaacagtagtgattcactccttatgatatttctacttcttttgctatttatggactctgtaacagtaataggtgatgcatcaaattttatgtacatcacatgtacctatatgaaatgagatacaggccacctgctaaaattatggtccggttatttgtaagtactttagactaacatgtgccaaccatttcatgcatctttttcgtgtctgtcacatggtaatattagaaaatattaccatagaaaatggtaatatttgtatagtgcactggagtaaactgaggcagtgaactgcttctggtataaggctccttcagaggatctcctgaagcctaggtgatcaatatccacatgtagctgtaaccattcacagcatactagtagggaagctgttcttagaccttattgtctatagaagtatagtaaagtcatccctcagtatccacaggggattggtcccaagaccaaatctgcagatatgaaatagtgtaatataaatatatatatatatatatatatttttttgatatggagtcttgctctgtcacccaggctagagtgcagaggcacgatctctgctcactgtaatctctgcctcccggttcaagcaatttttctgcctcagcctcctgagtagctgggactacaggtacctgccaccacactcagctaattttttttttttatttttatttgagacggagtctcactctgttgcccaggctggagcgcagtagcgtgatcttggctcaccgcaacctgtgcctcccgggttcaagtgattctcctgcctcaacctcccgagtagctgggactacaggcgtgtgccaccatgcacggctgatttttatactttagtagagatgggttttcactgtgttggccaggctggtcttaaactcctgacctcaggtgatccacccatcttggcctcctaaagtgctgggattacaggtgtgagccaccacaccctgactaatttttttatttttagtagaaacgggtttcaccatgttgactaggctggtcttgaactcctgacctcaggtgatccgcccacctcagcctcccaaagtgctgggattataggcgtgagccatcacgcccggccatatgaaataatctatgcacatgttcccttatactttattgttatttatttattttttgtagagatggggtctcactgtattacccaggctggttttgaactcctgggctcaaatgatcctccttctaccctgccccctgctccccaaagtgctgagccaccatgccaggccctcccatatattttattttattttattttatttttgacacagagtctcactctgttgcccaggctggagtgcagtggtgtgatcttagctcactgcaacctccgcctcctgagttccagcgattctcgtgcctcagcctcctgagtaggtgggactacaggcgcctgccaccatgcccttctaatttttgtatttttagtagagatacatggtttcgccatgttggccaggctggtctcgaactcctgacttcaagtgatccacccaccttggcctgccaaagtgctgggattataggcatgagccactgcgcccagccctgccatatactttaaatcatctctagattacttataatacttaatacaatataaatactacgtaaatagttgttatactgtatttagaaaataatgacaaagaaaaaaatctgtacatgttcaatacaggtgcaattttttctccaaatattttcaatccacacttggttgaatccatagatgtggaacctatggatatggagggctgacagtacagtggtttaaaatctatttcatgttctttctttcctcattgtagtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataaggtaggag

SEQ ID NO: 128 - DNA, 10983 bp, mus musculus; identical to SEQ ID NO: 127

SEQ ID NO: 129 - DNA, 3295 bp, mus musculus
gggatccgtcatcgaagcgtccctgcggccgctgcgccgtgaaaaccagctgctgcagccgcagaggcagccggaggcagaggggcggcgggcaggaccagacagggctgggcagggggctggccgagcgccgtgcgccgcttgggagaaggccggaagcttaccagccgagaaggaattcctagctagcttcagagccgggtaggtttgcctgggaccttgtaggccggctgtgggggactccccgggtcgcacagccccattgtttgcatattgcccgagcaggccacggtggcctgcgcgccccaggactcgcaagcagctccgatcggttggaactcggggcggcggcagcagcgctgagccggcctggatgaggagatgcagcttcctgcaggggccaaggaaggatctggggacaaactgtccggaactctgggccagggaggcgagaaggagagagagaggaagagccgaggcagatggaggactttggccacaactgccatgtactcaagagtagaaccgagtgggtaatgggtcgctttgctttttgtcttggcagtgcctccggagccagcgtggtggccatagacaacaagatcgaacaggccatggtgagtggcatcactgcgtcattctcatcccctgacttagctgctgcttatgtaactctgggcaggattgagggaatgggtgaaaaagcccttagccaaaaccctgaggaagccgacagcctgcctcctatccgcactggaggtggagtctgattagagtggcaccttttagggcatttccagtcttcccttcctgggctccctcctttcttcctccctcctccatctcaggtctttgccgcaggctctgactctctcctgggcctgttgttgggcagggagctcagactcttgcatttgtgtgcatcgtgcagctggcaaggggctgagctcattggatgcaacagcactgcagtgcctctgcagagcctggactggggtcaggagttgggtggaaacaggaagcgaagcaccccacccctgtccctctccttaccaggtagaggtcatactccaaggagcagccacaatggctgcagagggttagggcttcagcggttgggagccacttaattgtgccctggagcttaaggacaccttccctgcccccagtgcagtcatcaaattcagagaggatgcggcagttctgtacctttccccaaggccaatgtcctgtgtgctaactggccggctgcaggacagctgcaattcaatgtgctgggtcatatggaggggaggagactctaaaatagccaattttattctcttggttaagatttgtacagcagacaaacagtatgggatgcattgcaggtctacccttcccccagatctggatcggcagcagtaggggcttatgtaaaaagggggacatagcaaaccactggcaaacagcagaagtgtcaccccaaaggcccctcagcagccagctttgaaagtcattagaaacttgcaggggagaacctatctagttcaaagctgggctctcaactccagcataagccaaatcatgtagctctcctgaatgagggtttaagtgcttcagagaaaggtgaacgaggaattggacttgccagaccagttcactgagggaaggctggagggccctggcattaaggacagcacaggcacaccaatgacagagcaaaggtgctgcagaggggccacgatggctaaggaatggctttgttatgattccctcattggcaggatctggtgaagaatcatctgatgtatgctgtgagagaggaggtggagatcctgaaggagcagatccgagagctggtggagaagaactcccagctagagcgtgagaacaccctgttgaagaccctggcaagcccagagcagctggagaagttccagtcctgtctgagccctgaagagccagctcccgaatccccacaagtgcccgaggcccctggtggttctgcggtgtaagtggctctgtcctcagggtgggcagagccactaaacttgttttacctagttctttccagtttgtttttggctccccaagcatcatctcacgaggagaactttacacctagcacagctggtgccaagagatgtcctaaggacatggccacctgggtccactccagcgacagacccctgacaagagcaggtctctggaggctgagttgcatggggcctagtaacaccaagccagtgagcctctaatgctactgcgccctgggggctcccagggcctgggcaacttagctgcaactggcaaaggagaagggtagtttgaggtgtgacaccagtttgctccagaaagtttaaggggtctgtttctcatctccatggacatcttcaacagcttcacctgacaacgactgttcctatgaagaagccacttgtgttttaagcagaggcaacctctctcttctcctctgtttcgtgaaggcaggggacacagatgggagagattgagccaagtcagccttctgttggttaatatggtataatgcatggctttgtgcacagcccagtgtgggattacagctttgggatgaccgcttacaaagttctgtttggttagtattggcatagtttttctatatagccataaatgcgtatatatacccatagggctagatctgtatcttagtgtagcgatgtatacatatacacatccacctacatgttgaagggcctaaccagccttgggagtattgactggtcccttacctcttatggctaagtctttgactgtgttcatttaccaagttgacccagtttgtcttttaggttaagtaagactcgagagtaaaggcaaggaggggggccagcctctgaatgcggccacggatgccttgctgctgcaaccctttccccagctgtccactgaaacgtgaagtcctgttttgaatgccaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccaggatttggattttgattttccaaatgtagcttgaaatttcaataaactttgctctgtttttctaaaaataaa

SEQ ID NO: 130 - DNA, 30298 bp, mus musculus
ttgttgttgcaacatgagtactttagaagaaaggagactggtggtctgtttcgtgtttatttaaactgtgtttatttaaattcgacccattcacatttgttatgagacgtttatgtctggtcagatttctaccgtcttattttttatttatttattttttgagatgcagtctcgccctgtcacccgggctggagtgcaatggcgcgatctcagctcactgcaacctccgcctcctgggttcaagcgattctcttgcctcagcctcccgagtagttgggattacaggtgcctgccaccatgcccagctaatttttgtatttttagtggagacagggtttcaccatgttggccaggctggtctcgaactcctgacctagtgatccgcccacctcagcctcccaaagtgctgggattacaggtgtgagccaccgtgcacggctctctaccatcttattttatatttattatttattttgtttcctcttattcccttatttatgttttgctaacttgatgaagtttttaaacaatcctccatcggtaattaagttatgttggtaattgtattcatatttatatcaaacataattaattctgtatttatcactttaccaaagttaaataatgactattttgtaacctaccctttcaaaatgaaacctttagcatgctttcatgcttttgcttttccaacccccattacttgattcctggattttattgaaataatttggtatttcagttctgagctatttccttatgatatgcttcttcgattttaagaatcctttttttgttgtttttttgagacagggtctcactctgtcggccaggctagagtgcaggtgtgatcatggctcaccacaacctccgcctcctgggctcaagtgatcttcctgcctcagcctcctgagtagctgggacaacaaacatgtgccatcacacctggctaatttttttttttttttgagacaagagtcttgctgtgttgcccaggctggagtgcagtggtgcgatcttggctcactgcaacctccacctcctgggttcaagcaattttcctgcctcagcctctcgagtagctgggattacaggtgcgtgccaacacgcccggctaatttttgtatttttagtagagacggggtttcaccatgttgggcaggctggtctcaaactcctgacctcaagtcaggcatccggctaatttttgtatttttagtagagacggggtttcaccatgttgggcaggctggtctcaaactcctaatttttgtatttttagtagagatggggtttcaccatgttggccaggctggtcttgaacttctgacctcaagtgatccacccgccttggcctcccaaagtgcagggattatagctgtgagccatcgctcctggcctcagtgataagttttagtagatttccgtagatttcctgcccaccactgtttgtttcctttagcttgggatctttattctgatttaatttttattttgccagtagttttatccaaaaggaaacacagggccaggcgtggtggctcatgcctgtaatcccagcactttgggaggccaaggcgagccaatgacttgaggccaggagtttgagaccagcctggccaacatggcgaaaccccgtctctactaaaaataaaaaaattagccaggcacagtggtgcacgcctgtaatcccagctactccagaggctgaggcaggagatttccttgaacctgggaggtggaggttgtagtgagctcaggtggcaccactgcactccagcctgggcaacagagcgagactttgtctcaaaaaaaaaaaaaaacagagagagagagggagggagggagggagagacgaaagaaaggaaggaaggaaaggaaagaaaggaaagaaagaaaggcaagtggtaatctttgctcacctgaaaatgtctttttcttactttcacaaagtaagagtgatctgttggttagaattttatctctttatctttagagttcagaaatttcatcaggatatgtccagggtatgtctttttggttgttaatcttttttttttttttttttgagacagggtctctgttgtccaggctggagtgcaatggtgccatcatagctcattataactttgaattcctgggatcaaccagtcctcccgcctcagcttcctgagagctaggactacaggtgcatgccgccacacctggttaattaaacttttttttttatatagacaaggtctcactatgttgcctggattagtcgcaaactcctagtgtcaagcgatcctcccacctcagcctcccaaaatgctgggatgacagggtgagccatggcacccggccttggttgttaatcttgctgctgcctgtgtctttccagtctgaaacctcaagcctatgttcaacttaaggaactttcgtctgttattcagaaaattattgcttctccatttgtacccttttctctttcaggaactcctgtttagattttagctgtcttggctctattgtccattttttcttttatatttttgctcatcatttcaatttctttgaatttttgctctaagtaagcccctcctttggtcttctagcttattaatttggttgttagtgatgtcttttttgtttttcactatttctattgaatttttttaagagacagagtctcactatgttgcctaggctgttctcgaactcctagggtcaagtgatcctcttgcctcagcctcccagctagcaacaggcaggtgctactgtgcccagcttaagttttgactgttaaagcagtctgtgtttgtgtatttttttaagagatggggtcttgctttgttgcccaggctggattagaactcctgggctcaagggatcctcctaccttaacctctcatgtagctggggctacaagcatgcaccacggcacccagcttttgaatttttattcagtgtcaagttttggaaaatctttttttctcacacagttcctttgaagtatcttcttgattctccttaagaatttgcagtagctcgagactagcctggctaaatggcaaaaccccatctctactaaaaatacaaaaatttgtatttttgtatacgaatacgggaggctgaggcaggagaatcgcttgaacccgggaggcagaagttgcagtgagcccagatcacaccactgcactccatcctgggcaatagagcaagagtcggtctcaaaataaaaagaatttgcagtagaacttaagttctgtttcgtaccttaactctgcagtgggagccaactgatgtgattgtggagcctgttctctgtgtggtattctcgagctgctcatataatatatttgtttgtatatatcctgagcttccagaaactcctgtctctctaggaattccttgagcccctatgaaggtggtaagaattaaagggagccattcttcccaataggccaactgtgaacgggttgagagatgggacttcttattgaagaaggggagaggcctcataagttcttgggctttgctaagtcatgattggagaagtggtagatctcttctttttgtatctgagggaggcggcagcattttggctgagtaggtcaagtccctttggaggcaatggcctgagcagggtcagcaggaaggatggttctttccccacatactgagggcatctgcccaggtttagtgggctgggactccttagattaccttctcattctgccagctccctcatctcagcctggcacttaaattgttgagtttcccccagtaggaagttctgggggaaagaggagtcacaagcacatattcaggtttctctctgtacagaattcctctcagaattatttgagtttgcagtgaaataatgtgcaaatattatatccagtacttcctctgatactattgctgccatccgcatctcttgtcttgtgctggatctagacagacatggtatctgaggcttcctagctaggttcccagtgtggcctggccttgattcagatgtcaacaaatatcgtgtagatggatgacggctcttttctttcttttttttcttttgtagaaaataaaaagccaggtgaaggttccaagggccacaagaagataagttggccctaccctcaggtaaggtatgcctgttgttgagggtaaggtcaagaacaggttgcttgtcctgggagaggcccactaaacccagtaaatattgggtgactctggacagagtgccacattggagtcagtggatctggctttccctccttctctgggtggccgcagcagagaatcagcagcatttttcccaagtcatatgcagcttcgtgcttgatttaccttggtagggattatcattatccccatgttttagttgaggaaactgtcagtgagaaagttcctaggttcaaggtaacgcaactgggatttgagactgtctgattctcaagtccctgtttcttatggagaagagggaggccaaaacatcatctttggttcctggatctcctggtcctgctgggaaaggtgtgggtaagtaaggcttgggaaagagcaatgagaagaaggtataggccagagaaggcttgggttctcacaatttagcatgggtgaagctctcaaactttaaccagtcctctagaatcacctggaggatgggggaaaacatcgattgctgggccccacctcagagtttctgattcagtaggtctggcatggcatcccatgatttgtatttctagcaagttcccaggtgctgctgctactgctggtctgaggaccactcttttgagagtcacttatctagaaaggttttccctgggccttgggaaaccttcccagctgcccttcccctctgagaggtctcctgtcagtccctgcctagctataggagagaggacctctacccagccagatgggcagatctttggggatggagccctttttgcttctctcctttctttgtccccacaactacacttatctgagaagctttaactcctgctgctcaccttgggagtgaggggatgagaggatgagaggattgagagatagaaggggcatttatgaggggatgttgtcttccttctagggcttcttgctgcctttttgaggtgatttccatgggttcattacctctgttttttttctcttatgtggtggccagcctgcaaagcaaaatgggaagaaagcaacctccaaagtgccctctgcacctcattttgttcaccccaatgatcatgccaatcgagaggctgaattaaagaagaagtgggtaagctttttgccttggtggggagagagagggcctgccttgaatgccaggtccgcagaagtgttgaatggaagggcaaaggcaagagttgttagggttgttgaggctatttgtggaagccgggagagagggaggttaccatgatactggatttatgtctgcgtttgttcaccacccagtccattgctgtctggcttatgcttccactgctctgctgacactgcccctgctggcctcatcagcgccttccctgacatcacattcatgaatagtattcttccctcatcttattggaatgctcagcatttgaggctatgctttctttgaagcatgtggactttcttgtcatctcactctcctggatgtctttcttctttgactagccactgacagtctcttttgccactttttcccctttcttatctttttttttgagatggaatttcaccttgttgtcccggctggagtgcagtggtgtgatctcgattcactgcaacctctacctcccgggttcaagcgattctcctgcctcagcctcctgagtagctgggattacaggcatgcaccaccacgcccagctaattttgtatttttagtagagatggagtttcaccatgttggtcaggctggtcttgaactcctgacctcaggtgatccacctgccttggcctcccaaagtgttgagattacaggcgtgagccaccctgcccagccttcttccttatctttaaatgatgaagcatcccaggaccttggcttctttccatctctggtcttaagtggttccgcctgcctaggatacattctctctctgctttttataccctcttttctctgcaactctttccttcccttcatctctctttttcttcttctcaaaccctcatctcctgatgtcatatcttccctctccctggaccctgctcctgccacctctgccatgtcgcaccatttcctctgtctgtcacccatccctcccttaggctgcagacccagtcagctccagtaccagtgtgtgttcacttgttaggttgaggagatgagggagaagcagcaagccgcccgggagcaagaaagacaaaaacgcaggaccattgagagctactgtcaggatgtcctaagacgccaggaggagtttgagcataaggtaagagtgcagcccttgcccctgggtaggtttgctcaaagcatcttttgccgtttttctgtgaaagggaagaaggtgtgaagttgttggaggggaacaagggaatcagtgtagagaggatagaaaaccatggggacggacgaagggagggagggagggataaagggagataaagggccattttgagccttacccgtgactggacacctctggagagctcctctctcccaaggttgagcctgaagactggggctggtggcggagttgggggctgggagagttacatgtgaccaggggatggggttgggggagagggagcgaaagtatgaggagaggattgagagacagagaggagcatatgtgaggggatgttgtcttccttctagggcttcttgctgcctttttggcagatgttcttgtttcacacacagaatacacgcttgccagctcatactcccttttctgatatgcagtgtgtatgcctcccccatcctgtgtccctcatagattgtttttttcacacctccctcctccatccctccctttcacacccatgtgcacactcaggtctccacctggtgctcgagcacacgtatacacataggcgcacacatgaaccatggggttctgtccatttttcttccagttcccagctttattggttggtcaaagctactttttggtggcctgagactcacatgatttattttttaaattattattttactttaagttctagggtacacgtgcacaacgtgcaggtttgttacatatgtatccatgtgccatgttggtgtgctgcacccattaacttgtcatttacattaggtatatctcctaatgctatccctccgccctccccccaccctacaacagtccccggtgtgtgatgttccccttcctgtgtccaagtgttctcattgttcaattcccacctatgagtgagaacatggggtgtttggtttttttgtccttgaaatagtttgctgagaatgatggtttccagcttcatccatgtccctacaaaggacatgaactcatcattttttatggctgcatagtattccattgtgtatatgtgccacattttcttaatccagtctatcattgttggacatttgggttggttccaagtctttgctattgtgaatagtgccgcaataaacatacgtgtgcatgtgtctttatagtaacatgatttataatcctttgggtatatacccagtaatggggtggctgggtcaaatgatatttctagttctagatccttgaggaatcgccacactgtcttccacaatggttgaactagtttccagtcccaccaacagtgtaaaagtgttcctatttcttcacatcctctccagcacctgttgtttcctgactttttaatgatcgccattctaactggtttgagatggtatttcattgtggttttgatttgcatttctctgatggccaggactcacatgattttttaagcctcctatagtttaaaaagccctgcttctctttctcgctctctccccctcctcccctggaccattctctttttttttctcctttaggaggaagttttgcaggaattaaatatgtttcctcagctggatgacgaggccacgaggaaggcttattacaaggagttccgtaaggtacagggttccatttcttcaggcttttgcgggagggttccagtccagccccttttcctctccatttctgttttttcctgactgagatggagatttttgtttcacaggcctgcatcactgctaccctatccttttcctgccctcatctcctggtcctctgccctgcaggtggtggaatactctgatgtgattctggaagtcctggatgccagagacccattaggctgccgctgcttccaaatggaggaggctgtcctgcgagcacaaggcaacaagaagctggtcctggtcttgaacaagattggtgggtgttaggcaggattgggtgtgacagggaaggtgggcaggccatctttaacgtctagcttggaccagacactgaacccagcaactcagtgatactcataatagtcatgcaaagtagaaatttttgttccgattttcaaagcctgtatcacagagtatggtacaagttaggtgtggaatccaagcctgtctgcctttcagtcccctgttcttgccattttgagccttctctgtttttggacaaccctggagagttcctcctccctcaactcaaagactggggcagaggagcacatgggctcaggagtcactcatgtctagggttcagcctcccacctgtcctgattcttttctctgagacactggataagtcatgccacctccaagagctcctgtttctctagctgtaaaatgggccatgggtatcccaacctcacagatttgttgtaagaattaatgataaaatgcttggtacatggtggtcagtacttcacacatgatagccattctttttagggttatctttgtcatttggcccaacctagaatgatccagagaggggataggaaacacaatatttggggggtctctgatgctcctggcgctgttttggaaagagaacatttgggaccagatagctagtttgtccattttccctgagggaacagaggccccttcagggagggctaacgcatcccgtagaccagactatcctttctaactccaacctgcggactggatgggaatgacagggccagttgagagacctgttgatggtaggtgggcctagctttgggtacgggtggaggtgtctttggagggaaccatggaggtgttgttctgcttaccagccccatctgttcctatatttaccccagacctggtccccaaggaggttgtggagaaatggctggattaccttcggaatgagttgccaaccgtggctttcaaggccagtacccagcatcaggtcaaaaacctggtaagcctggggctagggtcatctagccgctttcagggtagtttggggccagagctgggagggtcgtgacttggactgggacctccagccctttagtaattgaactgggccttcaactttgagctttttgctccaccgagtgacttttttttttttttttgagatggagtttcactcttattgcccaggttggaatgcaatggtgtgatctcggcttactgcaacctccacctcctgggttcaaatgattctcctgcctcagcctccaaagtagctgggattacatgcacgcgtcaccatgccctgctaatttttgtaatttttttatttttagtagagatgggttttgccatgttgaccaggctggtctcgaactcctgacttcaggtgatccacccacctcggcctcccaatgtgctgggattataggcataagccaacatgcctggccagtgacttcttaatattagtttcacttgacttcttcctgtattatcactcttcaggaagcatttcttttttttcagttgtaaggataaaacataatgtctatagggaatttgtaaaatacagttaactacttgtttgtttgtttatttatttatttgagacagagtctcactctgttgcccaggctggagtgcaatggcatgatcttggcttactgcaaccgctgcccaccaagttcaagcaattctcctgcctcagcctcccaagtagctgggactacaggcatgtgccaccatgcctggctaatttttgtatttttagtagacacggggtttcgccgtgttggccgggctggtctcaagctcctgacctcgggtgatccacccgccttggcctcccaaagtgctgggattacaggcgtgagccaccactcccggtctaactttattttttattttttgagacagagtctcactttgtcacccaggctagagtgcagtggcaccatctcggctcactgcaatctctgcttcctgggttcaagtgattcttgtgcctcagcctctagagtagccaggattgtggctaagttttgtgttttttttttttagtagagatagggtttcaccatgttggccaggctggtctcgaactcctgacctcaggtgatctaccagccttggcttcccaaaatgctaggattatagctgtgagccactgtgcacaaccaactacttgttaactttaaaaaatacgtatacctccaatcatttttctctttgaaacaaatcacagttcttcccaattatatcattaatagagaaatatgtatggtttgtaaaatattaatacagaaactgattgtttctgggagaaaaattggatactaagggacattttttttcaattttgcattggatgttaaacttatttaaaaataaagtagaaaaaataaaattaactacagataaagcttaaataccctttcaccagtctccctaattctagtctcctttattcatgcccagaggtaactaccattgacagtttggtgtgcattcttccagactttatttattttagatacagatatttagggtctcaattggtcatccaggcctcagtgcagtggcgtgatgatagctcattgcagcctcaaactgctgggctcaagccatcctcctgcctcagcctcctgagtaccttggactataagtgcatgccaccatgccaggctaatttttatcttttttatttttgtagagatggggggagggtcttgctttggtgcccaggctggtcttgaactcctggcctcaagtgaccctcccatctcagccttccaaagtgcggagattacaggcgtaagccactgcactcggccttcttccaaatgttattctgtgctttggatatacatagaagtgtatatataaagagggaatactgtttggaagtattatgtatatcattctgtggcttagttttttttttctcttggacatctttctatagagatgtgccttttcgaggctgaatacaattagtttccagttttttatcgttataacctgggcttccacaaatacccttgtacatgtctccttggcacatgggcaagtgtgtgtttgtaggtgaggtagagaaagggagtggctgggtcatagcctttctgcattttacctttacctagacactgatgaatcaccctccgtgatggctgtaccaatttatactcccaccagtggggtagatgaatgtgtgagaggcctcttttcctacacccttggcaacatttgatagcattaaacttttaaacctttcagaaacatgataccttatttacattttcttggcctttttaaaatttaaatttaaatttttgttgagatggagtttcactcttgttgcccaggccggagtgggatggcacgatctcggctcactgcaacttctgcctcctgggttcaagtgattctcctccctcagcctcccgagtagctgggatgacaggcatgtgctaccacgtctggctaattttgtatttttagtagagacagggtttcaccatgttggtcaggctggtcttgaactcctgacctcaagtgatccacctgctttagcttcccaaagtactgggattacaggtttgagccaccgtgcccagcttcttggcctttttgatggcaaaaatagaagccgccttttctttcttttttttttcttttttttttttttgagatgacgtctcactctatctcccaggctggggtgcactggtgcaatcttgggtcactgcaacctctgcctcccgggttcaagtgattcttctgccccagcctcccgagtagctgggattacaggtgcgtgccaccacacccagctaatttttgtatttttagtagagacgtggttttgccacgttggccaggctggtcttaaactcgtgacctcaagtgatccgcctgccttggcctcccaaagtgctggattacaggaatgagccacagcacccggccagaagccaccttttctaacagctgtatttcatttgtattccactttaaggctacagctttttaacctgtttcttattgatggatatataggctaattccaattttgtgatattggaaacaatgctgtggctgggcgtggtggctcatgcccgtaatcccagcactttgggaggccaaggtgggcagattgcttgatgccaggagtttgagaccagcctgaccaacatggcgaaactctgtctttactaaaaatacaaaagttagccgggtgtggtggtgcatgcctgtagtcccagctacttgggatgttgaggcatgagaatcgtttgaacccaggaggtggaagttgcagtgagccaaggttgtgccaccacactcctgcctgggtgacagagtaagactctgtctcaaagaaaaaaagtaagggaagaggagggagggaattctgggcagaggaagtggcatcaggagtaaaggttgggatggctttgtcctgtgtgaggaattgagggagggtaggctgtgggccaggctccctctcatccctgcgcaggcagggagggtgggcatccctgttgtgcacacagggcactgaggcctggagaagggaagcaggctttgctggacataggcctgtgagaagtagacctggagctcaaacctggcctatttagagccaggatgccatcctgccactgccgagggaggcaagtgacatgtgtcgaagcagacgcaggggcagaggagactggagacacaaagacagtggaggggaatggggaaatgacacgtgttcaagatctgtgtgagaagccttccgtttcaggctgaggagctcagtgatcatagggaggccctgaaagttggaaatctgggctcagacctcatctgccacctgatgtctcttctgtgatattcaatttttttttccagaatcgttgcagtgtgccagtagatcaggcctctgagtcactgctgaaaagcaaagcctgctttggagctgaaaacctcatgagggttctggggaactattgccgccttggtgaagtgcgcacccacattcgtgtgggtgttgtgggtaagacctgctgtgtggtcatggggctcaggcttctttcttgagcggacacttcgctgggggaaaggatcctgggagcttcattgtcttttgcggggagagaggagtggttcaggagaagggtttcgtgatttgtaacttggatgggtgggcatcactgcgtattgagtattagattcatggagcaaatacagggtgccaggcttggacttggtaccatctcatcctatcagagctatgggaggatggggtgaccgtctaccttttacggatgagaattctgagtgaggctcagagaagggcaaagggacttttggagcccagccctgtgcaagacaaggcagagctgaggatcaaaacctgggcctttctggagcacaagtttctgagggagggatgatgggaatggagtagggaaattgagagaggcagagatagatcaccagagaaagaatgtgaagccacgtgagaaagacattggagagagagctagacactgagaaggtataggtatgcataccaggatagatacagaagaagacacagagaacgcactgggaagccagatggcaggattggtggggaatggaaagaggagacagatttacatgatggaggcatgtaaagagggagatacaatcagaaacaccaaaagggacatagaaacagacatgcatacagagatctgccgagggagacataggaagggtagagataacccatgtatgtagagaggcagacatgttttctcaaagaatgagagagaaaaacatactacagggatagagacagattcagagagagacatacatggaagcagactggacaaggctgtagatacagaggaacacatacacatagctcttaagtacacatacagatccacaaacacatacacagacccacgctacagacccagagatccagaggaggcacatctagcgagacagaaccacagtcaaaatgcatgtagaccaagcccttcccacacacacccaccccaacgctgctcccccaacgcgcatagaaccacaaggagggctggatgtagcagctcattcatgcctgtagccccagcactttgggaggctgaggcgcacagatcacttgaggtcaggagtttgagaccagcatggccaacatggcgaaaccccatgtctactaaaaatacaaaaattagatgtgtgtggtggcgggcatttgtaatcccaggtactcgggaggccgaggcaggagaatcgcttaaatctgggaggtggaggttacagtgagttgaggttacagtgagttgagatcgtgccactgttgagatccagcctgggcaacagagcgagactccgtctcaaaaaaaagaagacacgcatgtgcccacatacactttgaccctcgaacataatcacatacctagagttacagagggacacaaataccagacatgtcactatgaggcaggtatgtgtacctgtacagagagaaatagagacatacagagaggaggttaaggaggcgcagacagggagagagtagaagagacaccgtgagacacatacagagaggcatccatgaagtgaccagcccacagagatgaggagcatggacagaggctgacaggagttggcatggagggaattacaaatagaggcaggattggtggggtggagagaatcagagagaaaagaacaatggccagaatgagagacagacaaattggcagagaaagaggtgcttagatacagagacacagagagaaacaaagataagatagagaaagagactgagtgggagagatacaagaaaaggaaaaagtggtgatactgagaatgggaatgaccgagagagagagagagagagagagagagagatgtgtagagacttccatgcatggtgataatttagaatgagaatgacctagagagagggaggggggagagaggtgtgcagaggcttcatgcacgagaggtatacttagacatataccttttttttctttaggcaatcagctttctcgggttgaaacaagcatatgcttgagacaatagtacacacatgtaaattgagcacatacagaaagagaacggtgagaatgaggcccagtgaggggaaacacaaagacatccacaggctgagaatggctgacagatgcacaaacagcaaaatacacacctcaggtagacagctgcacagagagactggcatctggagatgacctccatccccatccatggaatgatacacccagacaggttgttctctgtttcttagacatttctcgatgtccaccttctgttggattgtgccactgaggccttgcattgaggacctctgcctggctgattgtgagtgggaggttggtgtcacgtctagaaagagggacatacctatctagcatgctcacaaatggaggggagaggtagaaaggccctgtaggggctttgtcagggcctggggtgggaagggaggaggtcaggctcaattttttggcttccccatggcctggttactacccctggctaggcctccctcacacaggctggcctgagtgttcctgagggcctcttctgccctgagccatctgctgctattttgtaggtcttcccaatgttgggaagagcagcctgatcaatagcctgaagcgcagccgcgcatgcagcgtgggagctgttcctggaattaccaagtaagcacctgcctgctcctccactccacaattccttgaccctaccatttccccccaactcccatgccttcagcccctgtccctttccttatcatggaccatcccctgatgctttccccaggcatgggagtctcatagccctcattttcctgatacaccctaggtgtgggccaggtccccacatgggtggttcccattagcgccttgaagcttctgaataacgatgcaagattgggctacaaatgggagctctgttgactggatgaagcagctgaggcttggagagtcaagcttgcccaagatcctgcagctcagtccccagtggcagaggatagattagaatcagcctcaagtctgtagagccccagtcacccctcctccaactctacatctctccaccttcgtctctaatgcaccctcccctcactcctttacactcccacatcccaggcccaccttcgtgattggggcctctacgatgccaggtacatctgggctttcttcttccccgccccagattcatgcaggaggtctacctggacaagttcatccggctcttggatgctccaggcattgtcccagggcccaactcagaggtgggcaccatcctgcgtaactgcgtccacgtgcagaagctggcagaccctgtgaccccagtggagaccatcctgcagcgctgcaacctggaggaggtccgcagcagagccctggctgatgccctgccctactctaagggcccttcattcctcctcatgacttctctccttcctcccttcaccagatttccaactattatggcgtctctgggttccagaccactgagcactttctgacggcagtggcccaccgtttggggaagaagaagaagggaggcttatatagtcaggaacaggcggccaaagctgtcctagctgactgggtgaggtgaggagggggttaggggtaagggtgaggcccgctggcagcctggctccccaaaggggctcatctgtgctcattgccgctggggcagcttgacttcctgggtcttggggcagaggatggccaaggtgccaggtcatgtcctgctcgagactttatgcccagtgattatccagcaactcaactccttcttgttcagaagccactgtctgggttttcttgttccgttgctgtttctggcctgcaaactcatcgtctcttggattgtcattggttctctcagtgacagcaccactcatctcccctatctcccaatgcagcgggaagatcagcttctatataccaccaccagccactcacactctgcccacccatctcagtgctgagatcgttaaggaaatgaccgaggtctttgacatcgaggatactgagcaggccaatgaagacaccatggaatgtaagtgtgggcagggtgggtgcacttggtcttgcactagtggggccacacagacctgacagcaaatcccacttttgacctcccgcttccttggccctacttgggctttgggcaagttgcttaagcagcttcaggcctaatttcttttcttgcaaggtggggaattctaatctggccctggcagggcgggttgggggagggtggttgtgagcttttggtaaataacgaaagaaaaagtgcctggtacccattgaggtgctctggaaatgtgaagctccattcctgtctcttgggacctggaatggactgagacattctctcaaaaactctctaatgttgccttaggctttttcacaaccacttcaggtccacttctcgattttccttcttacccctatcggtgagtaaggtacccaagtcacagaaagctgatatttgccaaaaggatgtcagcagaggtggcctttgacccagttctcctgccctgttgaagactcttccagctcacaggagctgggtgtccaaaagtatagactgcctggattcaaatccgagctttgtttcctttttactgtgtgatgctaaacaaattacttcacttctttgtctcaatgatgtcatctgtaaaatggggacagtaagtccacccgataaggtagttatgaggatttttttaataatgtaaaagacatttagaacaacagtgcctggcatatagtaaatagatgctcagtaaatgttagtttttattaagatgattatttgctggggaacagagatgtgactctcagaaactcctgagaatgtttgccctcctcagatattactctctgcagccctggcttgtggctccctgcttcattctctacactgcctaaggaaggtatccagtgccttctgggcttgtctgtagacattatggggtagttgaggaagcgttggctagcctggcttctagattctctgttttttctcttgaggtccagtagttttccttctctgggtcttttagtgtccttgtgttacacacgaggttaagaggacttgcctgctttctagtttgtatttcatgtggctttgagcaagtcagccccctttctgaatttgtttcctctttttgtttttttttgaggcagaatcttgctttgttgcccaggctggagtacagtggtatgatctgggcttactgcaatctctgcctcctggggtcgagtgattcttgtgcctcagctgcctgagtagctgggactataggtgtgcaccaccacgcctggctaattttttttatttttagtagagatggggttttgccatgttggccaggctggtcttgaactcctggcttcaagcaatctgcctgccttggcctcccaaagtgctgggattacagacatgagccactgtatctggccttagtttcctcttctgttaaatagggcagttgagaggggtttgagtttatgttcttatgatgatgcttgaccctggctggatgtgagggcaagaggtgctccatcactgagaatacattttggccaaagactgaggtctgagaaattgagaagacagtgaggaacaggtttagtggtgaaggtttcctggaggacttggccctagtgctggatcttgaagggtgagtagggattagaaggccgagggtagggaataggggcaaaattatagaagcaggcatgagggtagtggggcacagggcagtgggcacatctgagggttgcagtagaggccagctccaggcaaggggccagagagaggaggagaaagtctggtcctggggagggaatcccagtgcctgccatttacagagcagcatcttgggccagagcattacagacatctgccatgtctcacagcagcccagtgtgaagagggcttgtggaattcccattttccacatgaggaagctgaagctctgagtccagctcccagcaagtgaatgtcctactgcaaaacccatgcttttaattcttggtgatgtggcctctcagcaggagtgaaaaagttcctgcacctgactcccctgggaagcatccatgtatccttttcactgaggcctgaccagggggctggcaacagaggggagccagggccctgacagtggtgttggttgtgttaaaggcttggccaccggagaatctgatgagctgttgggtgacacggacccacttgaaatggagatcaagttgctccattctccgatgacgaaaatagcagatgccattgaaaataaaaccaccgtgtataaggtacctgtcatctttgttcatggcaaccctcttctctccccagggctctgggaagtggtcaatcccttttacctgcctttcatgtggtgagatgtgggtagttcactcgctccctatgggcttctggatgcctggcctagtatatcctttaccaagcaatgacaggtccaggaaacaggcatgctctctaaggcagctttcccagctctggttctagcccatagaacaggtatcactatctagccacccagttgtccaacttgcaaacgactctttcttctccctaactagtaccaggattttattttattttattttttatttttttatttttttttgagatagagtctcactctgtcacccaggctgcagtgcagtggcgtgatcttggctcactgcagcctttgcctcccaggttcacatgattctcctgcctcagcctcccagttagctggaattacaggcatgcgccacgacacccggcttaatttttgtgtttttagtagagacagggttttgctatgttggccaggctggtctcgaacccctgacctcgggtgatctgcctgcctcggccttccaaagtgctaggattacaggcatgagccaccatgcctggcctgggatcttatactctgtcagtcagcaagacctatgtcttctccctcctaaatcttttgacaagcttttcatccttttcatccctaccattcctgttaccctaaactaagcttccagccctcacttacttggacatatgtcccaaggtttctttctttctttttctttcttttttgagatggaaactcgctctgccacccaggctggagtgcagtggtgtgatctcagctcactgcaacctccgcctcctgggttcaagcaattctcctgcctcagcctccggagcagctgggactacaggtgcctgccaccatgcctaattttttttttttttttttttttttttttgtagagatggggtttcactgtgttggccaggctggtcttgagctcctgacctcaggtgatccacctgcctcggcctcccaaagtgctgggattacaggcatgagccactgcacctggccgtgtcccctggtttctaatggcccagtctgaccatgtcacctcccctgcttaaactgatttcatggctccccaacacctacacaatcaagtccatatacctgtggcctgctattgaagatctgcagggcatgatatgatgactcctagaggttttttcagcctcttcttctgccagtccatcctccatctctgcccttgaggagttcatattttagtgggtttcagacacagacatccgcactgtgatgggagacacatagggtgcggataggggtcgaggttgggacagcatggatccaaggaccctaacctgtactacctgtgggtcaaggaagtcttgcttgagtcatgtattagtccgttttcatactgctgtaaagagctgcctgagactgggtaatttataaaggaaagagatttaattgactcacagttcagcacggctggggaggactcaggaaacttacaatcatgtcagaaggtgaaggggaagcaggcaccttcttcacaaggtggcaggaagacgaatgaacacaggaggaactaccaaacacataaaaccatcagatctcatgagaacccactatcatgataagagcatgggggagaccacccccatgattcaattacttccacctggtctctcccttgacatgtagggattatgggaattatggggtttacaattcaagatgagattttgggtggggacacagccaaaccctatcaagccacgtcttgaaacctgaggagttctctgggcaagggggtcagcagcatgtggtccaggacccagccatgtcagccaggctggtctcgaactcctgaccctaagtgatccgccctccttggcctcccaaagtgtttggattacaggtgtgacccactgcgcccagccagagacagacactgtttttggtactcaggtgtgctctatgttttttcagtgttcagtcaggaatgacccctccccatcagtagtatgttgaccaccactatcatccctaacctcagtcactcatccttcatgtttctgatgggcagttaccatactctgattagtggtatagatcattgtaccttctttagcctggttgtttcctgaagatggaaccgaggccgggcgcggtggctcatgcctgtaatcccagcactttgggaagccaaggcgggtggatcacctgaggtcaggagttcgaggccagcctggccaacatggtgaaaccccgtctctactaaaaataaaaaaaattagccaggtgtggtgatgcacgcctataatctcagctactcgagaggttgaggcaggaggattgcttgaacctaggaggcacaggctacagtgagccaagatcataccactgcactccatcctgggcaacagagcgaaactccatctcaaaaaaaaaaagatggaatggagtcactcatttctctgtcccagcattgccccacacggagctggacacaaagtagatgtcaaaaaaaaaatttttttttaagacagggtcttgctctggcacccaggctggagtgcagtggtgtgatcttggctcactgcagccttgaactctgggctcaagcaatccccccacctcagcctcccaagtgcctgggattacagatgcaagccaccatgcgcagctaattttatttttatttttattttttgagacagggtcttgctctgttgcccaggccggagtgcagtggtgcagtcttggctcactgcaacctgcacctcctgggttcaagtgattctcctgcctcagcctcccaagtagctgggattataggcacccctcaccatgcctggctaatttttgtattttcagtagagaaaggtttcaccatgttggccaggctggtctcgaactcctgacctcaagtgatctgcccgcctcagcctcccaaagtgctaggattacaggagtgagccaccatgcccagcctcccagctaatttttaacagaattgtttgtagagacgaaggtctcattttgatgcttaggctggtctcaaactcctgggctcaagtgatcctcctgccttggcctcccaaagtgctaggattacagacctaatcctagtgaaccactgcgcctgccagaaaatttttttttttgagacagagtctctgttaccaggctggagtgcagtggtgcgatctcggctctctgcaactgccgcctcccaggttcaagcgattctcttgcctcagcctcccgagtagctaggactacaggcgtgtgccaccattcccagctaatttttgtatttttagtagagacggggtttcatcgtgttggccaggatggtctcgatctcttgactttgtgatctgcctgtctcagcctcccaaagtgctgggattataggcatgagccaccgtgcctggcctaccttttcattttattcttgtagaagccatgcaaactaccccttatccaccccccatttgacagatagggaactgaggctgagagttaactaagcacctgctggagtgtggtggggccagaattggagcctagttccacatggctccaggctcctgttcttacccaagcctgtgtccctaccttttctgcagaagtctttggaggttctctgggggttaagacctcatcgttatgttttctgtctcttcctagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcaggtgggagccccagaccaaccctgtgctctgaaaggggcccacatgggatctttttttgttttttttttctggctcactgcagtctccgccccctgggttcaagcgattctcctgcctcagcttcctgagtagctgggattacaggcacctgccaccatgtccggctcatttttgtatttttagtagagacgatgtttcgccatgttggccaggctggtctcaaactcctgacctcaggtgatccacttgcctcggccttccaaagtgctaggattacagatgtgagccactgcacgtggccccacctgggatcttgattggggctcctgaatgagtatctctctgtgtccagctccagtctagggttgggggcagggatgagctaggaggctcaactactagcacagtggctctcaaacttcagctcgcatcaggattccctggagggtttgttaaaacacagatttctgtgcccctccctcatagtttctaattgagtaggtcttctgtggggcctgttagaatttgtatttctaacaggttcccagctgatgctatttctctggggatcacactgggagaaccactggcctgcctagtctatgtatcaaataacgaccatttatttatcaggtactctctatgtgttaggtagcttgcaggctatatatcaataggcaatatactcaaaatcctacacgtacaagaggatatacagtaaaatctctcccacccgctagtcatccagaccgccccctcgtcagccagttagtttattgtgtcttttctgagacacaagcaaatatctatatattctttgttctctttttccacacaaatgccaatctactggacacatggttttgccctatcatttttccactcactatgtcttagggatatgtctatgttaatacacaaaagaacttcttcccctcgttttaatggtggtacattgtgtagctggcccatttgggtttccatgctgtacttttcactaactcattgcaaaagtcttccccttatttgataagtgagaaaactgaggtccagagacattaagtgacacgctaaaggtaagacaacttgtagttgatggagccaaaatacagactttgggttgattgaccccaacagccctattctttgaactagattgtgttctgtaaccaaacatacacaatcagacattcactcttggcctggctccacactgagtcctgggaattcagatgaattgcctttgaactcctagtcttattagggagtgaggaggagacaagaaaacagaccttggcagcacgagcacatagtaatcacgttgaagacccagcaagcacagtgagggaacctaacccagcctggggatggtggttggataggggtgatcagagaaggcctcctggaggaggtgaagtctggggggcatcctgaggaacaacagggtgtgtctgggggatgggaggtgtgcgtggtgaacgttcaggcttatggcgaacatacagccgtgttgccctttgctgtgagagctttgttttgagggtaatggtagagcactaagtttgacatagtaaaagaaaattattgctttggtatttggacaaaaatacttggagcccagtgagtctgaaaccctgagatagaagctgtgttgggatgatcatttcacagatagaaaaatggattgtctacctgtgaagctgagcagtggcttccagcactcaccagttttgtggtagcgtttgggggtaagtgagccagttcaggagcttggtgtagaccaaggtagatgtaggccagcgtcagcaggcctcctggtggcaagccagccaccaaaagattgcctgtatttctccatttgcagataaaatcgccagcaagctgtctgattccatgatgtctgctctcgacctctctggcaatgctgatgatggtgttggtgactaatcgactgatctcacttcccttccgctccaagcaccagttccggtggtacgggggaataccagtgaaatagtttggttctccctgaagcatctgcatattgaaagaacgctttccccactgtgtgtcttctccccctcctccagtaaaaacagtcccggctaggtgctgtggctcacgtctgtaatcccagcactttgggaggccgaggtgggcagatcacctgaggtcaggagttcgagaccagcctggccaacatggtgaaaccccgtctctactaaaaatacaaaaaaatttagccgtgcttagtggcacctataatcccagctacttgggaggctgaggcaggagaatcgcctgaacctgggagactaaggcaggagaatcgcctgaacctgggaggcagaggttgcagtgagcccagacggcaccattgcactctagcctgggcaacaacacgaaactccgtcccaaaaaaaaaaaaaaaaaaaaaatcccaaggggctgcagctgccaaacccaataccctctatttaacccctactctgttttacaagagaaataaaagaagtatcagcagagctcaggtgctaacacctgttgagggctgacctacaaaactctgcctacaaaactctcttagacaggtgaatatgccactagaagttaggttgctggtagacctgggggtccctgcgggagggtgatggtttctttaccaccccacaggagatttcagtggcaaggcatgcctgcagtgggctttgggccatgcatcttccaagtccataggtcttcacctgggtggcagtgagaaaaagtagaaagtaatgagcctcctgtgtctctggaaggttctagggatagggtagagggaagaagagaacaaacaagcctggcttgtgctgaagtgtggtaggcactaccctgtttgcgtgaagagaaaacaaagcacctgttagtagggaggctttagggggaagccccgtcttgggggcatttctgggcagattgtgaattggaggaatctctttaactgaagtactctggctggaccctgcccttgtgtgaccatgtctcctattgcaccagcatttgaattccatggctcaagagggttctggtaccatttattcacagactgtatcctcgagagagctgctatatatgggagtgtaccagccaactccttttccagtgtctgtaagtcacctcattaaagtataattagctgtctcctctgggagatcctaccccatcagacaagggcagtgagcccaagcagtgccagaggccctcagaaagggattagggtagatgattgcaactgaaacacaatcttctttctttgccagggtattttgggggttttgccccaaaatataccctgggcatagcattactgcagtcttggatgtctaccccaaacttccacaccatccttcgacccacagctgcacctttatttatttattttgctctgttgcccaggctggagtgcaatggcgtgatctcggctcactgcaacctctgcctcccgggttcaagtgatcctcctgccttagcctcccaagtagctgggattacaggcacctgccaccacgcctggctagtttttgtatttttagtagagacgatgtttcaccatgttgaccaggctggtctcgaactcttgacctcaagtgatccactcgcttcggcctcccaaagtgctgggattataggcgtgagccactgtgcccagcctcacagctgcatcttaaccttacctttgcctctgcctctcaagctggtacctcctaatttacatcctaagagtggaaccatgtgacaaggactggagtgccattggctgtggactgttcaggcagggaagtacaagaccactcttgtattcaggggcaaccaaaggagagaattacgtacttgttgagtacaaactgcaccaagccctggagacccattaccaccgttaaccctcaatacagctctgctagtaagggattcgtctccccaaatgaaaaaaaaaagtaatctcagaatgttggccgagcatggtggctcacacctgtaatcccagttatgcaggaggctgaggcaggagaatcacttgatctcaggaggcggaggttgcagtgagtcgacatcacaccactgcactccagcctgggggacagagtgagacttcgtctcggaaaaaaaaaaaaaaagttgacaggatggccagacccaagtgggcgtattaagtggtggtgctaggattggaacccaagcgtgattaaaaccctatgcaggccctttcctctatattgtactgcctccttaacaaaggaagattgattaagcccctactttgtgccagtctctgttatcaagtccgttaaatgcatttaacgttaaattttttcttttttggtttaaaaaactctagtttcttaaactactagtttttagtgtcttgctaaaactatgtgctcttgaataggctacaacttatttcacactatctcattgaactctcctggtatgtgatagtgttataatgaaaaattgcataccaggacagctaagtctattttgcaaccatacagcgtttcataatttagcatttaaaatacagacagtccccgacttttggtggtttgatgtgggatttttggtggaaaagcagtatacattcagaatgcacctctacttatgatggggctacttcctggtaaacccattgtaatgtgcaaattacgggtttatcaggaggtgaccccatcggtaatggagaagtgctgggaggtaaatattagaaatggaagtatctaaatgagtaagaaacagcatgggagcataatttggccaaaatcaaacagaactaaagtagtcatgtcggtaagaatttgggactgcaggccagttacgatagctctcacctgtaatcccagcattttgggaggccgaggcaggcggatcacttgaggtcaggagttcaagaccagcctaaacaatatggcgaaacctcatctctaccaaaaaaatacaaagattagctgggcatggtgtctcatgcctgtagtcccagctacctatggggctgaggcaggaggatctcttgagcccaggaggtcgatgctgcattgagccgagattgtgccactgctctccagcgtgggcaacagagtgagactgtctcagggggaaaaaaaaagaggaaaacaaaaaagacgttgggagtgcagtttctctacctacagcatatctcaaaggttttttttaaaaaagtattttcttaactttttaccttcatttttcaaaacaattagggtacaatttacatatagtaaagttcactctttatagttttagttatgtgagtttgtacaaacatatacaggagtgaaccactaccacaatcgaaatatagttgcatcacccccctaaaactctccaggcccttttgtagtcaactcctacccccgaccctcagattctgctaaccactgatttgttttctgcccctatagttttgctttagtatgactgtcatatcaatagaatcatacaatgagtaggcttattttatgccttcaggttttaaaaattataaacatttacattacagtaaaattcactctggtatacagttctataaagctctgataaatgtgtagagttgtgtaaccaccaatgcaaccaaggtacagaacagtcctcttagcctctccctaccaaatttattcctgctactttgtagtcaaaaccagtcccctacacccaaaccctggcagtcactggtttttttcttcgttctcttttttttttttttttttttgagacagagtctagctctgttgtccaggctggagtggtgcagtggcgtgatctcggttcactgcaacctccgcctccagggttcaagcggttctcctgcctcagcctcccgagtagctgggattatgggcgcccgccaccacgcccagctaatttttgtatttttagtagagatggggtttcactgttttggccaggctggtctcgaactcctgacctcatgatcctcctgcctcagcctcccaaagtgctgggattacaagagtgagccactgcgcctggcctttttctttgttcttatatttttgtcttttttttttttttttttttgaaacagagtctcactctttcactgaggctggagtgcagtggcgtgatcttggctcactgcaacctccacctcctgggttcaagcgattctcctgccttagcctcccgagtaacagggactacaggtgcccaccaccatgctgggctaatttttgtatttttagtagaggcgggggtttctccacactggccaggctggtcttgaacttctgacctcaaaagatccacccacctcggcctcccaaagtgctgggattataggcatgaaccaccgtgtccggccatatattttcgtcttttgaagactgttatatacatgaaattatatggtatgtagcattttgagagcgacttcttttgctatgagtaatacatttgagattcatccatatttctcagtatattaatagttcttatttctgagtcactccattgtgtggatttactactgtttgttccccagttgaaggatgtttaggatctttgcagttttggacaattacaagtaaagctgctataaaca

SEQ ID NO: 131 - DNA, 67004 bp, mus musculus
agtggctgtggtggtggtggtggcggcggcagcctcagctcctgctccccgtgccgccggccccagcgctgtctcccgggccccctagggcccccgggccctcaagcccggtgcgcgccctcgcgtcccgccggccccctcccccggctgggcccgggggagggtggcgccgtgagagagcggggacagggctctcctgcccgttcccctgcccctgggccgccaggatggaggcggggtcggggcccccgggcggcccgggatccgagagcccaaatcgggccgtggagtacctgctggagctgaacaacatcatcgagagccagcagcagctgctggaaacccagcggcggcgcatcgaggagctggagggccagctggaccagctcacccaggagaaccgcgacctgcgagaggagagccagctgcaccgcggggagctgcaccgggacccccacggcgcgcgggatagcccgggccgcgagagccagtaccagaacctgcgcgagacccagttccaccaccgcgagctgcgggagagccagttccaccaggcggcccgggacgtgggctacccgaaccgggaaggcgcctaccagaatcgggaggctgtgtatcgggacaaggagcgggacgcctcctacccgctccaggacactaccggttacacagcccgcgagcgtgacgtggcccagtgccacctgcaccacgagaacccagccctgggtcgcgagcgtggcgggcgggaggccgggccggcgcacccgggccgcgagaaggaagcgggctattcggcggcggtgggcgtggggccgcggccaccgcgggagcggggccagctgagccgtggcgcatccaggagctccagtcccggcgccggcggaggccacagcaccagtaccagcaccagcccggccacgaccctccagagaaagtaaggaatgtgtgtttgtacccccggctcttccctctagatccctctccaacttgtccagctgatagagtaagaagccagtgtctggttccgtgtcttcctctcctgtcccaacccgccaggagaagccaggtccccctcatccagccgacaccccttccctggccaccccaggctgggttggccagatgagtgcaggcgtctcttctttcccggtaccgcggccagcgagggactagagcagtcatcgccgcctcccccgcctccacttcttcaacccctagctgcatccttgccagaagataggttttcatttatttatttattttgggtatgctggttggaatttttatggtcggcgagggtgtctactcagagccccaggggagagaaagccccccacccccgcctttttttttttttcctttttctttttgcctgatcttttctcctctggccgcctcagctccatcccttaccaaagaggcaggtggggaccagaatggctgctggaggctgagacatccctctgaagggaactgcagcacattctggccggggggagcaaagatgggggagcaaagatggaggccaagcccttggctagttcctcaaagtccaccccctctccacccttcaagaaaaacaacacccatttaaagagccctaccgggaagggaagtctagattgcccctctgctggatcggttccagttcctgcactggggtctgtgtgtctatttgggacaccttggcactatctcttgggttggtgggacatgggctgggtccactttttctgtgtagataccatggtgagctgattgggttacatgtatcaggctgagagagtcaagggcgtgcagactcccaaggctgccctaaaggctcccttatttcttttctgccgtattcgaaggaacactgagctgggagttgggagacctgagttccccttccagctctgctgcagattggctttgtgaccttgactgagtctctttctctcttaggccatcagttcccccgtatctttttaaatggcaaggtctgccttggatgatcttgaagtacccctccagctcagatttgatggttctatgtttaatccagccacactacagagcaagtctgaagtcctgtagcgaatggacaggcttccccctcctctcactgctcagctggtcctaccatgtgccacaaccagtggagtgtctcttggaggctgggctgggggtggggaaaccttctgcctcaggaaatctgccgggagacagctctctgcaactcccccgtggtgaggcagcaggctggggtgctgggttgagatggctgggccccaggagcagcagctgtagcttgagggctcggctgggctccactgcagcacaccctaagctgaattttagtgtggactgcccctgaggagtctgggggcaaaggaaatgggctttcctgcccaggcagggctgctgcgagctcagtccgggaggaccgactgtgtgccttggggcgccacactggaagagggacagaggtagaccaaggtccattcagggagggtcatggtgggccgggggcagaggaagactgcatggggtatggtcgagcctggctgcagaagacttttctagaggggtcaggcctgtgacagagggagcggactcattatgtgtggcttcagtgagcagaacccgaaacagtgggaacatttgagatagattaggaagaactttccaacctggcattctggtggtgcagtggactgcctcgagaggtggaggtgggagctggatggacctggagctctcagcggagctcgggtgggagtctgggagaactggaggaagcatgattcctgaatcaggtagaaagcccagtgaaatgacctgggtcgtccccagttatgggattccatgactctggctctccaccctgcagacattggtctgaatctcttggctgactggttgcctgtttgctcctgagctccatgtttctgctatccgtgcaggcctacctcttggtccttccctctttttgtgaacccccccaggttgcttgttgcgtttccttgctttgcatttcctactggattaataaaggggtttaggtagtactttaagtttctctcctgaccatatattaactatttgcacacccattattacctctttttgacttcacaacaagccttctgcagtgagtgttggcaactgcattttagagatggggaaactgaggctccaagatgaagggacctcactcaaggttaccctactagttgctaatggagctgggactagaacccaagtcttcctgtctccaaggcctggtatttttttctctagagctctccaacccacaggagtctcttagcctcaggacctggcctggcactgagctaggagaggccaggagagccttaggtctctagaggatttgagcaggaggagatgagtctgggatgagtggggagttgacagcggcagggaagaaggctctgtctccctcctttccactctccctcctggcctggcatcaggagggcctgttgatgcagtagccattgctgtcactgctgctactgcaagcgactcccctgctaggtctgttctgggtttgtaaggagtgggtgagaagccgctggaagcgagggcaggcagggtgggagtttagcagcagaggctgcagcattgggggaggctaggtagagcgggtacaggctgggctctcttggtccccaggctccccctggtggaggaagaggggagagtggtgcctgggccgagctgcagcttgttgggggggccccgctgtgcctagggactttctttagtcctcccaatgatcccgtgcttctgtcaccacgatccacattttacagcagaagaaactgggggatcagagaagtgaagcccaccagaggttacattactcataagacagactcccaatcctgtgaactttccctctactgcattggacatcagctgtcatgtccacccccatccatgtcatccacccaggattcccatatcctcctgcaccgtcccctctggacaggttccaggatgccagtatcccttctgctgtgctcagggtgtggcctttctagtgcagatagagtgagatgcgtccctgtctccttttggtcctgggtcctctgtacgcgaaggttttgtttgcttgctttttagtcgttggtcctgactaatgctcaggtctttttacctggaattgtccacatacccccccaagcctggttgattagagaatagctctgcttttgttgttgatcttggcttggcccccttgcagtcctgccacctagagtgatatataggagtgctaggggcccctgctgagttgctccacgctgaagagctgcgtttcccacgctctttgcatgggcccagctccggctctgctgtaggcggtggtgggctgaagctggtatggtggcaactctccttcctttacccccacccccatccaccctgcaagctggcttacacttggagatagcaactagaggggctggcctggtggtgttttttttctttttcttttttttttttttttggttttggtttgtttttgggacaggggtcttgctctgctgctcaggctggagtgcagtgttgcgaacatagcttactcaagtgagttcaggagtttgaggctgcagtgagcaataattgcaaaaaaggaacaccaggctggcccttctagttgctatccgcccaattcttttaagcagagacggggtctctctgtgttgcccagactggtctcaaactcctgggctcaagcggtcctccctccttggcgtcccaaagtgctgagccaccacgcccggcccaacgtggtattcttgacagctagggcagtgtatggtctaccacatgctgtcgtctgcttgcagtgggatgtcagcatgctccccgcaggggctaaggccactgagagacagcacgtgagacagtgagcccagggagaggctcagggaagtctctcctttggggtcttgggtacttttcccagggggtgtctctccttcccaggagggaaaaccatttatcttccctcccactgtgttgtgagcattatcttcgtgtgggaggaaatggtaatgttgaatttaatgagaatgagagtcttgcttctctatctagatctggggcaagaatggggttgttatcatctacaaacatttcttggctgtgtgcacagcgcaggaggggccacgaggctgagcaaacactgcactcttagcgcttgcagaacccctgctcccctccatccagggagacagggttgcaggcctagccatgccatagaggcaacactcaggacaaaatgagtggcaagaatggtgaggagtggaagttctcagaggaaggagggatcaggccaggccaggctgctgtttgagtacctgggcggtgggtgagggatgaggggtatggaaggaatgtgagtggtcccttcatggaggtggcagctgggaggaagacgtcagaccagacttgctgcctgccctttcctcatctgtcccacccctgcctaccaaggtctctgaatttgctgggcgcagagtaaaggcctggagcatggggaagaggccacacgtgtaccgagtgagtctcagccttctgccaggccccacgctatgtgactttatgtaataatagctaacattttttcactgctcttactgtgtgctaagcactatttgttctaagcgctttccatgtattaattcattcaatctccacatgaatcctctcgtgtagatattgttattaactccattttacagatgaggaaactgaggcccagaaaggttggatagcatacccaggatcactcaatgaataagtggcagaactgtgaaggagctggaggagcccagggagttgggcttcagggtccgcagtgttctaacccaccctggagcactacttcttacctcatttgcacagagcccctgtcagatgggtgtgttcgtttgtttgtttgttttatgagtttcactcttgttgcccagactgaagtgcaatggcacactcttgactcactgcaacctccacctcctgggctcaagcaattctcatgcctcagcttcccgagtagctgggattacaaacacgtgccaccacccccgactaatttttgtatttttagtagagacggggtttcaccatgttggtcaggctggtctcgaactcctgacctcaggtgatccgcccacctctgcctcccaaagtgctgggattacaggcatgagccactgcgcccagcctattatcttcattttttcagacaaggaaacaaggatcagagaggtacagtgacctgcccgaggttattcaggcagatggagcccagaactgtctggcttccaaacctatggtacaccgctgcctcccgcaggtgggctttaaagacatcagagctactccaggtatgtggctctagcttcctccaacagagctcccaggaccactgctctaggcaggctccctctcaccatcaccccctgaattttggccatggtctcctagtagattgcccctcctgctctcgctccatcaagcctctgatgaggtgcagccagaccatgttctgcagtccagctccagtagtttcactctctctttggcctgagaactcctccgcctgccctgcatggtcttcttaggatctgtccccagtttgcctttttcctctcgtctttgtacagactatgctccagccaggctgacccgtgtgcccccctggttagcccactcaggccttctgctagcctctaggtctttgctcatgttgttcccttctcttgggctgctgtacccagttcccaggctggactcagctgttacctctcctatgtctgtttgctggtgtctctgatgtttggtctatccttgaccctctcaatgagcacattgcccctttttattccttcatggttgtttacatctcatgtcccctctgttagactgagacccccttcagatttacatttaactgacatatactgagtgcattttgtgtgtcaggttctgtgttaggtgctgtgggcatgagtgaaggagctaaaagcttggaaacacatagcacagcacatagtagctgcttaataaatactgagtagataaatgaatgtctgattgagtcctgctgaactaatagccaaaggtacctaattttttcttccttccaggactcctgtagtaagaaatgacaacttcagaattctcttggggtaggcacagtagctcccagcactttgggaggtcaaggcgggaggatcacttgtgccagggaggttgaggttacagtgaactatgattgtgccactgcactccagcctgggcaacaaattgagatcccatccctaaggaaaaataaattcttttggcttttctgtggcttttttctcatgctccctggagccattttggcctttgctgtctcttctcacgctcaccagccttccgattcatagaatgtcaaggtagcagacttggacgagactttggagacatttagaccaatctgctgatcattatctctccctgccatgtcaggctgtggtcctgaccctcgatgccaagtcttctgttctgaaaggagcaaagaggcctgcacaggacctgtgtgcagttcactcagcccagtgggaagttgcttatttatccatcaaacctttcttgagctcagaccctgagctggacatggtatctcagggttgacataagacttggcccctctgcctcactcactgcagtgttccctggcaggatcataaacattggtcatggggaagaatgcttagtaagtgacttacttcctcttttggggaagctcgtttagggcaacataatttgccagttactataacttcctcatggtatttggtttctctccaagcctgcctgttggaagcatttacacggggaagcccattccccagtgcttagtagctgaagctctctgggaccttagcattcagagaaagtgtggtgccatggaaggactttgtgtaactctaggcaaatcacttcactttcagagcctcagttttctcaagtagtaaataggaataaaactgtattttctgatgcatgagattcatgttgccagccccctacctccctcaaaaaaattgtatcagaaaatttcctggctgcctggcataccgtacatcaaggtcctgatcaggctggaaagctgagaatggaaaataatacatgagactgccctgccccctagaggcggaatgtggcaaacacacaacaatgcaaagaccgatgcatcgcatccctttcaaaacaaagatgacaagccagagctacacggctgatcaggattattcctccaacattttagatgtaaatgtatcactatcatcacctaataggtaccatttcactaatgtttcactagtgcatttcgttggagcgatgtgatttttatacctttttaaaggagtgataggactgcatatccaggccctgtgatttcctgctggattccaggatacagcatactgcattcacctgaataaaaccaatattttccttcatataaccactttagaattattgtcattatatctgtgatgaaaagtacctaacttggctcttcccccacattttcttataaatctgagaggcatctctcacaactgtatatctgatatgccagccaattcataaacaacccatctcattgtgatggttgtgaaaattaaataagatgacgtaggtgaagcgctgagcacacagtatgtgtttactcagcgatagccattattattaataataactctgtaaagctctgtgctgtgggaggacaggaggagaaaccatgtggcagctcaccacatttcagagagagaggtcagtccagtgaacattgcatgccaggatgtgccatgccttgtgccatcacaggcagagaattctatgattagtatatagttcctggcttcaaggtgctcataattgggtggagaaggtggtggtggaaatagacgattgcagtgtgctatccagtgtgtcatgccagaggggagcacagggggccacaggtgctcaaaggagagacatcaccctggactgtcagggaaggcttactggaggaggtgatacctgagctgaggcttggaggatgagtttgagttagctaggtgaagaaggacagcatgtgggttggtgggaattgggggcaaaagggaggttaaggcagaggggccagcatgagcaaacacacagaggtatgggcccagcaggatatgtgtatggggaggttttttgtttgtttgttttgtttttttatgagttcagtacaaactagagcacaaacagagagactcgcaggggagtctggagggttggccggctcacatcttgaggacacttcactagcagcgtcaggagctttctgctgttttgtttttgtgttgtttttgtttttatttttttgagacggagttttgctctttcgcccaggctggagtgaagtggcgtgatctcagctcactgcagcctcttccccgccccaggttcaagcaattctcctgcctcagcctcccgagtagctgggattacaggcgtgtgccactatgcctggctaatttttgtatttttagtagagacagggttttgccatattggccaggctggtctcaaactcctgacctcaggtgagccacctgccctggcctcccaaagtactaggattacaggcatgagccaccatgcctggccaagtagcattttaaactgggggagaggtgcttattgtggtgtgggagaacatgtcaagagccacgttttggagagatccccctagagggcagtttggaagatagattggagggtatccagggaggaggctggtacagcagtctagatgagagatgatcaggcctgtgcttgggcagtgggagtagagataacctatgtggggagaaagatgatgatggaggggagcgcagcctgctctggaagctcagaggagtggcagcgttcatgaccagtagggttttaataataccagcatagaaatcaagaaatcacaagttggaaggactctgacaaatcatccaactgaagctattcattttacagatgaaaagactgaggcccagagagagaaaggacttgtataaggccagtcagggtgtgagcagaaaagagaacgctgattagaagagtcaccctagtatgaatgccagcattcagagcatcttttcttttcttttctttttttttttttttttttttttttttttttgagatggagtctctcgttctgtcacccaggctggagtgcaatggcgcgatctcggctcactgcaacctccgcctcctgggttcaagggattctcctgcctcagcctcccgagtagctgggattacaggcatgcaccaccacacccagctaattttgtatttttagtagagacagggtttctccatgttggtcaggctagtctcgaactcccgacctcaggtgatccgcccacctcggcctcccaaaatgttgggattacaggtgtgagccactgcgcccagtgcatcttttcttaaatgtgctgttctctttctccccctagctcaggcccagccttctttctgctgttttttgtcttacgtggcttcatttactgtaactgaggcagctcagaggcagtttctggcctgacagccaggtctctcatccctgtttttctgttttcatggaagagggtggacctgtgtctgtctttagtatatccccattaccttgggctgggcagctctaccccgggtgtctttgttttgaggctcgatgatatgatacataaagaacgagctttggagacagacagacctggatttgaatctatgttccaccccaacccgcaggatggcctcagctaggtcattttaccttttatgaattttagtttttctgtaaaatgggataacaatgcctattatgcctatttctcaagtttttttttttgtttgtttgcttgcttgcttgttttgagacagggtctctttctatcagccaggctggagaacagtggtgcgatcacagctcactgcagcctcgacatcctgggttcaagtgatcctcctacctcagcctcccaagttgcttggaccacagacatgcactaccatgaccggctaattttttttgtagagacagagtctccctctgttgcctgggctggtcttgaactcttaggctcaagcaatcctcccacttcggccccctaaagtgcagggattataagcgtgagccaccatgcctggcatatttctcaaggttagccaaggtaatttcgatggcattccctgatactgtaggtgctccgtaaatagataatttcgatggcattccctgatactgtaggtgctccgtaaatagtcatttttcttctctttcatgaaatctcccatggacaatgacttaacgaatcaaagctttgcttcccctgaaaactggtatatttcttccttcctaatgtgaggctgtcatagctcattgtatcttcctttttgcctcagccaccagttaatttgaagcatagctctagcatctttgttgatttcttttttggacttattttcgagttcaatttctattctgtgttcttggagtaagcaccctcaaatcctttgtgactcaagcaggtataaataactaatgggtgtaaatagttgaatgaaagtaaggctgaagaggctggactggcgatggtgggatttgaagaggaccagaggtggagcaggctggggcagccaagacagtatctgtgtggatggctgtgaggaaccaaggggttagttaggaggggccaacccgtcacccgcctctcttacctcctgttctcaaaagaagcatagatattggagaacaggacctcatgtcacccagaatcatcagcctgcccatttcatatttacagtgtggaagccagagttctaaagaaagagaagggcttgttttgacaaactaaatcaaagcaatgcacatgcacaattttcaaaaggcaaagtagtacataaggactcatgtagtaaaaaactgacgtcttcctatcccctgcttctcagccccagatgcaaccacttttcccatttagttcttctggcggtaacttcatatctctaaataacgtgcttgaatgggtatttcctatttatcaactttaaacattatcttgactttttcctaccatgacaaaataatttagcttatttacaacagctgactctttctcaacactccttcccacttttttttttttttttttttgagacagggtcttgctcagtggtccaggctggagtacaatggtgtgatcacagctcactatgacctcaaactcctgaactcaggcaatcttcctgcctcagtctcctgagtagttaggaccacaggtgcatgccactacacctggcaaagttttatttattttttttttttagagacggggtctcgctatgttgcccagttaggtctcgagctcctaggctcaagtgatcctcatccttcggtcttccagagtgctgggattgcaggggtgagccactgcgcccggcccctcccagattttgagagttttattattgtgtgggctcctctattagttacctttgtaactttattaagtactattttaaactgacttcttatttcatcagttttccacagcatctcttgaccacgtactttgtaagacatagttattagtgccatccttccctccatctctccttcccctcttccacctcccagtctctatgttctgtacttgtgtatctagcaatgtagattacatttgcattctattctgtaaaaataattatgttttcaatgctttatctagagagattgattataaaaattacctggcagtacactgtttatgtgattatgactatgtcactattagtcatcgcagggccaaatagtgtactgtaattatacctcattactcacagttacacaacctttgtactcccaggattgttttaaaacttcataccgaaatataatatgaatacagaaaagtgctcatatcagaagtgatatgaccatatcacaagtgatatagtcactttttacaaaccaaacacctaggtaaccagcattcagaacaaggtctgttttttattcaccctgaatagtactcaagcagccctttcagtttgaaggactaagtctcttctttttttttttttttttttttttgagatggagtctcgctctgtcgcctaggctggagtgcggtggcgtgatcttggctcactgcaacctctgcctcccgggttcaagcgattctcccatctcagcctctctagtagctgggactacaggtgcccaccactatgcccggctaatgtttgtattttcagtagagatggagttttgaactcctgacctcaggtgatccactcacctcagcctcccaaagtgctgggattataggcatgagccgccgtgcccggcctttttttttttttttttttagacagggcctcactctgttgcatagggtggagtgcagtggctcaacctccacctgctggattcaagtgattctcctgcctcagcctcccgaatagctgggattacaggtgtgcactgccacgcctggctaatttgtatttttagtagagatggggtttcaccatgttggccaggttagtctcgaacccctgacctcaagtgacctgcccaccttggcctcccaaagtgctgggattacaggcgtgagccaccatacctggccctctccttatgttatttctttgatcattcccttcccttaatttgctctgttttcttgtttgggaatgtctcttagttgggtgttgaacttcctgtaggctgttgatcctgtaggctgcttaccttttctctcatactttctattttatggtatgtgaataagttaatagaaagtctgactgagccaggcgtggtggctcatgcctgtaatcccagcactttgggaggctgaggcgggaggatcgcttgagcccagaagttcgagaccagcctgggcaatatgataacatgatgaaaccctgtctctacaaaaaaaaaaaaaaaaaagaaagaaagaaagaaaaagaaaaagaaaaaaaaagaaagtctgactgagtggtgagctgcctatgtatccaggcttgcttgtccactcactggcttcattttggcgagctggcagggagttggttgttataatccccaaaggccagaatgaatagcactttattttgggggcaccaacatgccactaggtgtcttgactcatcctagatagtttaattcctttagcaagcagccctctgatactttgcctacgggtgaatgccaggcggcctgtgttctaggtctgggggttggggtggcagggaaggaaggatgtcatatacttaccttccatttatccctgtgtccagtgccgtggttcctcctaccctctcttgcagctaccatctccaagtctggagtctctctgggcctctgctggcctgactgtctccctcctcagctgcaagcccctaagtggtgttcctggatcttcctcaactgtgaacaccctgctgtttgtttttttgcttccagaaatttgttgaaatctctcacccactgatctcaccctctcccatcctcctccctgttatgagttcatactttattttattccttcactttcattatggtggggtcctgggagagagaggagataaacatttatgcccttgaggtggaaactaaggcgaaagctactttaaaaaatggttgttttgctttttcaacccagactgaaactggaaactattagtaggccccccacatagccaagcctggatgacctcatttggggtcatccaagctgtgttgcttctggccccagcccttatcataagcattcctccattggcctccagagcacccctttcctcaacctctgctgcctagaccatggagtcaagcgagccctcagccgaggaaccggacacctgggttctgatcccagccctgcccctgcctccctctggacccctgggccagcccctccacctctctgggtgccctctctgtggcttgagaggctctccgtctgctgtaagctgggctttgccgggattggctgggtgcttggagggcagcccagcctctttgtccaggcggtgggagcaagtgggccagagatgggccccaagcactcgggggggcttggaggctgagctgaggcttctgcaacagcaggctgtgctagctgctcccccttccgcccactctttcccatcatggctgaacctctatctctctgcctccagcagagagaggagagaaggcagggctagagagctagttctgttttcctttgcttcttctctctctctgtcattgtagtacccagctgatctgtgctacaatacctgtgcctaaccgcaccttccttttttggtgttccccctttccgtccttgaatgattgtctcttctagaagcgctccttgagtgttcatggggtggggggctttgggctgcactgtgtggtggggagacaggagacagatgagggagaggggccaagcttgcaggctggaatgggagatgaagtgccacttggctctgggatgacagaaggaagcagcagctgtagcagttaaaagcattggttttggaatcagacaaacctagacttgaatctcggctctactacttattagctgtgtgagtctgggtaagtcacattgctcctccgtacctcagtgactgcatccatacaatgagaagaactactttgcacaacagttatgaagactgtgcaaagtagtaggtacaactgtggaccactgtaggtgcaactaaatagtaactttatggctgggcatggtggctcatgtctgtactcccagcactttgggaggccaaggcaggattgcttgaggccaggagtttgagaccagcctgggcaacatagcaagaccccatctctacaaaaaatgaaaaaattagctgggcgtggtggtgtatgcctgtagtcttagctactcgggagactgagagcagaagattacttgagcccagaagttcaaggatgtagtgagctatgatcatgccacggcactccagcctgggtgacagaatgagaccctgtctaaaaaaataaataaggccgggcgtggtgggtcacacttgtaatcctagcactttgggaggctgaggcaggtggatcacttgaggccaggagttcgagaccagcctggccaatatggtgatactccatctctactaaaaatacaaaaattagctggatgtggtggtgcacacctgtaatcccagctactcgggaggctggggcacgagaatcacttgaacctgggagacagaagttgcagtgagccgagattgcaccactgtactccagcctgggtgacagagtgagactctgtctcaaaaaataaaaaataagaaaaataaatagtaactttatgattatttggattattataaggcagaatatgctaaggcccaaataaagtctgcttattactttattatgattatataacatatagtatttgcttatgattgaaaggagcatgaggttagggaaggtattctctaaggaggcagcttttgacctcatcactccttggatcaagcctcccaggggctccctggcaactacagaatgaggttcacgctgtgctgcctggtattcaaggctctcttggttgtaatctctgcctttcttctcttcaaaatgtaaatgtgaagtgatacttttctctttacttcctgaaaaagacatttgaaaagtgatagacaaatatttcatttgaggtatatagcagtcttcctcatcattgtcatcatcatcaacatcatttttatcatcccagaacctgtacagtgagttgtgttaaacaaggactataggaacaataatcaccagcaaaaggatagccagcaactgaaaccatcatggccttcattttgtcctttaccgccatctttgccttcaggattgtttggctccattactaaaagtgattccagtatccaacaagctttctgatttgtcctatggttctatttcttctttttaaataatcttcatgagactttcttgcataacaccattacctcatccacctgttcgctatactttttgtcatttctaggtctgattcttggcttccttagaaaagagtcttcctctctacctgaatcatcttccttttttttttttttgagacagagtctcactctgttgcccaggctggagtgcagtggtgcaatctcggctcactgcaacctccacctcccggattcaaacaattctctgccttagcctcccaagtagctgggattacaggcaccgcgcccaccaccacgcccagctaatttttttgtatttttagtagagacggggtttcaccatcttggccaggctggtcttgaactcctaaccttgtgatccacccgcctcagcctcccaaaatgctgggattgcaggcgtgagccactgcgcctggctacctgaatcatctttcaaaaggttttcactttcacttttttttttttttagatggagtttcgctctttcacccaggccggagtcaagtggcacgatctgggctcactgcaacctctgccccccaggttcaagcgattctcctgcctcagcctcctgaatagctgggattataggcgcccaccatcatgcctggctaatttttgtatttgtagtagagatggggttttaccatgttggccaggctggtctccaacccctgacctcaggcaattcacccgccttggcctcccaaagagctgggattacagatgtgaaccaccacgcccggcctacttttactttttacattgtcatgatttaggtgtcacttgaacttgggaatcatctttacctccccctagtgcttttctccttcctcgctgtcacaagtaggtcttcacgccacttgtggtttagggaagtgcttgcatgctcctttgggtaaggctacagctccactcattcctcaagtcactctgtttccttcctaaccctacactcaagttgtactgaactatgtagagtttgctaagcatgtcaggcttctttatgcttccatgactttattctggctgttcctatggctaaatgccctttttttttttttttgacagagtctcactgtgtctcccaggctggagtgcaatggtgtgatcacggctcactgcagcctctacctcctgggctcaagtgatcctcccactccagcctcccaagtagctgggaccacaggcataggccaccacacctggctaattttttggttgtttgtagggacagggtctccctgtgttgtccaggcttgtctcaaactcttgggctgaggcagtcttcccatctcagcctcctgagtagctgggactataggcacacaccatcatgcccacctaatttttgtatttttgtagagacagagttttgctatgttgcccaggctggtctcgacctgggctcaagcaatcctctcactttaacctcccgagtagctgggactataggcacacactaaaatgcctggctaatttttatttcattgtagagacgggatctccctgtgatccccaggctggtctcaaactcctgggctcaagcagtcctcccgccttggcttcctaaagtgctgggattataggcatgagccgccgtgcctggccccaaatgcctttttacccttgtctacatggcagataaccagttaacttttttttttgacatagggttgtgctctgttgcccaggctagagtgcagtggcatgatcatagctcgctgaagcctcaaattcctgggctcaagtgatcctcctgcctcagcctccctagtagctgagggaggcctagaaacttatttctctctggtgccaccacgcctggctaactattcaaatttgaagaacatctaagtacctcacactgttcaaggcacttggaaacagtgagcaaaatagacaaaacctctgccctgtggagctgagattctagtgtatggatgtctgggatgggtgtggaaaagaaacaaataaacaagaagacacataatatgtcaagtagtggtaagtgctatggggaaaataaagctgcatgagcctggggattgcagaaggcccagtcagctccaccacagccagtgtttgcacaaccattattaagcagcattttctcatttaagcattttccaatgttatcacatattctttataaccataatcctcccaacaaccgtatcatattagtgctattattatctccattacattgatgaagaaactgaaacttagggtcataaatcgcatagctggaagaggcagagctgagacccaaatccaggcctgtctgacctaaagcctggactcataactactgtcattctacaaacctcaacacaattctctgaagtcagaattattatgcctattttatagttggggaaactaagttcagagaggagaatggattcatccatgggttgcacagcaaatgaatggatttgaacccagatctgtgaaggctagggccttctacaaaccctgaggcctaaggctctatagacttgcctgcctctacatttctagggcccaagcaagttaccagttgaagcccttggccctccacacttctcttccctcccatagttcatatggagccttgagatatgtggataccccagccaacacctccaagccctgtctatctccccttccccttaggccgctccttggtcctaacagatggacctgggtaataagaccatgcaattcctgaaagtaagcccaagaaatttaggcaggaaattctgaggtccttggtgcttgaagtgcagcctagaagggacagggccaaagatccttatgggtcctgatggcattacagaccttttgcctgatggagagtggcccctaaaatgtgggccccagtgtagggccttctgtttatcagtacaacccataagattgtgattcgtaataggctggcctccaagatcctcctcctttggcttcctgagctaggtcctgctttgcagggaagggagcagggggtgttctgtgggcctgggccttcagaggctgtggccggtgaagaatagagctttcccagcaagccctggtggacatgtgcactgattcttatgccccccgcctcacagtattttgttcccagtactctcaggctacttaaccaatttaatttcttagtagcgtttaaaaaattatactttcaatgcatttttaaattaggaaatttagaaaaactaggaaaagtagaggagaaaaacattacacataattacagcacccagaggcagccactctgagcatctggtgtatttgcccttgttctctgcatttttttcatgtagttgaaatgattttacacatacaatttttgttcttgatttttccatttgagcatttcccatgtcattgcatattcttcataaccatcatttttagtggcaactgatataccacgatggacttaaccatcctcttaatgtagggtgtagaagctgtgctcatttttttcactggtttaaatcatgctgcgataggcttccttgcacacacagcatcaaaggaacttacagcttttagggaattgaccttatatagggacaattgtattcagcttatttccctttctagatggtccctctagctgggtccaattcgtttatttagtcattcatttattcattaatttcgtcaccacatatttactccatacgcctggaagccagactctgagatctgggggtccaagcaggaatgagacagagcgcctgactaccaggagctcccagtcgctgggagagtcagccatggaaatagacaatttcagaacagtttgatcagggctgtgatggagtcaagaaaaggatactgtgggagaacagaggaggggctcctaacccagcctagggatgttaagatacgcttcctggaggaggtggtgcctaaatgggtcatggaggatgaataggagttggctggaataagaaagggagcttcctgttaaacacaatgagttggataaacttatttctctctgttgctttcccaaatctcattaaaatatgaaaaaaggagtaaaaaaggtagaaacacataaggtctgggatgctgaccagaagtaaactattctacttagagaatcccagcagtgctcaggattgagaggtactgaaggtacatcctcagaaggcaggatgaagtatggacctgagaatgggaatgttgaaagtcttttctgtccgggcacagtggttcatgactgtaattccccccccaactttgggaggctgaggtgggaggattgcttgagctcaggagtttgagaccagcctgggcaacatagtaaaaccctgtctcaaacaaacaaacaaacaaacaaaagattggctaggtgtggtggcatgtacctgtggttctagctactcaggaggctgaggtgggaggatcgcttgatgagcccaggaggtcaaggctgtgagcgatgctcacaccactgcctcctagtctgggcagcagagagagaccttgtcttaaaaaaaaaaagtcttgtctttttggtccttccccaaccccatccagacagtgagtcccccactcccagctgcatccctgcagatggaggttgcttctttggagaaactgaagttaagaggctttgacttgaagtcaccaagtacagtggaggatggggtgaaacaggcctgcaggcaaagggatctgcagcctaaaacagtggaaccccaacttccttccacttaaaacagtgggactccaacctccttcaactcccccacttctaggacaccaaagtcaggtacacagatgagatcaaaggattgttctctggggaaactgaaaggccccagaaaaaaaggcctccaaaagccgacatttggaagtcttctaacaaaagaacagcctttcagcccagtaatttgatagtgaagcccaccacctggcaagccccacctgcacacagagtttccaagcagcttggtagtgtcatgggaactaatctaggaacaccagccaagaacccttaagattaggtatattttattttaatgtaaactaaacctcagtacactgggccaggcatggtggcctatgcctgtaatcccagcattttgagggggctgaggtgggaggatcacttaagcccaggagtctgagaccagcctgggcaacatagcaagaccttgtctctaaactaaaaaaaaaaagagagagagagaaagaaagaaaagaaataaacctcagcatatgtttttaaaaaccccaagctcttggtagccagagataatcagatagtccaaggctatttgaggaaaaccatcaacttggaagactgattgaaaaagcaaacaaacaaacaaacataaaaaaggaacttggaaggtaatgaagggaggagaagaaacctgggaaattaaaaatagtgagagctaaaataaaaatttcagcagaaggattagaaaataaaaggtgaggaggtatcctaggaagcagaataacaagacaaagggacaacagaagagaaaagatgagaaaattggaggatcaattgaggaactccaacagccaacaataggagttccagaaatagagaatggagggaacagcaggaaggaaattctcaaagacataatacaagaacatttcctagaactgaaggagtgaaaactcctgctgagtacccagcaagataaatgataaaaagacccatgccaagatatgccgctgtgacatttcagaataccagggattaaagggaagatcctaaaagcttccagagaaaaaacatcatatgcaaagaatcaagaaaaggaattacgttggacttatcaacagcaacactggaagctaggatatgatggagcagtgttctcaatattctgagggaaaagaatttccaacctagaagtctatactcagttgaatggtcactcaggtatgagggtatataagatctaaaggttttaagtcctatgcctcctttctcaggaagccctggggaatgtgctccagcaaaatatgagcataaactctaaaaaaaaaaagaaaggaaaaaaaaagccacggaatctaggaaacaggaagttcaacgcaaaggagaggtgaaaggaattcctagatgatggaaaagagagaggttcttttttcttttttttgagacggagtctcgctgtgtcgcccggtctggagtgcagtggcgcgatcttagctcactgcaacctccgcctcccaggttcaagctattcttcagcttcagcctcccgagtagctgggattacaggtgttcgccactgcgtccggctaatttttgtatttttagtacagacagggtttcaccatgttggccaggctgatctcaaatccctgacctcagttgatctgcccacctcggcctcccaaaatgttgggattacaggcatgagccaccacgcctggcctgagagagaggttgttagggcaacatctgggcaggcctagagagcagccagcctagattgcagcaggaaggtgggtgtttttaagggaaacaaagagtccgatggattacctgatatgtcaaagcatattgagaggagaattgcgcttctgacagtttggggagaattgatcatttgtatgaagagaactaagccgacaaaaaaataatggacagtaatcaggctgggcacggtggctcatgcctgtaatcccagcactttgggaggctgaggtaggtgaatctcttgagcccaggagtttgagaccagtctgggcaacatggcgaaaccccatctctacaaaaaatacaaaaattcaccaggtgtggtggtgcatgcctgtagtcccatctactcaggaggctgaggtgggaggatcacttgagcccaggaagttgaggctgcagtgagctgtgattgtgttactgcagcctgggtaataggatgaggacctgtctcaaaaaagaaaaaatatagacagtaaacaatagcagggaaaataaaaagttgtatgggaaaggaaatgtaatcatagtatgtcatatgatttatccattattagtatccatgcagtcataataacgtagaccaccagcctaggcaacatgatgaaaccccatctctacaaaaaatgtaaaaattagccaggcatgatggtacatgcctgtaataccagctactcaggaggctgaggtgggagatactgcttgaccccaggaggcagaggttgcagtgagctgagattgtgccaccgcactccatcctgggtgacagagcgagaccttatctcaaaaaaaaaaaaatgtagaccaccaatgttgatttaacccaaactttgtgatataactctgatggtagaatgagaggagggcacagttgttcagttgcaggacacttggagtgaatggaagtggtcactgcacagtcgtgtgtaaaaacagcatttaggctgggtacggtggctcacagcagtaatcccagcactttgggaggctgaagtgggcagatcacttgaggtcaggagttcgagaccagcctggccaacatggtgaagccctgtctttacaaaacaatatgaaaattagctgggcatggtggcacatgcctgtaatcccaactactcaggaggctgaggcaagagaatcgcttgaacccgggaggcagaggtcgcagtgagccaagatcatgccattgcactccagcctgggcgacagagtgaggctccgtctcaaacaaacaaaaaaaaagttcctttagcagacagtgtgagaaaggagctgacatttgcggttaggtgtaaggtgatattcaggagagaaaatgaaaggctgattcggggccggttctcagcttttggagagacccgcatgatttctgggccagggtacctgtctctttttccttaggacgctcctgggaggagccccgttcatagttgcccttcaagtttcattcttcaaaaaatctacttctgggccaggcgcggtggctcacgcctgtaatcccagcactttgggaggctgaggcaggtggattgcctgaggtcgggagttcgagaccagcctgaccaacatggtgaaaccccatctctactaaaaatacagaattagccgggcatgatggcaggtgcctgtaatcccagctactcaggaggctgaggcaggagaatcgcttgaacccaggaggcggaggttgcagtgagccaagatcgcgccactgcactccagcctggtgacagagtgagactctgtctcaaaaaaaaaaaaaaatctacttctgttgatgttcagtctcctttctgtaggagacataatcttttaggcatgttattcagattctggcttgaggaccagtctgtgatcattcaagttactccgcattatctcatttctgatgcattttgtatttatttaattagttttgctttcagggacaagcttcttgatctaatttcaggttcctgggaagaggcaccatattgttccccagttactgcttatgggtggcttggagcatggcaggaaatctagtcaagaggcaagggcagaaactccaacacagcagctccaaggcctccattcttttcagtcattctgctctgtcttccccataagtccccaaaaggttcaggaactttcgatattctgccatttattctctcatcttccagattgcttcttcttttttttttttttttttttttttgagacggagtctcactctgttgcccaggctggagtgcagtggtgcaatctcggctcactgcaagctctgcgttctgggttcatgccattctcctgcctcagcctcccgagtagctgggaccacaggcacccaccaccatgcccggctaattttttgtatttttagtagagatggggtttcaccgagttagccatgatggtttcgatctcctgaccttgtgatctgcccgcctcggcctcccaaagtgctgggattacaggcgtgagccatggcgcccggccaaattcttgtacgtggaagaagcaacattaaaatctctggtcagattacatgcctgtttttgattcagaaaatatggttactatcctcaaagctccaacaagttactatttattggccatcactgctgaggatgggagttggcatatccaaatctcttgagaatcctggggcctaagtggcctttcattaagacaaggctggccaggtgcagtggctcatgcctgtaatcccagcaatttgggaggctgaggcaggtggatcacttgaagtcaggagttcgagaccagcctggccaacatggcgaaaccctgtctctattaaaaacacaaaaattagccaggcacagtggtgggcacctgtaatcccagctactcaggaggctgaggcaggagaatcgcttgaacctgggaggcggaggttgcagtgaaccaagatagtgccattgcactccagcctgggcgacagagcaagactctgtctctaaataaacaaacaaacaaataaataaataaataaataaaaggctgtggggagtagcaggagaaatcggtctcctttactgacatggattgatgaagagggatctagtccttgggtctattgcttctccttgtagacagcagaatctagttgataaaagagataaactttggggttctgaagaaatagaatattttaaggcctaaagattgcttggaactcaactaacacagccctatcactttacaggtgaagaaccaaggtccagagggaaatgacttgtccgagttcacactgccaattagggaatgagccataaaaggacctagcattctttctaccagtctatactgcctcccaaaagaatggtggcccagcttcatgaacattggacagtgcatgagcctctgaggaggtgtaggatagcactgatgattgttctatacataatgaataatatgctaaatgcataaagggtgatggaccctggggtgagctgcacccccacattgagagtcatatgatgctgtgtaccctcaagctagtaagaatcagtccatagcgagaattggcgaattccccgctgcatcatgacttggagctcttttgctcccctttgctgccatcttgaggactgtcacatatcacatagaaatacttttggagcagagatatatttctcataatctctcaggtgaaagagcactggagaggaaaggtctgttggtgcctctctggcttgatattgaggaatgaagataagggaactcaccgtcatagtgcgtacgtgcccggcactgagcttctggtacagtggagcgtggtggtaggaacatgagctttggggttcactctgagcttctctgcttgtgtgaccttgggcaagtcattttgacctttgtgagtctcagtttcatcatcttgaaattggatgaataacccccactttgcaggatcaaaggagataatgtacaaaaagaggctaacactatgcctggtacatagtaggtactcatagtttgttcacagtggtggtgggggtgattagatgtgttgcttaaaccttaggtagattgggacaagtggccagtccacgagctccttgagaggttgtattcccagggcagggcctggtagacagcagactgaatacatgtgtgctgggtttgggggtaggtgggtggtgaagagatcggtctgcctagagcagagggttagtgttagggagagaggctgagaggcttggcctcagttctgtaggcatctggggagtcattgaagtcaggcccctcaggcctggtacctgagaataattgggccaggcctcagaagcaatcttgttgctgcagaaggagatggaacattttaataaatgtgataaggtgcgctgtggccctggtcctctgttccttcagggggctgagaaggctaaggattggtgctactggcatctgctgagcatgtaccatgtgccaggcactgtgctaggctgagcctcacagccacaccccataaagggagtgactctcaccgcagcccacccccaaagccccattttacaaggcaaagccctgacactcaacatagtgaaataccttccctaggattccatggcttgtgaatagtggaaccgggagtgctgtggttgcagcaccctgatgcttgcctgccccacctcgccagcggggcctcctttcattctttcaacaaatgctcccttctgaggcccacctgctcctctccctgtgtgtatctctgtcatttagcgcttagcatagatggacactcccctcactaaagccacgtcttggctctctcagctgaggacagagcctgtgctgtgttcatctctgtctccttcgcagcatgagtgagggtgggaggcctgaggtgaagatggaggaagatgacaagggggatgtccgtgtcccacacgctcccactttcaaattccatggtcctcctctgccccttccctgcacgcagtgaacaccagccccactgtcctgatcctccctcccgtacacacacacacacgtgcgcgcgcacatacacacacgtgtacacacgtgtgtgcactcacgtatacactctcacactcttcttgggaaggcgtggtgggagaggaagggtgtggttcagatttcactcattgcccggttccctcagtgatgtccccaactccattctcttctttcgcccttcttttgcctctaaagaggcctcacaatgaaaacggcagaccagtgtagtagaaaggagcccagcggctgactcatatatctcctcagcctcgttctcttcatctggaaaataagcaggttggaccaggcagttggcaaagccccttccatggtgttaataatacctggcatttgcgtaccgggttccaaagggctgaattatcccaacagcccagtgaggatcggcctcgtgtcacaaacggggagactgaggctcagactcagagaggtgaagtgacttgcccaggtcatggggctggtaagtggcagagccaatatctgaacctaggtcttcctgtgtttcaagcttgggctttgcccctgcccacggctgctggctgcctcgacgaaagccacgctcctcactgtgatccactaggccccacatgtttggttcctggtgcctctttgacctcacttctgaccactcttcccccttgctcactgcaccccagcaccaccgtcttcctctccatccctccaactggcgaggcactctactgtctctcggccttgcacttgctattctcttctctccgcatgaaataacccttcccctcatttttgtgatgtgcattaggcctcaaggccccccaaagccactctacctagggcagagggagaagagagcgtatactgaccgttttggttttttttctctgtttccctttcagatctgatggtgagaattccagaacagtcaggtcagtacctcctttctttagtactagttgggagatggggcagggcctggggtgggggcctctggtttgtaactgcaggatccatgggcaaggggaggggccaactcaagggcgtcttccctgttggtattaggggtggctatggagtggggtgagagggcagttgggggatgtggcagctgtggggagggggttcaagactgttccttagtctttctgacactagttgacttgggagcttggctgaacaccataggggctcataggagctgcccagatatgaaagctgagaggtcagctctggacaaggaccttttccaccttctcctcccagggtaagagggcatgatcgatgctgagcttccctggtctagcgttcactttccaccctgaatctgtgccagccctgagtagtgggatttgaatggactctggatgtaacacattctagacattagaactatacattatggcgacaaggaaaatttttttgtgtgtgcttggtaaaaaaagtttacaagcttcagtacgttttattttattttattttattttatttttgttgttgttattgttgttactgacccattggtagacatagtaagttttaaagatgtgctcaatctgccagttggggaggcaggagtaaaacttgggtaaaggtaaagacaagggacctttgtgcatttcccaggccttaccccatcagaagcttcatgaaggcagaggtgtcaagtatagggattatataggaatgatgggggtgctcaggataggacccactcagccttaacatccaggctgggggctatgggataggccactgagctgagctgagcccaggcagcagaggcacagatgggtacagtctttcccagccacggctgccagtagcataattggcacctttgtgaagaatagaaaaagatgtccctttcaagggcaccccctctgagtggctccattgagcatagcacgggttggatatcagcccctgttcatatccttttggctgtgaccctttgtgaaaggcacagcttgcctgactgtatgcaggagccctggtcctgtcattcaggcagtggatatgggctggggacagaggatgccagcatacagacaaaagtgtctaatgagacacactctgttctagcaccccagacaggggatctggggtaaacacacggatacccagagccaagaatggggctgtgggataaacacatgctgaggccagctttaatgcaatcagtcccagtgtccaggaaaggggtttgtgacaagacataattagtcctagcatgcagccaaggagcatgtcatgggcacagcttgtcctagcacttaggaaggcacctgtctagcaaagggaatagatctcagtgtcccaccgtgggtttggagagaggccacccgagcacggggctcctgcaagcatccccggtgatgtgcctgctacttgttgaagaagaagattgaaaacatctctagttctcagctcttcccagcaaggaagttcctgggacctagagctcaggacatttaataacgagcataatcataagtcatgtgatgatatacatttgggcctttacaacttacagaagttgtcagggactttcttttgtctgatcctcccagtgacactgtaggtagaacctgagctggccttatcatcattgttttacagctgaggaaactgaggctcacagtggttatgggttttgcctgcagccaggcagctaatatgtggattcagctaatatatggatcctgagccaggattcaaacccaagtctgcctggcgccaacccagagtgctacccataccatcaccacgggagctctcgacagcctggcagataataatcatcatcctcatcctcatcctaatattagcaattatagcaatcaccatttgttcctcacatactaacaacttggaatatgatcttatttaatgctcacaacagccctaataggcatggattacaatccctgatttacagatgaggagaaggaggttctgagagagtcagtgccttgggctgtctgattccaaagccagcatttaatttattcagacacgcttcctgacatccatcctgggcccagagtcaaggaggctgtaggggcctagaggagtcagcatctgggaagcgagggtcaaactcaggctatgggaaggggctaaagcatggcgtgtatggggcaatatcttgacaacatggtgggaaggcaacttgaacttgcaaccagggctgggtagggacctacttgtaaatttttgaattcgctccagttagggtgaaggagagcttgctggagcaggcagcgtctgagcagggctgtcggggactgccgtgcagatttgcataaggagggtgtccccggaggtgggatcagcttgtggagggaagcgaggggggtgggtttagagacagggagccatccgtggggctaaaatagaagatctaggcaggaaaagagcagtaaggtcagaacgcgggtcaggactgggtcacagcgaccttctgtcatcagtggggagctggggaagttggaggagagaggcgaggctctgtggcctaggaagggcagaaacactggatccatgcacaggcctccatttggggggtgggttgctctctagttgtgtgactggacaatctgtttgtctcttggagccccagtttcctcatctaataaacttcatgtgtgtgtggagggggaagggctagggaggtggaagaaacaccgaggagaggcgctaggcctgggcttttatgggaactgaatagcaaggagagagcagagtcggtagattgcaagccacccttggcatgacccaggcctgagggcttctaaagtatggggtgccagaggaagtgtggcgtctaattagagctgaacagttggtgatgggggtggggggtaggcatgggcagagaaaggtgcctggacttcttgtgggtccctgagaagtgtcacagatctgacctaaagataccttaagccaaggtccagagagggattggccatcgctcgaggtcacaaagctagctagcagcagagcctgcttcctagctgtgcactctttgcagaatcacttaacttctctggttcttagtttctcatgggtaaaatggaaacaatagtcttgacttctctgggttgatgagagaacttaaagtaaagcaatgcttggtgtgaaatagtggtgcaacaaactgtagtgtcctctgctttcccctaacccaatccattgtcatatgctatatagtcaggctggaagaatgtgaacaagtgtagaacttgaaaacagagagggcaggacgggcctgatgaggccctcaccagaagatgagggggcccaggcctagaggcactgctgcagtgagggtcagcctgaacttgttggccctggggaccaggctggggttgctaggcacgcaaggatgaaagcaggaggaggtggcctgttgctagggaaggagggagggggtgggggagccgctgacacccgcggagacagggacgtccctatggcaacgggagccactgcagttggaggagaagtgggaggaggagcctcccactgtgggcctcagtgctccaatctgtcctacaggagtttggattagataatctcttgttttcacctcttggcaatctgggatggccaagacctcatgaaccgtctgtggctcccccatccacatgtccaagacactacccatccccagagccatccagctgcatcacctcccatgatgcctcccatttggctcagcccggttgcccaccctgccctgttcctaccacttcctttgcctggaaccttgccacttactgcttcacagtctggggttgctgcagacacagatgagccagctcgggccagcccaaatgggagcgtgatgatggtgtagacagccagtttgtgaggacagaagtctagaggagtcagagctggattttgacagtgggagagaggaggaggtaactttccaggaagctaaagaagggcaagaaggggtaagaggtttctcttctcctccccttcctctctgtgttctgccgccgcctggcccagccccaggaagtgggtgacccctaagctggctgagtgcctggttggcaccgaaataaacttgccttctctctcttcccctccccttgcctctgtcccctctgtcctggctttaattagcagccctggggatgagtcacttggcagctggggagggaggctgcacagagctcagtgaagcttcgactcctgccctgagccttacgggcagcacctctgtgtttatgcatgtgggtgtgcactgctgcatggcagcgtggctgtgaagagcaaagtgcaacactgcatgctggcgcgtggccctgcatgtcagggggtctgcagagaaccatatctggttgctgctgcgtttgttgctgtgtgccactgaatgtcagtgtgtgtgagcgtgtggctggagcgtgtggctgtggttgcaagtgtcagggaaccagggagcttctgggtgaacaaacacaaacgctggacaattgcattcacccctctctacctaagtgttctttatgcgattttgcttacacaaaccctgcacttacattcccaattttcacttgtcttagtctgggtacactttgttgtgaggaacggaagcccactcaagctagctcaagaataaagggctaatgaggggactattgtgaggctacatttcacagaatctaagaacagttaatgaaaaacagccaggcctcacaccaactggaagtgggaccaggaagtcgaggaccaaggttgctgtctcgctgtctgcatctcctgggcccatgtctcatctttctccatctctcatggcttgcctggtccctgtcatctctttttctttctttctttctttttctttttcttttttttttttttttttgagccggatacttgctctgtcgcccaggctggagtgcaatgccatgatcttggctcactgcaacctccacctcctgggttcaagcgattctcctgcctcagcctcccaagtagctgggactacaggcgtgtgccaccacacccagctaatttttgtatttttagtagagatggggtttcaccattttggccaggatggtctcgatctcttgacctcgtgatcccccctcctcggcctcccaaagtgctgggattataggtgtgagccaccgcgcccagcctatcatctctttttcatggacttctctctctggaccagcttcctctgcttgcccatggcctgacatggccaccaacctggaagctatgtgaccttttccagcttcaggatctgcccctcctgccattggactgcagtgatcctccagcctgtggtaacacaaggcagcaaggggccgtgtgagataattgattccctcagaattggatgagaggagagagagaaaacacttggtacttcttgtttcttctgcagtaagcacagtttttatgtgtacccaagtgaggtcagagctggtcggctcagaggcaaacacttgtaagattgtttttggttcctattttatagcaagatgacctttgctcactgtgctttcaagttccatatccttgcatcaaaacatgctgttttgtctaaaagtgccctcttattttatgccgaaaaagcttttaaatgtacagtgaatattaccattgctaccagcttgtggtaatttttcataacctcagaacaactggtataaagctactgatggtacagctgctacccagctcttggtggcctcaggaattttgatattttatgagttcagtgactgaatttatagttacctccagtatataattacaagtacacattatcaatgttatcagcttgatgctggagcttacttttccactaatacaaaccctgcaggttttacattaattacagagggaactaatgaccccttagacaagttttcacctatgaataaagagttaggaatcagctgtgccagtaatgactgttctccagacacaggagcgatgtccacagctctggccttggccctgacctcgcatcctctggccgagactaggggcttcccatcacctcctcagaggcctcctgactctggcctggcacacagcaggtgctgttatttttaataaaattgatagttttatgattgctattaaagccatcttccatatctaaatggtaaacctaagtgagagagattatcccaggttctgggcagtctccttcaactcctccccctgcccttttctcactgttccaaatagtaataattgctttgagtcagaaaatgtctgctaaatatcaggtactattacagagcactggagacacattatctttaatctttgtggccaccctgccaagtaggggtgacttacaggtggggaaactgaaacctagagaggtaaaatgacttgccccaaattgtccatccacacatccattcatttattccttcattcaaggatttattgagtgcctacaatgtgccagatgctgctaaatgtggctgatagggtggtgagtaacagccctgctgtgatgaagcccactgtctggtcaggaaatagacaaggagacagacaattacagacaattataggggaagtgcagggtgctgtgggagcaccacggaaatatacccaacccagcctgagggccagggaggcttctccaagctgacatctaagtggaagcttggagcatgagtagaagttagccaggggaggggttgggtggggcaaagtgaagtgaagagtgttgcaggccagaactgcgagaagagtgtttggcacccacgtttgtgaagaactaaaggagtatctgcagtgagatggcactgtcatgagaaacggtctcatctggaaagggagcagaaggtttatcgggaggctggaactgtggccctggttgcttaagtccagagctgaggagctgcaggacccagtaacagtttccatgtgacaattgtgggcctgggagcctcctgggtcggcctggccaacagcaggctgggattctagtggccacagtgccctctagtgtccactggcccaccttgcagcctccacctctgtccattgtccccccaccatgtgtgaccaggtgcccggtgctgagtgctggggacactgggatgaacaagacacagctctcacagagctcccgacagagaaggggcagcaggcatctgaacacagtgttgagagaagccggctgagaaaagagcagggcggaaggacacaagggaggtgacccaacctgcttgggtggggtcaaggcaggttcccagagggcacaacatctagctgacttttgaagaacaagggggagccagccaggtggggagatgacagtgggggcacagcgggacaacagaggtactattacagagcatttgacacacattctctttaataaggcttggagcagcagagtgtagctgagagagttgcaggtgcttctgtctgggtggggtgcaggttgaaggtggggggaaggctgagactagctggaggtatggggtaggggctagctcacagaaggttctaggatgcctgccaccagctcatcatgggcacttagtgaatggaatcatataagaagcttccctaccctttgggatcacagacccatccgaggatctgatcaaagctagagatgttctccccagaaattaatgcttttcatacaactttaggggcttcaaagatactccccaccccacatgcctgtcccaaaccacaggcttccaaattgctcttcctatagatacggaaaccccgacagaggcctccaaggctctgcatgctgggcccccacctccatctccagtctcacctttctcccctgtgctcttcccaccccgccacgtcagtctcttcgtgcttgctggaaataccacctcaggtcctttgtccaggttgtttcctctgcctggaatgctctcctcctgccatctctactttttgctcagttgaattgcattagttggtgaatgtctgtctcttctcacttggatataagctccatgagagcaggacattgtctacctgtagtcactgctgtatccagcaccggggacagtgcctgggccacagtatctgtcgaataaatgcatgaaggccctgccagtgtcccgtggctgggtcaggctcctcacccttcattccttcctcccttcagcctctggtgggtcatcatctgagtctgttcagcatgctcagctgtaactgaattccaaaagtggtcccaggttcagggatattttcttagaaatcttcctcactatccctgaaacaaacaggcttcccatgggtctcctctgcctctctgggagaagggacagactctctcaggttcaggctgagactatttaccatgtgcacactttgtctacctaccaaatccctacaagaactgtgaggtaggaatttccactcctcttccatagatgagcaaactgagcttcagagggcttacccagctaaaaagtgatagggcaaggacttgtacccagctttaccaggcaccaaagtgtaggttctttgtctcaccagagagggaaagggccttacccaaagtcacacagcatcatcccttaaagctaccactacactttctttctttctttttcttttgtacagggtcttgctctgtcacccaggctggagtgcagcggcatgatctcagctcactgcaacctccgcctctggggcttaagcgatcctcccacctcagcctcccaagtagctgggactacaggtgtgcaccaccatgcctggctaatttttgtatttttagtaaagacagggttttgccatgttgcccaggctggtatcaaactcctgagctcaggtgatccaccgtcccccacccaccccactgctcccagcctcccaaagtgctgggattacaggcgtgagccactgcacccggcccagcactacacttaatgtctctcggctcctgccaggtcaagagggttcagctcttagggcaataactacaaatgggcacaaggtgaagctgctgcaggagctaggagagttcctcaaggagagttaaaaaaaaaaaaaaggcagatgctaaggccagagccttgaggaccagggctttgaggggtgggcagagggagagaaggtcactaaggacccacagatgccaaccttgtggtgttccggagggcctctctctctcagtagctttggctttcttgagaggaaccagctgccccagcagggaggcaggaaggctggcctgttgcctgtcagcttctatttcttctagatcactggccccctggcccctcccagggccgccttctgctcagaacagccaggggcctgggctctgggaccgtgaaaggacaggagcactttgagctggacctgtggtattctcaggagccctacatccttcaaagccaaaaaactctctcctttctccagtcccgcccatgtggaggacagagatgttgctgtaataggcaggcagggagccagggcacctggagtctactctgacctgctgcatgaactttagtaagacccttttcctctccaggcctcaatttgcccatccataaagtcaggctgggcagtttacttggaagaacagcctcttggcatttcttttgattttccctcttctcttcaggaagcatttctctcagccagtctagaaaacaacatagaagagtgagagcttattgcagtgagaaagaatattggccggggccccatcttgataccccaacatgggtgatttgaattgcacttaatatgcagagtcccagaacaactcctaaacatagtctctttaactgtgctgaaaataagggtatttgtgaaaagcttctatggaaaggtttctgtactcacaaggtagcaatatggctgaaggggcagattccaggtttgggaatagccaaaccgggtcttgatcttggggttctgccacttactagcagtattacttcacctctctccatctcaattttctgttcaggagaatagagccagcgatacaaacttgatggggtgcgtggggagattctagcagaggtgcactgagggagcccagcctggggtttggcccagaggagggactgtgagctctccaggccgcttcctcggaggaggagttcccagccctcctggaggagtaggggaaggagcaaagtttccagttgcaatctggcccgcagcccagctggcctggccccgccttcttggttcctccttctagggaagggctggggaggagggggtggtgacacggtggagacaccggctaggccagggggcctgcccttgggacaggtccagacccatggagccccccgggaggagcagcaggtaggaacctgggccccgcagcctggccccctcccttcctgcccaggcctggacccagtccctgggctactgattcagcagcctcctggcttcctggttcctggctcccttcttggactctgagaggcctttggcctgggggagggagccagttcaagtgggagatcccatgggcatccaggtgcccagctctggaaggaccctggaaccctgagcagcacagcctgtggcctgtgaggggtgagcttggctcctaccctgctctactagccttgtgtgcgaggcactgcagggctccaggctcgtggcctctgagattctaacaccaacattccagcagcctaagagtctctgagtctcagattcaaaagagataatgagtcaaggacttgggctggagactggcacctgagaagcagttgccctgatgatgattaatccagagccttcgataagaagagtctcagattcaaagattccctgtaaggttctgagatttggacatcctcaaattcgcagctggcctggcccgcagccatgtctcctggcttttacatgggcttttgaatggccaggccctgaccacagtctgcctctgtgggcttgtgggggacaggggctggctgacctggaaggggtcggctccactcccagcttgctctggctccagctgactggcatacctctggcatctgcgctgcactgggtagggcagggaccaggccctcagcctccctgccctgctgtacctcctcctccccttggccattctccggactttaatcgcaggaggcaggaggtggaggggtctttggaccctgcactaggggtggtgggggcacagcatcaggggtggagtgtgggccccgccttggggtggggggtaaagcactggccttcaaagcaaaagactcctacctggaaccaccccatcctctgcctcacccactcagccctgagtcccatcctgtcaccaagaccactgagaccttgtcagcctcctccgccctcaccctcctctgctctggcgctctctgcctctctctggcttctctctgtgtcttctgtctcgccctttctctgtcttcctctttctctgtctttctccttttctgtctctttcggtttctctctatctctctccctctcttccttcagtgttccccttacccacccacctgggttctcccccttctttgggcccagagcttctccttcctccatcccttcctcccttcctgtgagggatcttctctaaggggagcccccatgcatctttcccccttctctttcatccccccttcccctcccgtcctccctacccctgtggcgtctggtgtgaggagggctcccttcccccttccctactgtggtgtcccagcgtctctgtggctgaggtccccacggagtcacctggaacacaggaggcccagcccggctctttcgtctctactgccccctgttgtcgttgtgttctgtatgtggttcgagtgccgtcctctctttcttgactttgtggtttttttctttttttcttccttccttccttccttccttccttcctccctccctccctccctccctccttccttccttcctctctctccatcttcctccctctctcccttcctcttttcctttctcccttatcttccttcctttcctccctccctgcctcccacgcctcctcttccatttcccatcctccattcctcccagccttcccttttcccctcccgcactcactctcaccttcttgcccccatcgcccaccctgccacttccctccctccctgtctctctctctgtctctctctgtctcttgctgtctctcaggtccacagcgtctcatactctacaccagtattgctgtcctactcaggtccttgactccatgaagcttaccccctcaggcaggctggcagagagcaggtaagagctagacccatccctcccccaattcctcctccttccagacaaatatacagtgtcattgccagcccctcccacctccctgagcccctgctgtgcctgtggaatgggtgtccgagtgtatgaggagagtgcctggaagatcaggtcagcagaccaaagaggacatttgggatctatctaatttgtccttccttaaaaaaatccttccctagagacctgccccaaaaggcctgagtggttggtcctagactatgtgataatccagcttttttaaaggatgaataggagtttgccagttggatagactgaggaagggcagttaggcagagggaacaatctgcccatatctttgcagaatgttatttcttttttttttttctgagatggagtcttgctctgtcgcccagactagagtgctgtggtgcgatctcggctcactgcagcctctgcctcctgggttcaagcaattctcctgcttcagcctcccgagtagctgggataacaggcatgcgccactacacctggctgatttttgtatttttcttttagtagagacggggtttcaccatgttggccaggctggtctcgaactcctgacctcgtgatccgcccgccttggcctcccaaagtgttgggattacaggtgtgagccaccacacccggctggaaaacattatttctaagttaattagaaaacctattttatgttttctaattacagctcaataaaaggaaatattaacagcagcagcaaaaaggctaggccctcctccctatttgaaagtttaaaaatacttgtgttaaagaggaaataagagtggaatttatggactatttagaataaatgtcagtgagaatactacaacttaaaacctataaaatatgggcacagggattcccagaggaaaatttataatcttaattgcttttattaaagaacaagatggtttaaattaaatggactaattattccactcaagaagctagaaaaaaacaaccaaaacaaagcagaataattactacaaataaaaccagaaattaatgaaatggaaaacaaaagatttgataaagtattaataagtaagtaaatatgacttttggaaagaccagctctacctagtttggtagacattctttggcagatatgactaagaaaaaggctaaataaataaatacattaagaaataaggaaggggatttaaccatagattctaaggagatgaaaaaaaagttattataagaaaatattggggccaggcgcagtggctcacgcctgtaatcccagcactttgggaggctgaagcaggcagatcacgaggtcaggagatcgagaccatcctggctaacacagtgaaaccccgtctctactaaaaatacaaaaaattagtcaggcatggtggcgggtgcctgtagtcccagctactcgagaggctgaggcaggagaagggcttgaacccgggaggcggagcttgcagtgagccgagattgcaccactgcactccagcctgggcgacagagtgagactccgtctcaaaaaaaaaaaaaaaaaaaaaaaaagaaaaagaaaagaaaagaaaaaaagaaaatattggttggacacagtggctcatgcctgtaatcccaggactttgggaggccaaggtgggtggatcacctgaggtcaggagttcgagaccagcctggccaacatggcaaaaccccgtctctactaaaaatacagaaattagccgggcgtggtggtgtgtgcctgtaatcccagctactagggaggctgaagcaggagaatcacttgaacctgggaggcagaggttgcagtgagccaagatcgtaccactgcactccagcctgggtaacagagcaagactccgtctcaaaataaaataaaataaacattgtatatacttttttaccagtaaatgtgaaaatatagatgaattgggtggttttctaggaaaatgtaaattaccaaagtgacttaaggtgggacaggaaacctgaataaaatggaaaagtagggaagaaacttaaaagatggtcaaagtggccgggcgtggtagctcacacctgtaatcccaccactttgggaggccgaggcgggtggatcacgaggtcaggcattcaagaccaccctggccaacatagtgaaaccccgtctctactaaaaataaaaaataaaaaataattagccaggcgtggtggcaggcgcctgtaatcccacctactcgggaggctgaggcaggagaatcgcttgaacctgggaggcggaggttgcagtgagccgagattgcgcccctgcactccagccagggcaacggtgtgagactccatctcaaaaaaaaaaagaaaagacggtcaaagttttctccccagaaatggtaccaggtccagttggtattctggaagttctggtatgatggaaattctagcaaatcttgaaagatcagataataggaaaagatagatagcttcccagttcatcccataaggctagtataactagacaggtttaaacaaaataaaaaaaaaacaacaactatagcctaatgccacatattaatagagcaacaactattttcaataaaagattatcaaatggaatccatcagtgtattaaaagaagaatatattgtgacaaatgaaagtttgccccaagagtgcagggattgttcaacattaggaaatgttattgtaatttattgtattaagatattaaagagaaaatatcatataatcatctccataaatgctgaaaagtgatctgattaaattatacatctattctgctgtattggggtagtttgttacacagtaatagatgactaaatagtaagctaggaatcatgaaaacttccttaacttggtaaagaatttttatcagaaaccaaagagaatcatcaaatgtaacagtgaggccctagatacatttccattgaattcaggaacaaaataaggatggctgctatcactgttattaaccaatatttttctggaagttttaaccagtgggattaacaaaagaaatacatggtataaatgttagaaagacaaagttagaattagcattatttgaggatggtatgattgtctacttagataattgaagagaataaaatgaaaaattagtagaactaagaagaaaagtcagtgcagtgagtagacacagataaatatacacgcaaaccattaacttctctgagtaccagcaataactaattagaacacataatagaaaagatcccattcacaatagaaaaaataattctataaaaccactatgaatttacaagaaatgtgaaatacttctctatagaaaactataaaatttaatcaacggctgtaagaagacttgagtaaaacaaagttatatcttgttcttggatgagaagagtcactgtggtaaaaatgacattttgttcctaatttggccaaaacattcattgcattccttattaaaatttcagtgatattttctttgggatttgagtgattggagtttaaagttcattcagaagagtaaatgttcatgaatcactaagaaaattttgaaaaagaatgcaggtggctgggcgtggtggctcacgcctgtaatcccagcactttgggaggccgaggtgggctgatcacgaggtcaggagatcgagactatcctggctaacacggtgaaaccccatctctactaaaaatacaaaaaaaaaaaaaaattgccaggcgtggtggcgggtgcctgtagtcccagctactcaggaggctgaggcgggagaatggtgtgaacctgggaggcagagtttgcagtgagccaagatctcagtctcaaaaaaaaaaaaaaaaaaaagaatgagggcaacttgttgttctgttagatataaacttaccataaagctgcaataatttcaaatgttctatcacagaaatagaggactacagacatgaaacaaaatagagagtttagacacaaacttatgttcatatgggaatttaattcatgacaaaagacatctcaaatcagtggggagtcaataaatgagatgggactattggttacccatttgggaaaaaaaatttaagtgaaatccttgtctcatatgaaaacaaatacaggccaggtgcagtggctcatggggttacatgcctgtaaccccagcactttgggaggctgaggcgggtggattgcttgagctcaggagttcaagagcagactgggaaacatggcaaaacaccaaaaatacaaaaattagccgggcctggtggcacatgcctgtaatcccaactcggcaggatgagacaggagaattgcttaaacccgggaggtggaggatgcagtgagctgagatctcgccactgcactccagccctccagcctaggcaacagagggagactctgtcaaaagaagaaaaaaaaagccataaaagtaccagaaaaaaatctggaatattttaataatattaaggtggagaaagccttcctgagcatgacttaaaaacccataagctataacataaagagtaataattttggctacattaaaatttaaaacttctgtgtggagaaagatgctatacacaaaattaaaacataaacaggctaggagaaagtgtttactacacagatatcaggcaaaaggttaatatctctgcctatatctatatcaccttctggaaactagtaagaaaaagatacaaaacccattcaaaatggagagataacatgatatggcaattcagggaagaaatagacaattagctaataaaggagaaaatatgcccaagcttactaatagttaaagaaatgcagctaaagcaggccgggtgcggtggctcatgcctgtaatcccagcactttgggaggccgaggcaggcggatcatgagatcaggagatcgagaccatcctggctaacatggtgaaactccgtctctagtaaaaatacaaaaaattagccaggcgtggtggcgggcgcgtgtagtcccagctactcaggaggctgaggcaagagaatggcgtgaacccgggaggcggaacttgcagtgagccaagattgcgccactgcactccagcctgggcaacagagcaagactccgtctcaaaaaaaaaaaaaaaaaaaaaaaaaaagaaatgtaactaaagcaatgaagtgccatttttaggttcccaaattaaaaatattggaagggttctggagaaacagaacctctcagataccttctgcaaattggtaacattttttatggggctagtttgtcagttaccaccagaatcctaaatgtctgtattcttccatgctgagaaccatatcctggagctagatttctccaaggtcttgcttccagaaggacctcaacttggccaaccagaggccttttctaaaacaccacaatccaaactgcaaacataagccagactgtgcaactctttatcacctgcccttgtaggatatcattctcaaccaactcttaactaaaaggtgcatgatatatgcttctcaaaagaaagacaagattatgtgagtaggaataatctttctttacagccagactgcaaacatgttaaagtaacggaaataacttttatgtgcactttaaacaaaatgtgcattcctttgacccagcagttcaacttttaagaatcttaaccttcaagaatacttggagacatatgcagagatgttcagtgcagcattgcttgtgatactgaaaaattaaaacaacctaaatgtctatcagtagggaatagatcttagtccatgatatacccatattatggattactctgtagcagatccaaagaaaaggtagctctgtatatactcgcacagcaagatctacaagacttactgttacatggagaaagcaagttgcagaacagggtttacagtataatcccatttttgtaaggaaaagaaaacccccataacaacagtgaaaacatgttatgaacaccctgtcatcatttcaaaattactggcctttttccttggtcccatttccttgcttttattaattcatttccctcctcctttataccttgtccctgtatccagctgttcagattttgtttagatccttttaataattagctcagataccacatcattcattcagcaaggattctgtcttgcctgctttagattaggccttgtgctgacctttggtggaatattggaatgaattgtatctgatcctgctctcatggagctgaagtctagaagggagaaaggcacatagacaatgacaccgtagtgtgatttgggatgggacagaagtaggcccagaaggctgccagatgaggggcaattaaccccatctgggaaggcttcctactggaggggacgtttgtactgagtcttggaagagtgctagctttccttcatccccttcctccaccagaaatggtcttgttcactctttggcccttccaagcaggatgacgtcataggggaaaaatagtggagtcagtacctttattcaagtccgagttctgccacttaccaactcggtgactctgggcaagtcatttatcctctgagcctctgtttcctcatctatgtaatgcggctaatgccaacttacctcttagggctgtctttaggattggagataatgcatgtaaggctcctgggtgactgtcagctctagaagaggagggactacctgtgtcttgttttcctcatagccaactgtgtagcattgaattggattcgatctcaaagctgtgtgtattagacggttctggagcaaagaatgggcctgaccatagcagggctttgggatgagaaggctgagaggagtacagggtacatgggttgcatcataagaagagagaaccaggtgcctggtcttgccttatataaaggtgatgcaggagggaaaataagagtaggcgttcctgggaaagggattccaagtagggagttctggccctggttcttggtcctcttctactgataccatctcctaatctcacagttcagagcagtgaggcatggtggaccactacttgccatggcattcatggcaatttcagtcccaactttgtcactcactagctagctgaccttgaccaactcacttcacgtttctgagcctagttccttatctgttaaacaggactcaataccaccaacatcatggggttcatttactgaatgagctgagctcattcagatgaatgcattcagaatctgagtggctggcacataatgggtactcaggaaagagtagctattattagtgttgatttcagtagatacttttggagtactgctgtgaccagggtctctgttgagtaacagttcttgccctccatgagttcccagtcactcagggagactgagaagggccctgacagaggagaacactgaagggtatggaagcccagaggaaggaatttggccctgtctggggctggtacaggtcaactcagcctaagagctgggtcttaaaggttaagtaagagccagggacagaagggtgaagtgtggaagagcattccaggcagaaggaatagcatacagcatatggaaaagaaacgggatgttattgggaagggccagaagttcctaacctggggtgcatgggtctcagatgggcttcaggaaccccacgaacctccggaaattgaatgcaaaatgttgcattcatatacctatgtgcattttttggtggaagagatggtccatggctttcattaaattggtaaaggggtttgcattcccctcaaaaagcttgagaaccaatattgttggtgacaaagtgtcagttgaatggattctaaataggagagtaatttggcaaaatttgtgttttagaaacatcacattagcagtcagtatgaaaaatgggttgtatgcagggaaaccagctggaaggcctaaactggggtattggcagagaagaaatggatttgagcagggctacggtgttgcacgactccagtgagcaccatttgttgagaagcactttaatttcaaattatagaatccaaatcctttgagagttattaatgagatagactcaatagaagtgtcagatgatataaactgttgtggatgtataaggtgagggaaagggaagaggcgaggatgagtcaaagttagcagagggccagagggacatgagtccatgccagggtgatagtgcaaggggaaaagggaacctctattaatgctcacccagcatccagagtccttagtctcagacatatttactaactttcatcctacccctggttctcagagatcccaagtgacactggcaatactcatttccctgcggattttgcagaggaattacttttgctttgtgagttaggtcaagtttcctgaagaaagctgtgtttaagccagtcattcaaggtccatgaggattctgagagttagagatgggggaggaggtgctgacagtgtccgcaaaggcctggaggtgagcaaggtgaaatcagacattggagggtgcagaggtcaggcttacctcaagcagctgtctgaagagtataggctttttattttattttattttttttttggtaggcagttggagagccatgaacagttcttgaataggaaaagatgaaaagtgacatgatcaaattagcgttttagaagggaaatgagggaggaggctatgcagtaatccaagggagagagaagccaaggtcgtgggcatagagccgaggagatggatttgagaggtgatcaggaggaagagaggactggagtcagagactgaagaggtaaccggggagagaggaggaggtggagatgacagaggctggagttcgcagtaagttcaagtgttcatgcctggcactggattcattcattcactgaatatttattgaatgccaggcactgtgttaggcactaggggtttagcactgaacagaacagatgcctgtcctgatggatcttacagtgagtgagacagaaaaataaataaacaactaaatgtctagagtgtatctgatgtcgataagtgctatgaagaaaaagctggggtgataaggtagagaatgttggggtgccttttgagagggagggcctctctgatgaggcagtatttgagcagaggcttgaaggaggtaagagagtgagccgtgtacctctcagggacgatgttccagatagaaggaaccgcaggtgtaaaggccccgaggcaagagtgtgtttggtctgtttggggagcagcagggagaccagtgtgatggggaaaaggctgaagaaggagtgagaggagtagaagatgagatggtaggggcaacatcacagtctatcttttagagctatttaggaggtagagtccacaataattggtgactgacttgctaagagggcaggaagaatctagggtgactccaaggtatgttttgggctcaggtgactggatgaatggtggtgccttaaggacaatggtgagatgctgagtcagaggtccctatgagagctgaaggcccaaagggccatcctggtagagctgtccagcaagcattgggctcgacgggtccgggacccaggagagggatctacacctgaagttatgaaatggaatgagatcactgaaaaagtgtggagtgaaagagaagagggccagagcagaattgggaaggggaaaccaacgcgtagggaaggagcccaggaagaaatgggggcggggtcagagcagtaggaggaaaagcagtgggggtgggctcacagaagcagaggaaggaaagggccatgcagaggagggccttgttaagagtgtcaaatgttgcagcctgggctagtaagccgagggcggaagagagtctattggctttaaccatcaggagggcctgggcgaccttcctcagaacagcttccatggagtggtgggcgcatgaggcagattggagtgggtcgaagagctcgtgggaggtaccgaagtgaagcagagatggccagtgtagacgggtttcttaagaagaagcttagctgtgaagaggagagagggacagagggggatgtgggggcagatagagggtttttattcccagatgggagagacttgagcttctataaatgttgataggaaggaggcaacagagggggagaggttgaaaacgcaggagggagaggggatgattgttgtggaggaggtaatggggatgggctccagagtccaggtggagagactggccctaaatgctagaggggccccctctttcttacagaggagcaaagcagtgatagtggtggggatacaagggtattgggggattggtgaaagaaatgcttcaggaaagttcaaagcaacaaatggagagccctggccaagggaacggatgctggagctggaaggaagcagagaatacttctggctaggacttccttaggaagtggcacttgagctgggtcaggaaattcagaaaggatggtaataggcaaagatctgtgcagagggaagagtattctaagtggaagaaacagaatcagcacacacatagagatgtgaaaaggccaggcatgctgatggaataatgaacaagctagcttgatgaaggctgggcatcagtgagtagggaacatggataccactataatggccgttataataatagttaccatgcactaagcaccagccttgcttagtacatatttgaattcctttagtcccactgcaccctgcagaataggtatttcctcagtttgcaggtaaggaaagtgtgtcctggaatggtgaagaaatggacccaaggtcatccggctagtaaatgatggggctggtattgaaactcaggtccgtctgattccatagcctgtgcttttgccatctaacaggaaaggcctggtgaggccatatggtgggagagccttgaatgccaacttgaggaccctgaactttatccaggaggcagtgggtgtctgagcagaagagatgcatgcttgaaggtgggctttaggaaggctaatgtggttcaagaagggagggagaagaaatcaggaggtgactgcagtgttagggggagaggaagcaggggcctcgcctggaaaagaggggagtgagcagtgggaatggaatatcacttgttcctcatgacagcctggagaggtgtggatcttctgtttttatagatgaggaatgggacactcagaaagggagggctacttgcccagaacttgcgccctgcttcatgtgattttgctgattcaggaagtccgtggaacaatgtgtcagagggagctctgagtctgagaaaggcgtgtgcgtgcgtgtgtgtgcttgtctgtgcatcagatggacagcaatgccttcctttcctttcccttcacttccctgtctgcgttccttcccacctcttcccattcttccagtctcctggattccataattcctgcatcccctgagccaaggggtctgggaatgagggtaactgtttccttgtctgtccccagaaggtcagccttgtcactcccaagtcacctggtcccctcccagcccaactgtctgtccatccaccatatgaaactgtagcccagcaccagtgaatgccacatgcagcctggcccctggtactgctcagcagcaccctagggataggtgcttgttcctgcagcgactcttctcccactgctgtggctgcttctgtgtgggcagacggccactttgggaattagattcagctcacgagtagttaacaataatcaccaccatgttcccattgctggtgtttgccagacacttgatatatgttctagttcttgcaacagtcctgggaggttcacatcacgagccccatttttacagacgaggaaactgaggctccaagagtgacaataatgcgctcaagggcatatagcctggaaccacttgtagagctgggatttgaacccaggtctgtttgcttccaaagctgtgggctttccgtactccatttccaagtatctcccattttcctgagcctgaaccttcaggaaatacaaatccttgtccttcaagagcagggtgggtttctagagatagtgccaagttcacccaaaggacctagtgggatgagtctgagacttggagctccaaaaactctgggttcaaatcctgactctaccacttacccagctgtgtgacctagagcaagttatctaacctttctgagttttaattccctcatctctaaaatgctcctctgcagagctgttgtaggggctaagtgagatgatgcgtgcaaaatgagagcaggttgctgttattatattaaaatgagggtcaggcacctggcagggttagaaagggagttgatatacgctgagggtgaccttaagactgagcccaggctgggtgtgggggagggctgtcccagcacactgagttgggtgtgaccctggataatccatcacactggcctccccaccctgacccccattctcgtcccaccttctggttccggtcctggcccttcgcgtatctcccctgctctgcaaactaatgcctctgcctctctctgtcacccaccgcctgtggcctctaccccgcccttcctggccccagggaagaggaggaggaggaggagactgaggaagaggaagaggaagacgctcaccagttctgctgtccggcctccgagtgcagtagtccctcctctcggtaactgagaggacaagggccattttctatgcagaagcaaaagccttaaccagcccctccttccccccacccacccccccgcagattcccccatgggaccctgtcccctgcttcaggaaccagatgggcaagcatcgtgccccttcctccccccaccttcttcttggaattcccatccccactgctgtctcctctggactccagcccctgaattaaagagagctggagccctaggtccgactaaaatgtgggagaagcagagcttggagcttggagcttggaacctggatcctcccgtacccgcactcccacttcccaggcaccctggagcctgccactactggagaggtctccaaatgacatcccaaggacctacctctgtcctctgtgagcacaaacagagatgcagggtgcctagggctcagaggaccagacgggggcaggacccagcctgcctagttccctgtcgtttgttcccttgctgtggccattgctgccatctcctccactgcttgaaggcctcaccccatgccctctgccactcccatagtgctctgtaaatattatcaggaggaaaaggcctctcagagtgcgtgttgctgtgtacaaaggaatttccatcaataaaagctgatctcttctctctgtctgatgtatattccacccacccccacttccctcttccaatccccaccagggccttgccttctttcctatccagggctgggaataggggccgggaaagagagtagggtttgattcgtggttttgtcaacacccaggaggcactcaataaatgcatgaatgactcccaacacgggcaggctaaccttggatgtgtcgcatgacctctttgacatctataaaaaggagaagggttggattagagggtctccaatgactcttccagctgtgacattttgtgaatctgagatgctacagttttaagaagctatgattatgtgaatttaatagacaatgattcagtgacacattccactgcaattttatgatttctatttctacaatgcagtgattttgggattttccagtcctgtggttttaagattgcataattctaccatttgaacaaattctgatgatgcaattttaatattctgcaatgtttagattccttgatcgtttacttttaaggttctgattctacaactttagggatctctgaatctgagaggaagccatttccctccaatgcaacgaccctaaatattccctgcacctgggcagaggctggttctaagactccctggaggctctcagctggagggtggaagatgtcctttacgggtttgtaggactcacaccttccatgatgtgtctgaagtgggctcatacccccgacttttcctgtctgagcctttggtattagacaaatctgagtttaccttctggttctgccacttacatctgtataaccttgagcaagttttttcttctccttgagctttgttttcctcctgagtacagtgagaatatacctacctctctgggttgtcatgaagattagcaagaaagaacacaacgagcccagcataggagcttgtgcactgttgggcaagtgtgctgtgattggtggctcttgttttgattaaggcccaggtgagagttttctcctgtcttttctttcctccctcccttcagcatctctatcacattgaacctctaggtttcctagaacctcacctccttccctcacttattgcctcactcgctcaactcatctactcattcacccattcaaagtctcatttatttctcccctccctccctgcctgtctcccttatttactcttcctcattctactcaacaaagcattgtttgagcccttactgggtataagacctgacgctaaatactgtgagagatccaaagtaagacagaggccaggtgtggtggctcacacctgtaatcctagccctttgggaggctgagacaggcagatggcttgaggccaggagtttcagatcagcctgggcaacatagtgagatctcatctctacaaaaagatttttttttttttttaagcatgacagtggctgtgtcctctgcgagctctccatctcccaggggagatgagagatgagaaatcctttgggaaagtaggaaggatgcaaagggttaacatgattggacaggaacggcttcagtaatgagcacattttgttcctggcccagagaggaaggagatgtcaaggtgggtggggaggtgtggtgtccaggagggcttgctggaggaagaggtgcaagagttgagccttgaaggctggtaagggtttgaaaaggtggcaaggggtgagaaggcattataggagacagggaccgcatagacaaaaacctgggggagcgctccagggtcatgcaggggaatggtgggtacattactctgtttattctgctctccagggtgtgtgaatgtaggtgacctggggctggggacgaggagaccattctacccttccgctgaatggagagagaagcaagtgtgggggtggggacgggggttcaactacatggggggagggggcaagtcagggtcagatgaccctcccgacccgtgggcaactgaattggctgaatcgggcagagggcttgtgctgtgggaagggggtggggttttgatcagccgtgagagaaatatgtgtgcacgcatggcctccatgtggccggccatcctcacacatgtctttgcacaaggctctgcaggtctcacagttgtgagactgtgcacactgctgcagagctgaggaaatgtgatgatgtgagactgggtgtgaggaattctgagtgtgaggttgattgtgtgaagtggtgactttatgtacctggcagccttgatgtctgtgtctggtggatgtaatcacaaggctgggtgtgggtggcttttaagcacgtgaggctgtggcctttagggtgacagttgtcaggcaggatggtcacacacacacagacacacgtgatttctacctgtggtcttcgaggacccagggtggctgctgagtaactgctgtgtgcttagtactggcatgagtgccataggtccgcaaaggtgaatcacaccgggccgctgcccttgggaaacaggacgggggtgtggggtgggagacggacactttaagagagaaccacaagttagccaggaagaaagactgactgtgataatatgggtatgcataagacacaggggagggagtcactgaccctgtcatgttccgtgagcggcaggagtgagtcagcattgacttcccagaaggaccaacctgcccagggtactgcaagatgaagatgagctcacccagatcaagcaagtcggggggtgaaggggagacagaagacattctgggcagaagaaacaaaggaagagtatgagcatgggcttggttatgtggatcagcttgctgtagtctaggaattgcaagtaacctgctattgcctgtgacattgaggaacttacagggcagggtgggaggtgaggggtggggagacaggccagattcagaggggcttctgaagctaagagtgggatgctggccagaggtgagggggattcttgtcctgtgcaaccctgggcaagtcactttgactctctgggcctccatttgggtctgtgggattggatggttcataaagcctagtccgtccagtccatcccagctctgtgcatcttctgccacccttggctagccacatccatgagtcatcgctcttgaggtcaggagcttcttccatctaacctcagtccttcctgcttcctcccgggttgcttcctcgttcacccactccacaaatatttacccagcatgcgatcctttgtgtgccactgtgggaaggcacggggagatgaagaatgcgaggactgtaccttgaagggactgcttatagtgcctgggacagagggtggggtggtggtaagagcacgggctttgtgttcagatacacttttgtttgaatcttggctccaccagtgctgagcttcaaggctttgggcaggttacttcatctctctgtacctcagtttcatcatctgtgctgtcctcctcagagagaacaacccaaaccttgcagtgttgctcagcctagcaaaatgacaactcaataaatgacaactattatttttagggctgcacagcagcaaagctgggattcaagctcaggtcttgcgctcccaaagcccgtgtatgcagctcagctcctctgaaggctgctttcttccctgtcagttcctgtgccaagccaggctgggctagggcttagatccctgtgacactgggattgggcagcagaactagcttgcagaagaaatattggagggagaggtggctgcagtccccctgcctcctctctcccctgccactgggtccagtctcctggcccagtctgctccttccagaacccaaagcccctggtcccatccaggtgcaatgaccttcctcgtcttgttttcttgtctctacttccagtccgtcccgttccccccactgccacctaagttgtcatggggatagtcctcaccatccctagcttcctcttgccctcatcttatgatatccatggcaacagcccccattcgtttccatgacaactgcatcctgatcccatcccctgctggctgcctggttccgggcagtgccaataaagggaaggagggagagaagacctcccattagaagcagcatttgaggaggattagtgcccctgccatgggcaggccagccccagatccctgtggaacatcctacactgcttctccccatcttagtgctttggcacacaaggttccctcactcttcatctctaccaactccttccaggcaagacccagtccacaagcttcctcccccaggaagccttccgggcagcagaggaactagcacaagctttggggtttgaatctctgtcctgccacttgctagctctgagacctttggcagtcatttcccctcttggagtttttttcttcatctgcaaaataggaatcctaattcttccctcacgtttgccatgcagattaaataatgtgtggaaaatgcctgacacagggaaggtgcgcagtaagtgcgagtttatttttattctgctcaaccacccccaaacagaagggatctctctcctgcactcccccagcacttcctctgttccccagccctgataactttctgctttgtactgtggttatttgtgtagcatagcttatttccccctctgcagaggatgctctccaatttcccccacagaatagcccagcagacagcgcacatgggcgtgtgtgtgtgtgtgtgagtgtgtgtgtgtggttgtgtccgtatatgtgcatgtctgcatgtgtttgtgtctattttcttgtgtctgtggatgtgtttttgtttctaggtttgtctgcctttgcatgtgtctgtgttattgtacctctgcatgcatgtgtgtgagtgtatgtgtgtgtgtgtgtgtgtgtgtgtgcacatgcagatgttttgctcctggctgggaagagtccagagagggggtgctcccagaccgtttctgaagtccaggaatccaaagagggagttggttttgcttgacccctgcacagatgagaaactgagttgcagagaggaaaagtgacatgcacgggctcacacagctggtcagtggcagtcaggacctgagccttggcctgcccagcgtcttactctacaacaggctctttctctctctgtgtgtttgcatgtgtgtgtatgtgtgcgagagaaagagaagaagagagattttccatgtgatcagcatgtccccgagtgttgttctgggggctctgacttgagggattccacatccccagtgctgtttcttcagcagtatgtatgatgtcagaagcaacgccgtcaagcaccctcctttttttgccaggctcccttgtgggaggctgtgctgacagcctgatctccctgccactattccctttgcaaccaaaacgggggtgagctctcaagggaggaattgccaaagagtgcagagccaggggcagcacggagccgggagtgaggagaggcaacaagatgtcatgaaaagcctgggccctgggtttgaatcctagcttttttacttaatagctatgtgaccttgagcaagtttatgtcacctctctgagcctcagtgtcttcatctatgaaatgaggctaatggtgcctgccttggtaagtttcaagaattcaatgagctaagtagtgcctttgccctaggaattagaggtgacaacagggccctactgcagcccgagaggagcgggtgtaagacagcctgtgtggaggaggcaggcaggcatggaaaggcatacctgagcagagcattgaaggctgagcaggaggtagccaggttggggcaatggggcagagaatatatgaggtgggggtcaagtcaggagagccatccatggccacagtgaggaagttgaaggttatcccatggctgctgattcctggaacacccaagttagatcatgtccctcctctgctcacctcaatcagagcaaaagccaaagtctttattgtaggctcatgccctttccgatttggcccccatgacctctctgatcttacctcctatctcctctcattcactctgttccggccacactggcctcttcactgtttctcgaacatgccagacacagttctacctccgggcctttgcgctggctgtaccctctctctggactgctctgcctttgccatgcaacttcctctcacttccctcagcactctgcttatatgccattgctccagaaaggccttccctgagcaccacttctcaaacagcaccttttcgcaatctgctatattttccttcctagcacttcacccctacctgaaatggcaggatatatttacttgtttctttcttctgtaagcctccaaccttgtgccccccataatgagaccattctctgggtcccagccacacccattccctcactagaacatcacctccctgagaatgttctcgtgcattttgctcactagtatatttccagcacccagcactgtgcctggcatacagagggtgctcagttgttgtttgttgagtgagttatctggcgctgtggaagggttttagtgagagaatgaaatagttaggttagtacagttttgtttttgtttttgtttttgtttttgagacagggtctcactttgttgcccaggctggagtgcagtggcaggatcacggcttaccgcagccttgacctcctgggctcaagcgattttcctgcctcagcctccctagtagctaggaccacaggcatgcgccaccacgcctggctaattttttattttctgtagagacggggtctccctatgttgcccaggctggtcttgaactcctgggcttaagtgatcctcctacctcagcctaccaaagtgctgagattatgggcctgagccaccatgcctggcaatacttttttttttgagatggagtctcactctgtcactcaggctggagtgtggtggcacaatcttggctcactgcagcctccacctcccgggttcaagcgattctcgtgcctcagcctcccaagtagctgggactacaggggcccaccaccacacctggctaattttttgtatttttggtagagatgaggttttgccatgttgcccaggctggtcttcaactcctgccttaagtgatccttccatgtcagcctctggagtagctgggattacaagtataagccactgtgcccagctagatttgtacttttttttttttttttttttttttggagacagtctcactctatctcccaggctggagtgcagtggtgcgatgtcagctcactgcaacctctgtctcctgggttcaagtgattctcctgcctcagcctcccaagtagctgggattacaggcacacccaccatgctcagctaatttttgtatttttagtagagatgtggtttcatcatgttggccaggctggtcttgaattcctgacctcaggtgatccacctgccttggcctcccaaagtgctgggattacaggcatgatccacggcgccaggcctagatttgtacttttggtggtggtggtggtggtgggttttgtttgtttgtttgtttgtttgtttttagacggagtctcgctctgtctcccaggctggagtgcagtggcacaatcttggctcactgcaacctctgcctcctggattcaagtgattctcctgcctcagcaggagatttcaggcccccaccaccacgcccggctaatttttgtattttcattagagacgggttttcgccatgttgcctgggttggttttgaactcctggcctcatgtgatctgctcgcctcagcctcccaaagtgctgggattacaggagtaagccaccacgcccggcccagatttgtacttttgaaagctctcactggccacagggtgaagaatgggttggaagaggagatcggaggctgtggtaaaagttcaggagagagtatttcttagagcagcctcctgagcacattcattgactccctctggacggcagcttttattgagcacctactctgttccaggccgtgtgctctgtgttagctgggagattatcaaattctcttcctgagctgggattctgggagtcatgaacacaaatagctgtcatgctttgccaaagctaacctgtgccataaaaagcaggacagacatgtgctgtgtgtgggagctctgaacaggatcagcaataatttctggctggaggcgggattcaggagggcttcttagtggtggcatatgacctgaatcttgacggaactaggatgtgggggaatttctcagattgcagatggcggagacgatggggattgcatttcaagtggtaggtactgtatgagcagttttggaggtagaaagcagaggagcatttgggaaaagcaggatgtgggccaggctggaatgatgggtggatggaatagggggctggcagccaaccctgaagtatggcttaatgtttaagagtgtgggctctggagtcagactgcctggatttgaatcctggctctatcattagtagctgtgtgaccatagatatgttacttaacctctctgggcctcagtttctttatgtgtaaaatgaagataaattacagtacctacctcatacggttgtcttgaagagcaagcaagttattcagtgtgaagtggtaagaatggtacctaaatgtgctaaatggtctataaatattagctgttgtatcttggagaagcctcaaatgccagaataagggacttgggctatctcttctgagcagtggaagttatagatgatggttcatgcatacaggagacagttgatcaaaactgggcttgagccgtgtgctgggaggggaggtttgagagattaatgggcaagatcctgcagtcctggcagggaggagaggaacatcttggatgccgggggtgggctgagctggggctgaaccctggagtgggggtgatgtcagggccaccgccccaggcccaggaggagagagaatttggggtggagagcgagcgatgggtgggagctctccccagggcggagccgagctccacagcgctgcagcccgggaccgggcctcgtgggcgcagccttcacaccacatccagcccccagtgcaaagcgctctgctgcaaggctggcaggcctgttgcagttccagctcctgcactggtagggtcccccccagtacctaccccagcccatttctgccctttgcctttgcctctgccgaataggggctggggagtaccccttcacctgtttaccagccaagagcctccaaccttgtgccccccataatgagaccattctctgggtcccagccacacccattccccccacagcctcctccatgcctcacctgcgtgttccttcccgcccgactccttccctgtcttccccacctctgtggctcttcaccgtgcaggctcggctcaaggcgcctgggctctgtcgccacctgggttccctggcagcctggttgccatggcaccatgggagcagttctggtggaacaacagctctgggaaaccagggcaggcaagacccggggcccagctcctgccacgcgtggagactcccctgcccccttcccccagctgagcagaggaggccatgaggagaaaaaggaagctgccccgcagggctgctctttacctgtgaggatgctggatgggaggcgcctcccactgttgctgctcgccctgccctgctgctggccctgccctcgcaaccagggaaccctgggaactggcttggcctggcccggagtccaggcaccagggggcaggggccaggctgcaggggacagggctgggcggatgaggggagagctgtgtgcaggggtgggcctcacacagctgggacagggctgggagggggtggcgctttgaaggagctagtctggggtggtgctgggaatcggactgggagggaaatcacagcgagcactgcgttggggacaaggccaggaggggatggagctgtaaggggaagaggtctgtggggaggggtggagctgtgagggggcagaagaaagggcatgaggagacaagactgggaggagagtggtctaggggagaaggctgtgaggggtgaggaggactggggaccaggcagagccttgagggaaaggagtctaagaggatcttgccgtaaaggcaggggggctggaagggaggggacttgggtgggagtggggagacgtccaagagctaggactcaccgtggcctgtaagtgttgggtccctatatctgtgaggaagctggggtggatgggatggggggcagggatctggctcacccactctcagtatggcccagtaggcccctgtcctgtccccacatcctggctcatcttatctcatccccacagtgtggagggtgatgccccaggcagtgacctgagcacagcggttgatagtcctgggagccaacccccctaccggctgagccagctgcccccctccagcagccacatggggggcccccctgctggagtgggccttccctgggctcagcgggcacgcctccagccagccagtgtcgccctgaggaagcaggaggaggaggagataaagcgctccaaggccctatcggacagctatgaactctccacagacctgcaggacaagaaggtgcaacagaggcatctggttgggaatgggagtcgggatgcaagagagcgccaggggagggtttgggatgtggctcttgggggtggtatcagggagggataatgaggctggaattggagaagactggcccaggacccttcaccccactggggatgcactcattcaccacccatccactgaggcttgtattcactcaagaaacatttactgagctccctgcccgggtcctggcgatgtaaagatgaatgagtcctggatccagtccccaaaaaactcagtctaacaggaagaacacacatcagttgaccttttcagaagagtgccatacaatagattgtttggctaaaaagaaaggtggagggaaaacaaaatactacatataggaaaaaactggaaggacatatacaaaaacatataccctacaccaaaagacatattctagttatgcttaggtgtttggaatgtaggtaattcaacctacctacctaccttccttccttccttctctgcctttctctctccctctctccttctcctttctcattctctttcttcctcctttctttccttcttgctctccatttatttctaccttgctttctttttttttggcttctctgtttgtttcctgttttcaaataatcaatatgttcttcttgcaaataagaaaacaaaacataatccaatcccatttgactagtgttatctgaaattcaagtgaggagacaacactgagcacctagcctggcgctctcggtggctgtaagcagtcagccatgattccagtgggggtggtgtggttgagtgcctagggagatgaggctgccatgactttctgaccttgttcccctcgacccttctctgccaggtggaaatgctggagaggaagtatgggggctccttcctgagccgcagggctgccaggaccatccagacagccttccgccagtaccgcatgaacaagaactttgagcggctacgcagctcagcctcagagagccgcatgtcccgccgcatcatcctttccaacatgcggatgcagttctcctttgaggagtatgagaaggcacagaaccccgcgtacttcgagggcaagcctgcctcgctggacgagggtgccatggctggtgcccggagccaccggcttgaacgggggctcccatatggaggctcctgtggtgggggcatcgatggtggtggaagctccgtcaccacatctggagagttttctaatgacatcacagaacttgaggactccttctccaaacaggtcaggatccctgaaaaggacctttcttccccatccccgtgttctggctactcctgctactttttacctagattgcaaactgaaagaagttgcgtgacaggcatttaataacagcaaatagctaccatttgagttgggactgtgagaataatgagaaagaactggta

SEQ ID NO: 132 - DNA, 67004 bp, mus musculus; identical to SEQ ID NO: 131

SEQ ID NO: 133 - DNA, 38669 bp, mus musculus
ccacgccccctggacgccgcggtcccgcccccggacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggtaggtggcggggcgtggaaggggctggcagggcggtagcctggggtgccatcgtcttcccctagagcttcgggctggccccggcggaagaagtgggccacgcatgggcatttgggctctatgataaggggcgctcgcccactgtacctccgaccggacataagcccgccggcctttggttgggagaacctcgcccccactttggcgacttctagcactgagtttgatattaaaagcaaagcagcacttttaagggaggaagttgggtgttccctaaaattcctttggccttgctcatccggggtgtggttggtagccgcgtcggggtagccccttgtcagaaagataatatttggagttctatgttacctctagcccttcatcttcctttggagaacatttttaggattaaatgcttgacctacttcggctcttacttaagtttgttgtaacattggcagagattacagggtaccttttggctcccaggaccctaggactgtgcgtctaggaccctggtgccaatttgaacttaactttaatgagccgcaaagcccttataagaggctgggtgctttgattgggccacgtgggtaagggaggatgcctttttgtatatgtaatcttcccagctggcacagttaaggcctgagggccttagactccagagcgtgtctagctctccctaatccctttcacccgagcatgccaccctttccaagttttctgcctggctgcatcccagggggctcacacctgctccagtttctgaagttatctcgctgccagtgggcctgtccccctgatgtgactcatagtgcttttgactcacattaaccccatcaattctcttgggggtcctggatatctctctctctctctctctccctctctctctctctctctctctcactcactcactgttcctggggactttgttatcagttgtaagggttctgtcttgtttatagtacttaaaaacaaacaaaaaacctttgttaaactatttgaaggcagactgaaagtcattatgagaggggccacagttgactttagcttgcaatgtgaaaggtcttctacaaaagctccatggtcttgttcaggtgctttctcttataaccctgtgttcctttcttgaaaattctattgaggccgggtgtggtggtgcacgactgcagtcccagcgttttgggatgctgaggtggatggatcacttgaggccaggagttcgagaccagcctggccaacatggtgaaaccccgtctctattaaaaatacaaaaattagccgggagtggtggtgcatgtctgtagtcacagctacttttggaggctgaggcaggagaatcgcctgaaccggaaggcagaggttgcagtgagctgagatcgcgcccctgcactccagcctgggcaacacagtgagattctgtctcaaacaaaaaactattgaaccttaagcggataatctcttagtgtctagtgagaggaggagttcacaaatgaatatagactgagatgattaggttctttgactggtgggcaacctttgtagcttcttttcttttttagacttgcaagaggcacctttgtttagtctctaaatagaggttatttcctcagagtggagggcatatgagtggtattgcctgttattgcactgaacactcttccttgccaactgctgtaagcttgggacccagggctgagccagggtgagttatgtgactccccaggtaggccatggaggccttgagttttcttttttttttttctctttgaaatactttttttatttctttgggatatatgtccagaagagaaattgctggatcatatggtagttatatttttaatttttggaggaactgcctcattatttttcaaaatggctgtaccagtttacattttcaccaatagtgtacgagggttcccttttctctacatcctcaccaacacttgttatcttttgtctttttgtaataatcatctttttattattattattattatactttaagtttagggtacatgtgcacaatgtgcaggttagttacatatgtatacatgtgccatgctggtgtgctgcacccattaactcgtcatttagcattaggtatatctcctaatgctgtccctccccactccccccgccttgagtttcttgatctcctttgattggaaaggttcagttacaaggtcctgggatttgagtgttgcaaaggcctctccacagtaaaggcctagaggttttgctataagtaagactcctgagggcttatcaggagataagccagtaaccctgaggtactgaagtgttgagtattgattaaaaccattctcccacctcctccacctcagtgcggtgtgtgtgtgtgtgtgtgtgtgtgtgtgtgtgtgtgtgtgtgtgtatgtattgggggagatcggaagaactgggctctatctggactctgctggtgtgcctgttgactggcactgggggaaagtcgtctgaaactggggcctcagtttcttaaggaggttggtttgaatcagaatcttcaaatatagggggatctgagggtacaaaaagggtctgtgcacctcctgaaatagtatataccattgtgtgtgtgagcaaaaatgtattccaacccttcccacgcccgctcgaggtccacagtttccatcagattatcagtaaataggataccaaatgtagtgaaaagttaccattacatgccaggcgcggtggctcacgcctataatcccagcactttgggatactgaggcgggcagatcacttgaggtcaggagttcaaaaccagcctggtcaacatggtgaagccctgtctgtactaaaaacacaaaaactagctgggcatggtggtgcacagctgtaatcccagctgctcgggaggctgaggctggagaatcgcttgaactcgggaggtggaggttgcagtgagccaagatgttgccactgcactccagcctgggtgacagtgagactgtctcaaaaaaaaaaaaagttaccattacccgaatactcttgaatgctatgttgacagtatgatatagatttattattaccaatatgctattggtataagcaacatttttttaaaaagtgttccaattatgcctttgttgtgccacaggaatgtatttccaaattttttaaggcagcatgcaaagcaatggggctctaggactacaattttccaaataaattggcccaagtgtttctctgtattcattaactcccttcttttctctcctcatttgattctatgtttggcagtggtccgtgatagtgcctggcttaggctatctttcctttttttttggagacagagtcttgctcttttacccaggctggagtgcagtggtgcgatcatggctcactgcagcctcgacctccccggggctcaagtgatcctcccacctcagcctcctgagtagctgtgaccacaagtgtgcaccactacgcctgactaatattttaaaatttttttgtagaaacgggatctccctatgttgcccacactggtctcaagtgatcctcccgcgttggcctctcaaagtgctgggattacaggcgtgagccattgtgcccagcctggttctttttgatctttaggggagactttggagaagcatgactttctggaataatgatagctagagatttttgaggacttgtcagtatattagacatgctcttctagacgtgcccttcagggtttaatatgtgttaattcctttatccttttgacaatcctatgggataggtagtattattatccccattttacagatgaggaaactgaggatcagggaggttaggtaacttgtctaaggtaactcagctaacaagcagcatgattgggctcttttttttttgagacagagtctcgctgtgcagtggcacgatctcggctcaccgcagcttccgcctcctgggttgaagcaatactcctgcctcagactcccgagtagctgggactgcaggtgcccgccagcatgcccagctaattttcatatttttagtagagacggggtttcaccatattggccaggctggtctcaaactcctaacctcaagtgatacgcctgcctcggcctcccaaagtgttggcattacaggcatgagccactgcgcccagcctttgggttaacccctatactgtattgcctctcacacaaacaggatggaatgattttcatccctcttcagaaaatgctgcttcttagtgtaacaaaacaatttctgtgtatatgtgtatttattcaggtatgtgagactggttatatagctcctgttagtgatgcgtattcagggtatttagccattcagaatcagatcccatttcttatgttggatacatttaacgtgtctattatagttcctattaatgtgttgggggtcatgatttttttgctctttcagctaatggtagcaatagaaaggattagctttttccagtgtgttctttaaaaccagatatattcagttgtagaatgctagtttcttttttgagatggagtcttgctctgttgctcaggctggaatgcaatggggccatttcagctcactgcaacctctgcctcctgggttcaagtgattctgcctcagcctccagagtagctgggactacaggtgtgcgccaccatgcctggttaatttttatgtttttaatagagatagggtttcaccatgttggccaggctggtctcggactcctgacctcaggtgatctacccacctcagcctcccaaagtgttaggattacaggcatgagccaccatgcctggctgcttgtttctgagatggaagaatgaaggaatacttactctgtttccttcagtaaggcatatgaacctatagaagatacataaaacaaaataatgaaaaaaatggaaaattcaaatcacgttctgagaaaatgcagattagatggtcaaaaacaaaaagacggccaggtgcggtggctcatgcctgtaatcccagcactttgggaggccaaggtgggcagatcacagggtcaggagtttgagaccatcctggctaacatgatgaaaccccgtctctactaaaaatacaaaaaattagccgggcgcggtggcggcgcctgtagtcccagctactcgggaggttgaggcaggagaatggcgtgaacccgggaggcagagcttgcagtgagccgagatcgcaccactgcactccagcctgggcgacagagcgagactctgtctaaaaaaaaaaaaaaagacaaatattaatctgtatacgaaagtacaggaattgaatatttatcgtgaaaaagtgaagctaaaatatttaagagagaggcttgttagctgtgtgattgaagaataaacagatccaaaaccccaaaccctccagcaagaattttggtcttagtggaccagcagggattgtattgcaaccaaataagatgactggtgactaagaagttcaattagccaatgagtatgtgctcatatttctgtgttctgtgcaattagatgatttgacttggtgaaaggataaggatttgttctaacagcacagtgtcaaaactgcatgtagattttacagaatactgtaaatactgagaggctttctctgaatgctgtcattcagaagagaaacctatagtagcttggtctgtaaagaaaactaaaaatatctcttttttttgttgttagtcattgcttattcccacattaggtggtgagaatttactagtaaattgaactggaatgagtgacagtatctggggttctgggttttttttgtttgtttgttttatttttgtttttgttttgagacagagtcttgctctgttgcccaggctggagtatagtggtgtgttctcggctcactgcaacctccatctcctgggttcaagcgattctcctgcctcagcctcacaagtagctgggattacaggtgcctgccaccacacccggctaatttttggatttttagtacagacagtgtttcaccatgttggccaggctggtctcgaactcctgacctcaagtgatccacctgccttggcttctcaaagtgctgggattacaggcatgagccaccacgcctggcctgcggggttcttaacctattcagtgccttgccttcttcaactgtgctctcacagatcagtttattaatctgtgatattgcctgtgtgctacccctgacataatattgtgtgattaggagtcaatgcttaagcaataatgaaccaaaatcaacttattttgggagagtaggttaggcacatttaggtagacagcttttattttttatttttttgaagcagggtctcactctgttgcctaggctggagtgcagtggtacaatcttggctcactgcagcctcgacctcctgggttcaagtgatcctcccatctgagcctcttgagtagctgggaccacaggtgcatgccaccacgcccggctaatttttgtattttttgtagagatggggttttgccatgttgcccaggctggtcttgaactcctgggctcaacctgtctacctgcctcagcctcccaaagtgctgggattacaggcctgtgccaccgtggccagtagatagcttttattttattgtgttgggactctagaaaatttctgcgtaagttaaataaatactttctttgcatctggaaagggctaattcaattttcaaagtttactttataattgggtttatcttatttattgaggaaatatggtgcgataataaagaacagaataaattgttcataatgagtttgctcagttgtttactaaatcgattatggacttctgaaactaataaaatagaaagaccaataataaatgcattaaacctagttgccgtcttttatttattttgtagataattacctaattggtctctgctctcaagaaatgtttactctagtgggagagatgatttatggaatagcctcatgaaaacatacatatacttgtgaaacagctacagactcctacaagacaatatatactaagggtgatatggccagatactctgggaggagggtaggtctttagggttgccagggaagaagctgtgggatctgctctgtgttttatcttgttttataggctttgtgccttgggcaaagggcagcttactcctggaagaggactgactcaaggaccccagaaccccaagaaacagggaatcttccacattcatgaaggcaagcatggtgtctctgtttgatgcctatgtggtgaaaaaccttgttttacttttatttgaaaggtatatagagtgatagtttagagcaaatgaggcatattaaaggtagatctttcataaacatttcattgacaaaatgaccaggatagctgcataatattaatagcttcagatagaagtcacattcagattttgaactattgttcctgggagccttgaggactgagctcttttagttaggtgatttccacttcctgtgtgtaggttctgaaggcatggaaaaaaagagatgggcccattagttgtatcaagtaaacactcctagtccatagttatgttcgagggatcctgttagtccatgcttaattaaagttaatttcaattaccaatatgatacgtaaactatggattgtctttattaaactaggagtattcgttataattaaaattgcggcttctttaaagggtccaaataaatttatattatgtgtgtatataaatatatatgtaagtaaaattaaaaagtttttccttcttggccctcaatacttgcctctcttcttacactgattaagctagtagtaattattttatgtcagtgagcatcagtagtccatgtactatttgaggtactttctgtccattcttttttttttttttttttttttttttttttgggatggagtcttgctctgtcacccaggctggagtgcagtggcaggatctcggctcactgcaacctctgcctccctagtagctaggattacaggcatgctccaccacgcccaactaatttttgtatttttaggagagatggagtttcgccacgttggccaggctggtcttgaactcctggcctcaagtaatctgcctgtcttggcctcccaaagtgctgggattacaggtgtgagccttttttttttttttttttttttgagatgaagtctcactctgtcgcataggctggagtgcagtggtgggatcttggctcactgcaacctccgcctcccaggttcaagtgattctctgcctcagcctcctgagtagctgggattacaggtgcccaccatgccaggctaatctttgtatttttagtagagacggggtttcaccatcttggccaggctggtcttgaactcctgacctcatgattcacccacctcggccccatccattcttttattcaaggaacttaggaggaaaaaatcagaaataagactaagttactaatggttgttgtttgcagttctctaacatttagttgtaattatacatcaaatttatggtgtatccaaaattgtttgatagaaaaatcaaccatttttcatgaaagttaaaatgcatgttcatataaattatatttggttttgatcagttagttattgaaggactgaggattgctatagttaatttcctataactggaatgtatattttgaagtgctaggaaaaacacataaactcaacacagtatttgaaatactacagatttatcttttagttttgaattattgctggttctctaattgattttccctttattcatatagcatgttcatctatacatgtgaatcatggtgtgtgtggtaattagtatcagcttttcttttaagagcttaaattttgtaagcactaatatacgcttgcacttttgggcagtggcattaactaaaattgcattctttgccttagcttgatgtaagtctttgcttcatttttctggcttaaacttttctaacaaccaggagactataaatatatgagaaattaattataatgagactcagatttggatattagtattagtctctgaactaagtaatttgatctattactgcgtataagaagataggtgggggccaggcgcagtggctcacacctgtaatcccagcactttgggaggccgaggcaggcggatcacctgaggtcaggagttcaagaccagcctgaccaacatagtgaaaccccatctctactaaaaatacaaaattagcagggcatggtgatgcctgcctgcaatcccagctactcgggaggctgaggcaggagaatcacttgaacccgggaggcggaggttgcagtgagctgagatcgtgctattgcactccaggctgggcaacaagagcgaaactctgtctcaaacaaaacaaaacaaaacaaaactacaaaaattagccgggtgtggtggcacagcgcctgtaatcccagctacttgggagactgaggcaggagaatcgcctgaacccgggaggtggaggatgcagtgagccgagattgtgccaccgaactctagcctgggtgacagagtgagaccatctcaaaaaaaacaacaaaaaagaagataggtgggaatcctgttcatatctccatcataatggctcttactggctaacactgatacagccccattaagtgaataattgaagttatccttttttgtttgtttatataaaccctagtgattggcacaaaggtattcatttgtgcacctttaaagagacagtatagttctttcaggtttttagggagcagaggcttgatcctgtccctgagctgtttgttgtggcattaaatggaaatctatggatctttaaatcttttgagtgcatgaattgctttttgtagttcttgagctcattgccataatccgtttctcatatttctttgtttcatggaatgacctctttatttttgtttcagttcgagataagttgcgggagatagtaggagcatccacaaactggaggtatgcatctttgttttcattcattcttttcatccccaaggtattatactacactgtatttaggctcagttgatggtctcacagtggggatggggagccctatgttcagagataggttgagaagtattttgcttgggggagaaggtcaacatttcaacatactcatcagatgacacctcattgtcatgaaagaagatgatttacgtatattctgcattttcaaagtgcatttaggtgtatattacttcactgattctcataacaaaacttgtgacgtgcttacgacatatgttcctgttcctttttttacacatgaaactgaaactcagagattgaatgattaaatgtcagggtttgggacttgaacccaagtcgctaagtttctctgtttcatgcaacttgactcctttattgcttcttgtcagttcaaaattagtcaggcctcccatattgtctttctctttctcgcagtatttccttgttgtaaagtaggatcatatccctcttggtgtacataattttgaggctaaaatgagatagaaaaaacacgagtgatcactagatatataataatctattgttggtatagaaattatctaatgacttatttttaaattctttatatgaaaaatttcactttactaaaaggtagaaagaatgaatacctgtgtacccaccacctggattccatacttattaatattttgccaaattttccaatatacacatattgcctgaaccatttctaagtaaattatagacaccatgacacttcagcgtgcatcttcagtaaacattttataaaaccagccttcgcttatctccaacaaataagacattctctcatgtaatcaaattgacagcaattccttgctagtatattactcatccatagtcacatttcctcaactgttaccattttgtgtaatagattactccttttaacaaaaatgtttttatagctgtttaaaaaacatcaagatccaataaaggattgcatgttgcatctggtggttatgactctttagtcttccctaatctagagtaatggacagtcgtccttcccctattcttcccccatgagcttgactttaaggaggccaagccatttgtcttgagaatgttccacattctggatttactggtgtcatttaactcattcctctatctcctgtagtttttgtagggtaaacatttctggaaataatactttataagttaagcttagaaagacatcttagctaatgttcttatcaacattgtcgttccgtatccccttgtctttcttttctctttcaccttaatcttctcttctttttcttccctttctgtctccttttcatgttatgttcttctttaccttttgttctgccttccatacttcctttggatatagtccattttccctcctctgtctctctttcctgaaattgaaggcagagagagagagagaactggggctcaaagaatccgagaactgtcaggtgagaaatgggaatataaagtagagtggccaagccattctttagcatatatatttatatgtatatatatatactattttgtccatctctctaaatttttaatttaatttcaaatattctggtctttgagtaaactttttgataagggtgaatatatggctcatttgggtatatctatatcagttttaagttttcttttttttttttttttttgagacagtcttgctctgttgcccaggctggagtgcagtggtgtgatcttggctcattgcaacctccgcctcccacgttcaagcaattctcctgcctcagcctaccaagtagctgggattacaggtgcccaccaccacacctggctaattttttgtatttttagtagagacggagttttgccatgttggccaggctggtcttgaacccctgacctcgtgtgatccacccgccttggcctcccaaaatgctgggattacaggcgtgagacactgcacctggccttaagaatgtttttaagcttgagaaatgataccggaaatgatcaatttcaccaagtggcaggtgggaagggagggaaggaagagaaggtgaaagtaggcccagaccttctttttcctcctttgatggtatcttactggcctgtgtaccactggaattgtgggctagaactgctcttgttttatgaatcctgcatcctttcttctcagagaccatgtgaaggcaatggaagaaaggaaattacttcatagtttcttggctaaatcacaggatggactgcctcctaggagaatgaaggacagttatattgaagttctcttgcctttgggcagtgagcctgaattacgagagaaatatttgactgttcaaaacaccgtaaggtaacacagtgctatttttatgtatttgtttttatttccttgttttataacaattttgaaatataattcacacaccatacaattcgcctgtttaaagtgtacagttccatggttttgatatatttagagagttgtgcatccatcaccacagtcaattttagaacattttcatcaccctgaagtgtgttatttatttttaaagggagaccaacatgatttgcatttaattcactgtttgctttatttcacagatttggcaggattcttgaggatcttgacagcttgggaggtactggtattattttagtctttctaatagatacctacagatatacattgaattctgtgactggaaagggctcttttattctttaacctgcacagatgatgatattctaaagtgcacaaaaaaagaaggacatcggccgggcgtggtggctcatgcctgtaatcccagcactttgggaggctgaggcgggcggatcacttgaggttgggagtttgagaccagcctgaccaacatggagaaaccccgtctctactaaaaatacaaaattagccagttgtgttggtgggcgccgtaatcccagctacttgggaggctgaggcaagagaatcacttgaacctgggaggcagaggttgcggtgagctgagatcgtgccattgcactacagcctgggtaacaagagtgaaactccatctccaaaaaaaaaaaaaaaaaatggcatctactacttctgaattgtcataatttttttcttataaatgtagattcctatttaatggaggtatagtctgaataatctttcttactagtaactttaaaaaaagaaagtcttaaacttacagaaaagttgcaaatacagtataaagaatttttctgtggccaggcgcggtggctcacgcctataatcccagcactttgggaggctgaggcaggcagatcacaaggtcaggagatcgagaccatcctggctaacatggtgaaaccccatctctactaaaaatacaaaaaattagccaggcgtggtggcatacgcctgtagtcccagctattcaggaggctgaggcaggagaatcacttgaacctgggaggtggaggttgcattgagccgagatcgcgccactgcactccagcctgggcgacagagtgagactccgtctcaaaaataaaaaagaaaaaaattttttgtccctgaattatgtgagaataagtggctgacatgatgccacatcacccccaaatatttgaatatgtctttcctacaaacaaggacattcttctacataactacaaaacaaccataaaaaatcaggaaattaacactgatgtgtcatactgtctaatcctcaggtcccattcaacttttgccagtggtccttcatagcagaaggatccagttctgaatcatatgttgatttaattgtcatgtcaggactagttccttaatctttctttgactttcgtgactttgacatggttcttttgtgtattgtccctcaatttgggtctgtgtggtgcttcctcatgattagctttgggttatgcatctctggcaggaatgtcacagaagggatgctctgttcttattgtatcctatcaagtggtgcatggttttgatttgtctcattactgatgatatcagctttgcttactggatgacgatgatgtctgccactgttcttcactgtaaagttactcttttcccctttgtaattaataagtaccttatgtgggggggggtggcaggtaactttgagaccttcatcagactttcaattcattatttttaaatcagtatggactcaggaattcctatgttactgaatggactataatatgttactatcatctatttgatgttcacatgatcccaggagtgtcccagtcccttcaggctagcttctgtgtggttttctttgatgtgtccccattattctttgagcactttctcactttctggcacaataaaatattctaggctcatcttatgcttttccctgccccagtcctagaatcacccacatctccaaggagcccttttttgaaatggagaatgatattttgaagtggaggatgatattttgaaatggagatatgtgcgttgggagtggtcattattcctgggtatcactgctcccataccctcttagtggaggagctgggaaatatatgtgcatatacgtacatatatgttatttctaaatctttgtacagatgtatgtatgaaaaccatgggatcgcactgatagctccaattccagttcagccaccacggggttcattctcatttccttcctttccatatttgtaattcccttctccaactggctccattctccttaatatattgacttatttaatcagttccgctgtatgtgaccaatttcctatggctgccacccctcatgcatcatggatgctcccctcaccttacctgggctctggtaccccacaccaggtccccctctgcaggctcaccctcttcattgtgctcaagctgtgacatgctctgccatcactcttgcagcctctctgcaaggatgtcctcctcaccgtgcttggatgccagcaccctactctaggttaccttacttgctcccacctaatgatatttgggctgaatggttgggaaagggtctgaaaaagggttctaatatattgtttaaaaaactatttttttatagagatggggtctccctgtgttgcccaggtttttcgtgaactcctgggctcaaaggatcttcctgcctcagcctcctaaagttctgattacaggtgtgagccgccgtgcctggcctttttttttttttttgagacagagtctcactcttgttgcccggcctggagtagagtggtccgatcttggctcattgcatcttctgcctctgggttcaggcgattctcctgcctcagcctcctgaacagctgggattacaggcacccgccatcacatctggctaatttttgtatttttagtagagacggggtttcaccatgttggccagtctggtctcaaactcctgacctcaggtgatctgcctgcctcggcctcccaaagtgctgggattacaggtgtgagccaccatgccaggccctaacttttaaaatatagatacaagcttgttgttaagcttacgcctagcaactacttttctctagattaaataaacccagttaaaaattcttggctgggcacagtggctcacacctgtaatccttgcactttgggagatcgaggcaggaggatcgcttgaggccaagactttgagaccagcctgggaaacatagtgagtccccatctctacaaaacccaaaaaattagctgggcatggtggcatgcactagtagttccagctactcagaagactgaggtgggaggattgcttcagcccaggaagtcgaggctgcagtgagctgtggtgacaccactgcactacagcctgattgactttggtttgcttaggtgtccttatatatacaaactcccctgccactaccctctttcttgctcattaacttctgttgatggccagtccctttaacctgttcacttgattctattccttctatttcttcaaggaactgccttatcacttggctttctccctcatttcctgagccttttctcaacttcacttttccctcaagttataaacatattcaaggttcttccatcttaaaatgaaaaataggccgggcagggtggcttacgcctgtaatcccagtagtttgggaggccgaggcgggtggatcacttgaggccaggagttcgagaccagcctgggcaatatggtgaaaccccgtctctactaaaactacaaaaagtagccgggcgtggtggtgcgtgcctgtaatcccagctactcgggaggctgaggcacgagaatcgcttgagcctgggaggcagaggttgcagtgagctgagatagactccagcctggacaacagagcgagactctgtctcaaaaacacaaaaattagccgggtgtagtggcatgtgcctgtagtcccaactactcaggaggttgaggcaggagaatggcttgaacccgggaggtggaggctgcagtgagctgagatcgcaccactgcattccagcctgggtgacagagtgaggctctgagtcaaaaaaaaaaaaaaagataagtaaaaaatcctctttccttataacacctcacactttcttccttacttcatagctcactttctgaaaagaacctagaaaatcacctgctctcattgcctctttatgctaacttcctgttaattaaacatttcccggtcggctgtgttccggcttctgctcctccacgccattgaatctgctcttgccaagctcgccattggcccctttactgcacagttgaatggatacttttcagggctgacctgacccctttgtggcttcttatatcgtccagcccatccttgggctttggtgacatttccttctgcttctctggctgctcttttgtagtcccctttgtaggttcctctttttctgttgatcccttaaatgtaggttatccccagggttttgtcttctgccctttcaaaaactgattattttttgaatttattttattttattttgtttatttattttttttgagctgtagtttcgctcttgttgcccaggctggagtgcaatggcgctatctcagctcactgcatcctccatctcccgggttcaagggattctcctgcctcagcctcccatgtagctgggataacaggcacacaccaccacgcccggctaattttttgtatctttagtagagacggggtttcaccatgttggccgggctggtctcgaacttctgacctcaggtgatccactcgcctcggcctcccaaagtgctgggattacagacgtgagccactgcgcccggccttttgaattttataatttgttcatattaattaaattttaaggcattttaaaatttaacaataaaattgttaaatcttttaaaattatttatttagtttttgagacagggtctcactctgtcacccaggctggagtgcagtggcgtgatcacagctcactgtagccttgacctcctggctcaagcagtcctcctgccttagcctcctgagtagctgggactacgggtgcacaccaccatgcccagctaatttttttgatttttagtagagacaaggtctgccatgttgcccaggctggtcccaaactgctggactcaagggatccccccacctcggcctcccaaagtgttgggattacaggtgtgagccactgcgcccagccctattttttcagttgaggttaaaatataaaatttaccatctttatctttttttttttttttttttgagacagagtctcactctgtcacctagactggagtgcagtggcaccatctcggctcactgtaacctctgcctctcgagttcgagcagttctcctgcctcagctttcgacgtagctgggattacaggcatctaccacaacgcccagctaatttttgtatctttagtagagatggggttttgccatgttggtcaggctggtctcaaactcgtgacttcaggtgatccccccacctcggcctcccaaagtgctgggattacaggtgtgagccaccgcgcctggctcatctttatcatttttaagtgtactgatcagtggtaaaaactacatttatattacattttcctccgtctcttctctacccttcccttctgcccttttttgggttgacgttgcagattctctataaactcatctactcccagtgtttcagttgctatcagtatgctgaatacttacaaagctacattttctggcctgcttttctgagtttcaatcaatttttcctcttagctactagatttatttttcttttttagagacagtctcactctgttgcccgggctgtagtgcagtggtaaaatcatagcctactgcaaccttaaacttgcgggctcaagtgttccttctgcctcagcctcctgagtagctgggactataggcacactgcaccatgcctggctaatttgttttgtttttttggaatagggtcttgctctgtcacccagggtggagtccagtggtgcgatcaccactcactgtatcctcgacatctcgggctcaagcatcctcccatcttagcctctcaagtagctgggaccacaggcacacgccaccatgcctggctaatttttgtattttactgtagagacgggatctcaccatgttgcctgggctggtctggaactcctgggctcaagtgatccatctgcctctgtcttccaaagtgctgggattacaggcttgatccaccatgcctggcctaatttttaaagttttttgtagagacaggggtctcactctgttgcccaggctagtctcaagctctgggctcacgtgatcctcctgctatggccttgcaaagccctaggattacaggtgtgaacaactgtgccctccccaataccttcatttggatgtgccataggctcttcaaattcaacgcattgaaaatggcccattcttttcttcctatattctctttttattttgagacagagtcttactctgttgttcaggctggagtgtagcggcatgatcatggctaactacagtcttgacctcctgggttcaagcaatcctcctacctatctcccgagtagctgggactacaggcatgtgccaccacacctggctaacttttgtgtttttggtagagatggagtctctgctgtgttgcctgggctggtcttgaactcctaggctcaagtgatcttcctgccttcgcctctaaaagtgttgggattacaggcatgagccactgtgcccagtctctcttctctttttcagtgactagtacaccacgcttacctatgcaagctagaaaactgaatttattcaagtcttctcaggtttaccttcttcttaactcatagtcttttcatttctactcctgttgccataggttggagccatctgatttctttgctggacaaagacttttaaatggagtttattgcctttagcctatcattcccccagtgtgtcctttagcaggtgcatagatggaaggatttacacttactcaacaagtatttattgagccacatatcttgtctgagagtttgtgatacaaatttgaatggatcatgggggaagcagggagccaatcaacatataatcatacaacttttttttttttttttttttttttgagacagtcttgctctgttgccaggctggagtgcagtggtacgatctcggctcactgcaacctctgcctcctgggttcaattgattctcctgcctcagcctcctgagtaactgggacgccaccacgcccggctaatttttgtatttttagtagacatggggtttcaccatgtcagccaggatggtctcgatctctcgacctcgtgatccgcctgccttggcctcccaaagtgctgggattacaggctgagccgccgcgcccggcccaacgtataattatacgactttaaatgagttgatatctgtaaggtgcatgaaccatgcatggcacatataaatgcttgttaaaatatggaaagtatacagataaccacagggtggtataggagtcaagggtgttatggggaaggagggataactgagtgaaataattgtttcatgattaattaggacaaagccaggaggaaaacaggtagccaagtccttgtgctttgtttctctttcctgaagatgtttgatactgtcagactcatgtgctgagttcttactctgatttgggcactgagtctctgtggagtggtaacaagctgtctggtgggtctgggcttgcttcgggctttgatttcttcaccaaatcttaaaattgagggggcagtcagattggaggatctcccaaatccttcaatttataaaagtgtttgatcctaggataagatgatcaatggaatattaggggctggatcttccaagcgagacaaggcttttcatggatctcagggaggaaattttaaatgttgggaaataattctgcctttttaaaatttggtacactcctgtttccctgcagttcttatttgttacatgcacaacaaaatccactccgccaagatgtctcctttatcgatagttacagccctggtggataagattggtaagtgatatcattttctatgcatacttagaattcttagtaatttcaagatattattgagattacaggacgtactctccttttatgggaattttttttttttttgagacggagttttgctcttgtcacccaggccggagtgtaatggcacgatcttggctcactgcaaccttcgcctcccaggttcaagcaattctcctgcctcagcctcccgagtagctgagattacaggcatgtgccaccacgcccggctaatttttgtatttttagtagagatgggattacaccatgtcggccaggctggtctcaaactcctgacctcaggtgatccacctgcctcggcctcccaaagtgctgggattacaggcatgagccaccgtgcctagccctttatggggaattttaatgtatatatgcatatgaaaatgtctagaatgctgtataccaagatatttattataattaggtgggttttgcatgattccagttttattttttatattctttgctttttctacatttttcaaaaacacatgtagatttcttctgcgtgtcaaaaaagttattttagttttgaagacaaaaaagaaatgtagtggaatttgccataatttctaattgttcatatttacagaacagaaaatttttggtatgacttggaccctgattgacttctgttttgcagatatgtgtaagaagagcttgagcccagaacaggacattaagttcagtggccatgttagctgggtcgggaagacatccatggaagtgaagatgcaaatgttccaggtaaatatgcgcctgaagattgtccactgtttaagtaaaaccagctagtctccatgcaagaaaagcttatttacctatgtatctgtagacaggtatgttgctcactgcttctagaaaaacagttgaaagctcatgtcatatggatggtgggttattaatatcctccttgtggacaaagcctgacgtactatttggtgtttatatttaatatttatttctaatcatatacaagtccatgttaaggtgtttgtttctggttctgcctaggagaatttcacagaagtctgtgttatggtaggagtgaatggaattgattactgtattcatttcccaggactgctgtacagttggccctctgtgtctgtagatttcacatccacagattcaaccaaccatggattgaaaatgtttggaaaaaaacagtgaaaaataatataaataaaacacaatacagtataacaaccatttttttaaaaaaatagagatggggctgggtgcagtggctcacgcctgtaatcccaccacgttgggaggctgaggtgggcagatcacttgaggccaggagtttgagaccagcctggccaatatggtgaaaccctgtctctatttaaaaaatacaaaaattagccaggcttggtggtgcacgcctgtaatctcagctacttaggaggctgagggttgggaaccgcttgaacccaggaggtggaggttgcagtgagctgagattgcgccactgcactccagcctgggcaacagagtgagactcgtctcaaaaaataaataaataaataaataaaaatagagaaatggatatggagtttcaccatgttgcccaggctggtcttgaacttctggcctcatgtggtcctcccaccttagcctccccaaatgctgggattacaggcatggctggccttaaaacaactatttatatggcatttatattgtattaggtattataagtaatccagagataatttaaagtacacaggaggaggtgcataggttttatgtaaatatgaccccattttatataggggagttgagcatctgtggattttggtattggcgggtggtggtagggagttctggaaccaatcctgcgtggattccaaggggcagcggtaccacaaagtaccataaactggtggcataaaaacagaaaatgtattgactcacagtttggaggctacgaatccaaaatcaaggtgtcagcagaggcatgttccctctaaaacctgtaagagagaagccttccttgtctgtttcttgcttctggtggtttgctggcaatccctagcgttccttggcttccagctgtagcacttcattcagtctctgcctccgtcatcacatggtgttctctcatgtgtctctgtctctctggtgtctcttgtcaggatgctgctaatcatactggattaagggcccacgctactccggcatgacctcatcttaactaattatgtctgcaacgactctatttccaaatacagtcacgttcacagttatgggggttaggatttccacatgtctttttgggggacacagttgggcccttaacagtcatttgagctattacagtagttaggaacagctaatctgatgagtaaaactcagaatagctattacaaacaattgaagaaatttgacaagaaaaagtacctcaaagaggataacaacacagaaataaaatgattcagtgtatgtccaagatttcattgtggaaaacttatttaagaatgactggctgggcgcggtggctcacgcctgtaatcccagcactttgggaggccaaggcgggcagatcaccaggtcaggagatcgagaccatcctggctaacacggtgaaaccctgtctctactaaaaataaaaaaattagccgggcgtggtggcgggtgcctgtaatcccagctatgggaggctgaggcaggagaatggcgtgaacccaggaggcggagcttgcagtgagccgagatcacaccactgctctccagcctgggcgacagagcgagactccgtctcaaaaaaaaaaaaatgacttattcatttatgccagggtattgagtagaccaggggtccccaacccccgggccatgggctacatagcaggaggtgagctgtgggcaagagagaattaccacctgagctccgcctcctgtcagatcagcagcggcattagattctcataggagcacgaaccctatcgtgagctgcgcatgtgagggatctaggttgcacactccttaggagaatctagtgcccgatgatctgaggcggagcagtttcatcccaaaaccatcccccccagcccaccccattccgtggaaaaattgtataccacaaaactggtccctggtgcaaaaaaggttgggggccactgcagtagacctattattcagatgcattttttcctgctatggaatgatgaagcatttcaccttttggtgaaataaactttcacactttcagaaaaagcctgaagctagctctgtagtagttatttgtcaaaataagtattttttttattcagtactatatgcaagtgattgaatctttcaattcccatgtttgatgtaactgacagtaatactgttttattttgtttgtttgagacagtgtcactctgtctcccaggctggagtgtagtggcgcgatctcagctttctgctacctctgcccctcgggttccagtgattctcatgcctcagcctcccaagtagctgggactacagatgtgtgtcaccatgcctggctaatttttgtatttttagtagagacggggttttaccatgttgcccaggctggtcttgaactcttggactcaagccatccacccgccctcgcctcccaaagtgctgggatttcaggcgtgagccaccgtgcccagccagtaatactgttttaaaaacaaaacattgctgggttgctgctatgatctgcctacagtctttttttttttttttttttttttgagacggagtcttgctctgtcacccaggctggagtgcagtggtgcgatctcggctcactgcaagctccgtctcctgggttcatgccattctcctgcctcagcctcccaagtagctgggactacaggtgcctaccaccatgcccggctaatttttttgtatttttagtgcagacggggtttcaccgtgttagccaggatgatctcgatctcctgacctcatgatccgcctgcctcggcctcccaaagtgctgggattacaggcgtgagccaccgtgcccggcctgttctgcctacagtcttttaaaaaatattcttggttaattcctagtctgctcagtgccatgcacagcagattcctggcacaggacctgccttttagggcatcttgacaatttgcctcttggacaaataggttgaaaaagagatacaggaattattgagagagaaccagtggaactcagtgtcagacaagtaaacacttttgttttaaatttgcattcttcactggctatttgactaataactcatgactcgagtgatcctttttattccagagaagtggtgtggggataagcactctgcctctggtttgcatagatttaggttctaatcccagcactgctgcttcctagtcatgtggctgtggataaaccacttgtctgagcctctgtgttctcaaatgtaacatgaaaatagtaacagagtaccatgttatatggttgtggtaagggaaatttgaaaaaaacccattcatgtgaagtactttggtacagtgcctatcacacagtaaccactgttggaaatttttttttttttttgagacagggtcttgttctgtcacccaggctggagtgcagtggcatgatctcggctcactgcagcctctgcctcctgggttcaagcaattctcctgtctcagcctccctagtagctgagattacaagtgcacaccaccatgcgtggctagtttttgtattttttatacagaccgggtttcaccatcttggccaggctggtctcgaactcctgacctcaagtgatccgcctgcctcggcctcccaaagtgctggaattataggcgtgggccgccgcccccagcctggcaataatattaatttattataaatactgttgaggtggcctcaaatttctattttgggcttgaccttcatacccactttcctgagtgctccttatatttctccacctagacgtgctgttgctacctcaagttccaataaacagtatgttccaaactgattggccccaattctcatcctcctccagtcttccctttgccagcctcctgcttcctttcccatgcagccttttgccaggtcttgcaaattcatcacccacagcaactcaccagaattctttctccccatatccttttggccctgtgttttattcaagtcctcactgcctcttgtgtgagtgccttaaccgtcttttaattaacctgactttctctagccggacctctctcttttaattttatgcatttttaccacataagtcttccaaagctgatcttgaatcaggtcacttcccttctcagaaaccttcagtgaccattcattatctctggattaaagtctaaactcctttgactagcccaggtgcagtggctcacggctccaatctcaggactttgggaggccgaggcaggtggatctcctgagctcaggagttcaagaccagcctgagcaacatggtgaaaccccgtctctacaaaaagtacaaaaaactggctgggcgtggtggccatgtctgtaatcccaacactttgggaggccgaggcaggcgaatcatgagttcaggagtttgagaccagcctggccaatatggtgaaatatcccatctctactaaaaatacaaaaattagctgggggtggtgccacgtgcccgtagtcccagctactgcggaggctgaggcagaagaatcgcttgaacctgggagatggagttttcagtgagccgagatagcgccactgcaccccagcctcggcgacagagtgagactcggtctcaaaaaaaaaagtacaaaaaattagctggtgtggtggcgtgcgcctgtgatcccagccactcgggaggctgaggtgggaggatcgcttgaggcaggggggtggaggttacagtgagccgagattgcgccactgtactccaacctgggtgacagagtgagaccccatctcaaacaaaaaacaaaactcctttgattaattagggcccaaggggcttcataaactagccccagcctacctttccaactatattccctttgacttgtcatttatataccttcttaatgctcaccactggccttcaagcatcgtaagaatagggagttattcatgtttgcgttctagtgcttggcactagtgggtattcatgatagtaaaccataacttacataggttgagcattgcaactctgaaatctgaaatgctccaaaatctgactttgagcactgacatgatgcccaaaggaaatgctcattgggtttggaatgttcaacctgtaagtattgaatgcaaacattccaaatccaaaaatcgaaaatccaaaatagtctggaatacagaacacttctggtcccaagcattttggataagggatattcaactgggagtgagtgaatgagtataattgctgatgctttttcttttgcctgaaattctcgtgctctggctctgtatccacattctttctccctgtgctccaggataacttcatgctcaatcctttccttattctcccagcatgtaacacctgttcctcaggcctcctccctcaataccgtctctttgacttgctctcctggcacctgctagtctcctacagagctgtgcatgaatatgtcttttctcttccactgcggactctactcctcaacgataggacctgggtttgagtcacctagctcacttcctgacatccattcatttaacattcatttagcaatcatttattgagtgcctgtcctgtgccaggcatacagcagtgagcaaaacagataaagttccattctcttggagttgacattctagtagtgcctagaacctgcctccttcattcattggcaaatattgatcaggtatctgctatttgctggtctttgtgctaaatactagggatataactgggggaaaatggtctttgtcctacaggagctcacggtgcagtagggagacagtcacataaacaaatggttatgatatagtatatcgttatgcagtatttttcaacagggacactgttggcatttctggtgggagcattcattgttctgcaggtctatcccctgcattgtgagggatttagctccttggttacccccctccatagtaatgccccccaagttatgtgacaacaaaaaccactctgtatttttcaaatgcccgcctattagagtgacatctacttctcttacattgagaaccactgtcaagagaggactgtttctattaagggggctgaatgaaggaggcaaagataaacttggtctggggaatagggatgggggaggggaggaatgtcgtgaagaatgaggctgctgaggaaggcatcaggtaaagatatagacaggaggcagtcaacagcctgttctatcccaggacctctcagttgttagttagctatggctagagaaaaaggtgcaggtatgagcacagtatttggtgaacaactggggagcaatcgtgggctctgttgtggagggctttatatgccacgctaacaggattagcccaggtgctggtggaagaaaggaggaactattgaaaggtttgaatagggcagaggcataatgagattggtgagactgttcctgcaattgagggggagggcagtagtgatgaggcttgtatcatttattgaggagggaacccaatatactctcaggttataaataacttctgtcattactttatggtatgactttcctggaagtacagacttctaggggataaagaaacatcttaaggcccaggcatggtggctcatgcctgtaatcccagcattttgggaggctgaggctggtagattccttgagctcaggaggtcaagaccagcctgggtaacatggaaaaccccatctctacaaaaattagctgggtgtggtggtgcatgcctatggtgtcagctagtcaggaggctgaggtgggaggattgcttgagcccatgaggtcgagactgcagtgagacatgatcatgccactgtactccaacctgggtgatagagtgagaccctcttcctggggagagaaaaaaagaaacatcttaaaacctcagaggcctatgcattgtaaatacaggttgagtattccttacctgaaatgcctgggaccagaagtgtttctgatttcagaatatttatatttactggttgagcattcctaatcccagagttcaaaatcttgaaatgctccaatgagcatttccttgagtgtcatgtcagtgcttgaaaagttttggattttggagtattttttatttttggattagagatgctcaacctgtatttaacttaacccacataatcatctttgattttacctcttcttgggagctcctgtgcccagctatgaaggcataaactgtgctagtggttggcacactacagttccctgaaacatactagtgtttgtgagcatgatgggaggtccgtctgggtaggtgtgccatcaggaggacaggcacgccctgcaagaagctcagattctgaggaaagcaggcaaattaaacgctgatgatactctctgtgacccttgcctttgggtcccagtcttgcacagttccaaactccatgccagcagcccatctcatgcagtatactatttgcgttttgtttgttttgttttggagatgggatgttttctgtcatccaggctacagtgcagggtcgtgatcatagctcagtgcatccttgaactcctgggctcaagggatcctcctgcctcagcttcccactagctggtactacaggcatgcaccaccatgcctggctaattttttaatttttatttgtagttagagaccaggtctcgctatgttgcctaggctgatctcgctttcctggtctcaggcaatcctctcatctaggcctctcaaaatgctgggattataggcatgaggtaccatgcccagcccccgattggactttgaggtatttttctcctctgctaggccacgggctcctttgtcatcctgccattctgagagcctagtgctgtgcctggctcagggtaggcccttagcagacggtggttaatgagagtgcttctcttctttttccagttgcaggctttctctctctctctctctcttttttttttttctttttttttttttagacaggggcctgcaatctcggctcactgcaaccttggcctcctgggttcaagcaattctcatgcctcagtctactgagtagctgaggttagaggcatgcgccaccacaccctgctaatttttgtattatttagtagagacagggttttgccatattggccaggctggtctcaaactcctggcctcaagtgatcctcccaccttggcctctcaaagtgctgggattataggcgtgagcgactgcacctggccagcatacataccgtctgttagaatcgtggtaggtcttcccgataaatccatttctcatatgtacattttctttcctttgttcttcagttacatggtgatgaattttgtcctgttttggatgcaacatttgtaatggtggctcgtgattctgaaaataaagggtaattgctattttttcataattctttattttgaagaatttcaaagatacataagactggagagaaaactataatgaatgtccatatacctatcacttggacgtaacagttttaattgcaatttcttggccatttttattttaaggcaaatcccagacatgacatttcactcttaaatacttcgggcatcttttaaaaaatgagaatattctcaggccgggagaggtggctcacgcctgtaatcccagcactttgggaggccaaggctggtggatcacttaaggtcaggagttgaagaccagcctggccggcatggtgaaaccccatctctactaaaaacacaaaaattagctgggcgtggtggcacgcgcctatggtcccagctactggggaggctgaggcacgagaattacttgactctgggaggtggaagttgcagtgtgccgagattgcgccattgcactccagcctgggcgacagagcgagactccatctcaaaacaacaacaacaaaaagagatgttgcacaattctgtgaatacactaaaagccgttaaattgtacactttcaatgggtgaattgtgtggtatgcgaattataccttaataaagctgttatcaaaaaaaaacagacttacagacataaaaatcaaatgtaattttttgttaggcatgacaatagtaatgtagttacttaagagaatattatcctttttttttttttttttttaagatggagttttgctcttgttgcccaggctggagtgcaatggtgggatctcggttcactgcaacctccgcctcctgggtttgagcgattctcctgcctcagcctcctgagtaactgggattacaggcatgtgccaccatgcctggctaatttttgtatttttagtagagatgggggggtgtttcactatgttgcccaggctggtctcgaactcctgacctcaagtgatccacccacctcagcctcccaaagtgttgagattacaggcgtgagccaccatgcccagctgagttgtgcaatctcttaaatctgttttaatccagaacagttgtgtcttcccctattgtttcttattcactcgttgagaggctggatcatttgttctaaatagtgtcccactttctggatttgttctattgctttctcatggtggtttgtttgtttgttttttgatcttgtttctctatccctagtaatttctctaaactgaagttagatctaaagccttgtattagatttaggttgagcatatttggtgagagtactacatagatgatgttgtatatctcgtatttcatattgcatcgtatcaggaggtacaggttgtcccactcacagtgatgctaagattagtgtgtgggttcaagcagttacagcctaatctctcctttgtgaagttcagtttttcctcttctgatcagcaacaatctacaggggtgtactttgtcatcctgcaaatagctgagtttcccatcagtctttttccagtgctttcaatgtccactgctgatcattgctttaattagtatcattaggcagtttagagtaattctcaaattttgtcattccttctatgtttgttagctggaattctgtaaagaagagcgttcccttaacaactagggcgattgggtttgaaatggagttaggatcaatgcttcattcttgtcttttatttacatgttttcagaataaggagttggttcactagctagtgatgacatgcttttcccagttttttagctttttagaaaagtatcatgtttttaaatttctttttttttttctgtgtgtgtgtgtttttgagatggagtctcgctcagtcacccacactggactgcagtggcgcaatctcggctcactgcagcctctgtctcctgggttgaagagattctcctgcctctgcctcccaagtagctgggactacaggcatgccccattatgcttggctaatttgttttgtatttatagtagagacggggtttcaccatgttggccaggctggcctcgatctcctgacctcaagtgatctgcccacctagggattccaaagtgctgagataacaggcgtgagtcatttcgcccagcccgttttttttttgtttttttattttttttgagatgaagttttgctcttctctccaggttggagtgcattgtcatgtgtcatgagcatggctcactgcagcctgggcctcctgtgctcaagcaatccttccgcctcagcctcctgagtagctgggaccacaggcacataccaccatgccgagctaattttttttctttctttctttttgagatggagttttactcttgttgccccggctggggtgcagtggcgcaatctcggctcactgcaacctccacctcctggttcaagtgattctctggcctcagcctcctgagtagctgcccagctaatttttaaattttttgtagagatggggttttgccatgttggccaaactgatctcaaaatcctgggctcaagtgatcctctcacctcggcctcccaaagtgctaggattacaggtgtgagccactgtcctgccagaaaagcatcattatgaattcatggttgtaatatattacatgtatttcaataaattgcagccattgtttctcttgatgctccaagtgtgccttctttgggcggtgggagttcctctaagctggctcctttccacctgtctgtttgatagcttcctgctgtctgacacaagatgtcttgggctcatcttacgtatttcctgccccaggcctggagtcagccatttctccaagtagtcctggggttccttttagtgggaactggtatttagacatcaaaatctgggcactagaactgtacattgttactagtttgttattgtttccaggcctttttagtggacagagctaggatatattttaaacaaacaaaaaacctcatgagagctgggtgtggtggctcacgcctgtaatcccagcactttgggaggccgaggtgggcagatcacttgagcccaggagtttgagaccagcctggccaacatggcgaatccccatctctactaaaagtacaaaaaaattagccaggtatggtagcatgtgtctgtagtcccagacgatgtgggaggctgaggtgggaggattgctttaacccgggaagcagaggttgcagtgagccaaggtcgcaccactgcacgccagcctgggcgacagggcaagaccctacctcaaaaaaagagcctcatgagtttatatggtcattttcaagtcatttaaccatatagacttcaacttactttacgtcatcttttttctctgaaattgaattcttggtttctaacaacagttacacccaaactgagaaaaactaattgtgggggtagagctggggtgggagggattgctctttgcacaggacagagtccagtggcctgtgggaaatctcatttgtattagaaacttgatttaggagtctgcagtgaaaaatctttgctgctgcgtggaaagctgacttggaaagccaaattaagatagaaaaatatgttggtcccttagtgatctgagggaagaataacacccatctactctggcccttcctgccagccccagctgacctgctgtggccagtgactggcctggggcttgtattcaagcactgaggccactgctgcaagtttcactcccagctgatgcatgtcactttcccaagctgttgtttcaattcttttgttttttgttttcaagacagaggttggctcttgtcacccaggctggagtgcagtggtgctatctcggctcactgcaacctctacctcctgggttcaagtgattctcctgcctcagcctcctgagtagctgggattacaggcacctaccaccacacccggctgacttttgtatttttagtagagacggggtttcaccatgttgaccaggctggtctcgaactcctgaccttaggtgatccacctgccttggcctcccgaagtgctgggattacgagcgtgaaccactgcccccggcctgttttaattcttttgtttccattgttgtttcatcaaatcttttgattctaccacagtgaaatattatcccttttcccttattttttatttcaaaaaatttgatgcttacagaaaagtagatagaataatgcaacaaacgtatgcctttcacgtaaattgtattacatttgcgtaattctcttaccctctctctacaaatacacacatttacatattttttcccatgaatcattggaaagtaagtttgagactgcttcacccattcaggagttcagcatgtatttcctaagaaccaggtatttctccataacctcaatgcctttattatatctgagaaattcaacagtgatacagttatttaatatgtgatccgtattcagatttcaccagttgtccctaaaatgtcctttatagctatcttcctgattcaggacccaatccatcaaggattgtatattgcatttggttatcctgtttctttagaatagtctctctgccatttgctgtctttcaaaaattgatatttttaaagagttcaagccagttttctttttcttttttttttttttttctttttttgagacagagtttcgctcttgttgcccaggctggagtgcactggcacgatctcggctcaccgcaacctccacctcctgggttcaagcaattctcctgcctcagcctcccgagtagctgggattacaggcatgtgccaccacgcccggctaattttgtatttttagtagaaacgaggtttctccttgttggtcaggctggtctcaaactcccaacttcaggtgatccccacccggcttggcctctcaaagtgctgggattacaggcgtgagccaccacgcccggcctaaagccagttttcttgtagagtgttctacaacctatatttgactgtttcctcatgattagaatcaggttaaacatttagcagatgccagtatcctttttataatgttaagtttctagtgtgcaattaaggctgtaactgtaaggcttccctaattgttccagcgttcacatgtaaggcaagcagtaagcactacccaaaatgaaaagcagattctttaaaagtagtaggtgattgttcatcttcaagttttattagataatggcatatcttaaattatattcttttttttcttctttttaggccggcatttgtaaatccactcatccctgaaagcccagaggaagaggagctctttagacaaggggaatgtacattaatttgtttataataaaataaatttgaaaagcacattaattacgctgcagaagagattatttaagattttatatgggctcttcataccagtcaaatgtcttttttttgtttgtttttttgtttgttttttttgaaatggagtctctctgtctcttgccaggctggagtgcagtggtgccatctcggctcactgcaacctctgcctcctgggttcaagtgattcttctgccccagcctcctgagtagctgggactacaggtgcgcgccaccacacccagctaatttttgtacttttagtagagatggggtttcaccattttggccaggatggtctcgatctcctgaactcgtgatccgcctgccttggcctcccaaagtgctgggattacaggcgtgagccattgtgcctggcccaaatgtcttattcataccaataatttattgaaattaaaaatatgctattcttttttctttggagtccatactttgaatgattttattgatcagacaatatttattaagtgaagtaatttgttatctccgttttttttttttagacagttcttgctctgttgcccaggctggagttgggcttgggtccaggagtttgaggctacaatgaacaatattgtagtctcgatctcctgggcccaagctatccacccacctcagcctcctgagtagctaggactataggcacgtgccaccatgcctggctaattaaaatttttctttgtagagacaggggtctcactatgttgcccaggctggtcttgaactcctggactcaagcaatcctcctgcctccgcctcccaaagtgttgggattacaggcatgagccactgcacctggcctgttttctccgttttaatgaagtgagaaatgcatctcaatgggataactgcaggtcagggctctggatcaggatgatatcaagtgatctcacactgaaccaatataatttccatgtggaaccaaagactcactgggagttttatgtggcctctgcagttttctcttggatacgtgtataattttcagtgagattttgaaaggcatcccaggtcagaataccgtgtgctgtagtgcgaccgtcctgatcattgctccttattctcccttgttccagtgaacaaggggagaagaattgccttcagctccacgtcgttactgaaaatggcccccagcgctgaggagaggaccaccatacatgagatgtttctcagcacactggatccaaagtaaggatggtgagattccacgttgggaaaacatttaaaccttggccttttttttttttttttttttttgagacggagtttcgctcttgttacccaggctggagtgcaatggcacgatcttggctcactgcaacctctgcctcccgggttcaagtgattctcctgcctcagcctccgagtagctgggattataggcatgcacctccacgcctggttaattttgtatttttagtagagacggggtttctccatgttggtcaggcttgtcttgaactcctgacctcaggtgatctgcctgtctccacctcccaaagtgctgggattacaggcgtgagccaccacacccgaccttttttgtttttgagatggagtcttaccctgttgcccaggctggaatgcagtggcgtgatcttggctcactacaacctctgcctcccgggttcaagcaattctcctgtctcagcctcccaagtagctgggattacaggcgcccgccaccacgcctgctaattattttgtatttttagtagagacggggtttcaccacgttggccaggctggtctcaagctcctgacctcatgtgatctgcctgcctcggcctcccaaagtgttgggattacaggcgtgagccaccgcgcctggcctaaaccttggccttctccagagccacagttgtctgagtgtattgggagtgacttgcaaatgtttttacttttcaacaagagaaccatggcattaacagggtttaataaatattcatttgtacaggactataagttttcggagtcgagttttaccctctaatgcagtgtggatggagaattcaaaactgaagagtttggaaatttgccaccctcaggtattataatttagtgagaaatccgaataggatagcttccgttcatgatatttgtccaagatttgacacacctttaaactggcctttgtcctgtggcattgttaattcctctgttctgtatacaaaggtggccataagttttgtatttattgatatttatttatgtcctgtaggagcggaacattttcaatcggatctttggtggtttccttatgaggaaggcatatgaacttgcgtgggctactgcttgtagctttgggtgagttacatgtaaggcagccttaacttctgagaagcaatttatatcaccccactgaaatgaaacatttcggaccagtctgggtgtgtgtgggaatatgttatgtttttgaatgaataccacactgataccagctgaatttgatcttcattttagaaggttgtttctctgactttgtaagttcatacattaaaaaaactactgagaaaatacagtgatgatatgtagaaaggaaaagatatagttattttggccctaatctgctcacgatggcgtctcttaccatttctcactggtaggatcttttcccccttctctaactttattcttcgttcatttttattttgcttcagctagttgttagaggaaacaattgagatcatctgaattttgcaatataccccaaattctgtcctttcccccaacagtggttctcgaccgtttgtggtagcagtagatgacatcatgtttcagaaacctgttgaggttggctcattgctctttctttcttcacaggtaggtgtgtgatgagagatgacatacaacttttttttttcatttgagcctagaagtttctatatcaaaaagccactgttttctcttatgactgcctttttccccttcctaatgcagttgactgattatagtgtctataatctgttaggtatgctttactcagaataattatattcaagtcagagtacacagtgaagtggcctccctgcaggagaagcagcatacaaccaccaatgtctttcatttcacgttcatgtcggaaaaagaagtgccattggttttcccaaaaacatatggaggtaagtagtgattattgcttgtccctaacaaagggaagaacttctaa

SEQ ID NO: 134 - DNA, 399 bp, mus musculus
cgcggtcccgcccccggacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggtaggtggcggggcgtggaaggggctggcagggcggtagcctggggtgccatcgtcttcccctagagcttcgggctggccccggcggaagaagtgggccacgcatgggcatttgggctctatgataaggggcgctcgcccactgtacctccgaccggacataagcccgccggcctttggttgggagaacctcgcccccactttggcgacttctagcactgagttt

SEQ ID NO: 135 - DNA, 651 bp, mus musculus
cgcccccggacaccgctgtccggctcccgggctgtcctcagcaagggcgcggtctggtactcgtgcgtcttttatcgcctcagtttccctccgccgactagcgcgcggggcccggttctccatcgcgcgcacggcagcctagcgcaatgaggcgggcagcactgcggtaggtggcggggcgtggaaggggctggcagggcggtagcctggggtgccatcgtcttcccctagagcttcgggctggccccggcggaagaagtgggccacgcatgggcatttgggctctatgataaggggcgctcgcccactgtacctccgaccggacataagcccgccggcctttggttgggagaacctcgcccccactttggcgacttctagcactgagtttgatattaaaagcaaagcagcacttttaagggaggaagttgggtgttccctaaaattcctttggccttgctcatccggggtgtggttggtagccgcgtcggggtagccccttgtcagaaagataatatttggagttctatgttacctctagcccttcatcttcctttggagaacatttttaggattaaatgcttgacctacttcggctcttacttaagtttgttgtaacattggcagagattacagggtaccttttggctc

SEQ ID NO: 136 - DNA, 152 bp, mus musculus
catcttgggatgacggcccggcacccagcacacaaacagcgacagtcccgagggttcagcccactctggcgacctcgacagtcggagaggaaggggcgggggtgcgagcaccttcggatctacgccgcccagggcgcaccggaaagctgccg

SEQ ID NO: 137 - DNA, 37099 bp, mus musculus
tgcagggtctcaggggcggggaaagaaatgcgactgtgcgcagctgcagtgggtgcgagcgcgacaatcatcgccccgcctccgccacgctatataggtcccagatctgatttggttttccaatgaggcggggcgttgagcaaccctctttgcctccagttgtcgtggcttcgtggggccaaccattttcggccaggctgagaaatttcttattgatgggtctgctcatttcctgcataggaagaaatcggtgacatttgggtggatacagttcccagccaatcgccccgagttccctcgcccactggggaaagaggcagagcttccgctagtctttcatcttcaaaggaaatcaagcttctaaaaagcgggccctgccgaattggctaatagctactccttttctccactaggggagcgttcgcaaggggtgtggggaggtggccagcgcttgccaatcagaggaggccagggctgtcccctagcgggcggtgaccaatcgccggggccggccagagcgcgcttccttagtaggtggatggtggtcggagcgccgactcccttctcgtcgtcgccattttgagctggtgactgtggccggctgggagtaggcggcagtgagtttccctgggagggcagcgcgcttggcgcttctcccctccccccgatctgcctccagtctcggacttggttgttgcgcgctccggctccggctgagctgggagagttggaggaggtggcggcgggcagaggtgatgtctgggagcccttccttgacagcccgggccgagaaggtgagcgtcgacgctggtcgtgggggcggaggtaaggggcccggggcggggacgtagaggaggcgcgagggcggacttcgggtcgggggagatgcgcggaacggaggggttggtgcaatgtctcaacccgggagggtttttttttttttggttttttttttttttttttttttttttggtgtgagcaaaggcgcgtgcgcgactgggacatgggatgggtgcatgcgggttgggggaagggagggacggatgggagtgggctactgtggatcactgtgtcggctacatcgaagtttatcagtggggaagcggttgtctgcgactttgagtttgtgcataggagaggggatgctgctctgtgttactctggtgtttatcggtccatggggaaatattctgtggttctggtctctattcctgggggatcggaggggggatgtgactctggtctttaccctttgagggggggcggtctgtgactctgatccttatccatggggcggggcttgggggacgactgtcttttgattgaccctaacccacttattgggtgggaaggggcatgcagggaatgtgtgtgtgactcattgccccttcttttggggagtttgtatctgtgacactgacgctcatccatggaaaggggacccactgtgtaattgtggtccttactgtgtgttccttctgtgatgtgggcccgtagttatttggggctcgtgtctgtgactggcccttggctgtggtggatgttactgtgtgactctggcccctttgccagagtctcttgaaggtttttgtgctctcagacgccagtgcctctgtgtgattctaactcttgcccacctgggagcaggtaactcgggttccctgtggcttgaggaggaagagaaaattggagtgtgtttgtctgtgtatgtgtgtgcacgagcatagagcaaaggtgtggcagcaacctagtgttgagcaggtgctattattgcctggctttacctgcttcttattcagagggtggggcctgaagatctgggattcatcctgacctctggctgggtcacagggttctcaggactccctgagttctcaccacagccctgagggttggatgaagtggctgctgctccatcccaatagaagagcacagtggttcagaacagcctccaaaagggccccttttgcctctggaaaccgggcttgagccctggggagggaaccaccttaggaccgggctgcacataagagacagggctcagggctgagccagttgctgtgtgagggccaaggctgtgttggccaggagcccagggaggtggcagctgtctcgtcgccaagttcgccccttcacacacccccccaagagcctttcatggtcttttgctgccttataggggacagccagcagcttgttgggaggatgagatggtcccttggggcctgtggaaggagcctggggcccccattgttgtgaagtcttgtctgatgtgctgaatctcaggcaagactttcagccctgagagtcccctacccccaccctgggatgcagccccaggcttgaatttgtctacctgtcttaggtggcaaagccctgatcacactgtgggtggccccgccaggtctctctgcaagatgccccctgtctgctgaagtccttgctgttttctagggcagtgggctctagccttatgtttgcggggaaagggaggagcaggccaagtaggggctaccttcatactgtgatgcacaggagtgctgggagctggaagacaatgtccctgggctaaggggcagcggagagccttgacaataagagtttctcaaggaggccctctcagtcccaacagttttgacccctttcttccctccactctccccagagtccctgcaggaagcatcacccaggctggcagatcatggtagcagcagcgggggtggctgggaagtgaaacggagccagcggctgaggaggggccccagcagcccccgaaggccctatcaggacatggagtatgaaagacggtgagttatctgttctcagcttcccagacagcctaggcttgcgtctatgtgagaattgatccaagaaggtgctaggatggggcttctgggtagaggaaacagcatagcagatgatgggtttcttttcagcagacaggtgtttggcacctgttgtgagccaggacctgtgctaggctctgatagtgcagtgatgaatgagacatgagattgcatccttctcagtactcagggtgtcacagggacgctatgcagttaacgggtgggaggttgaggttggggctatagcctggggtatgagggatgggtgggaatggcaccatcagagtcaggatttgcccgggaccactaggggacaagccaggtcagatagtggaagactccagggacagtatgggctacagttggcatgatacttgctgggaatggatactctcagacagttatttcttcagctctgctatgaacaaggaatagctggaacactgggtaaaatacagaaatcctgagtaaaattcagtgatccctcgccatccaggtgattccgaggcaggtgacccagccatgacacttgaagattgcctagaaaagcagacctaactctctcagaaagcctctattaagactcaagagtcaatagctttataaaaagagaaaataatttttaaaatgttttacgaagtgtttcttctaccaccactccttttaaaaatgtagaattgtaatattttgttttctgaaaagtgagcccaaatttgagataaggtcatcacctagtgttattcagtcttggctttcattagaaatgttttttgaaagacatttgattttggacggtattcactagaagtgctctgtggccatttctgaatttgagtagctgacatacatactttgttcaaactttattaccaagtaaaaccattgacttttaaaagccctcaagtgcagaggtttgagttcatcatactttccagttcaaggtaggtttctgtcataggtcagcaaaaggcttcctcttgtcatgtttattttttcatttttattcccaattcccacctctgtgggcagctgctctgtcgtgtttgatatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatccttctatgatacatatcatagaaaatgtatcatagatttatcatatagatcattttcatataaatgtatcatatagatacatgtatcatataaatacatacataaatgtatcatatagatacattttcatagaaaatgaaaatatgaagtgttgttttgagtgactgtgttttcagttgacacacatggcatggtgccacagtcttcgttttgtttcctgaactttgtattactcagagtgggaggttttttttgttttttgttttttgttttgagacagggtgtctctatgttgcccaggctggtctcaaactcctgggctcaggcaattctcctcccttggcctcccaaagtgctgggattaaaggcatgagccgctgtaactggccaacagtgctgtttttttttgtttgtttgttttgttttgttttgtttctttgttttgagaaagagtttcactcttgttgcccaggctggagtgcaatggcgcagtcttggctgaccacaacctctgcctcccggtttcaagcgattctcctgccttagcctcccacatagctgggatttcaggcatgtgccaccacgcctggctaattttgtatttttagtagagatggggtttctccatgctggtcaggctggtctcgaactctcgacttcaggtgatcctcccatcttggcctcccaaagtgctgggattatgggcatgagccaccacacccggcacagtgctgtatttttaacatctgtctgtattgccatgtatatgttactactttgtttctaattgctggcaagggcatcatggggcatgtctactgagttttacttaatacttcccccaagagtagatgcctgttgttaattttgatgtgctagcatcattttttttttttttttttttgagacggagtttcgctcttgttgcccaggctggagtacaatggcgcgatctcggctcaccacaacctccacctcccaggttcaagcaattctcctgcctcagcctcccaagtagctgggattacaggcatgcgccaccacgcccagctaattttttgtatttttagtagagatggggtttctccatgttggtcaggctggtctcgaactcctgacctcaggtgatccgcctgcctcggcctcccaaagtgttgggattacaggcgtgagccaccgtgcccagcccaacgtcaccttttttgctttatctgttaatgtatagtgttttttgtttgtttgtttgtttgttttgagatgagtctcgctctgtcacccatgctggagtgcagtggcacgatctcggctcactgcaaacttcgcctcccgggttcacaccattctcctgcctcagcctcccgagtagctggtgctacaggcgcccgccaccacacctggctaattttttgtatttttagtagagatggggtttcactgtgttagccaggatggtctcgatctcctgacctggtgatccacccgccttggcctcccaaaatgctaggattacaggtgtgagccactgcgcccagcctaatgtagtttttaccttttgcattcagatctttaatccatctagattccactcttgaatatggcatacggtaggctccggttttattttcttccatatagtaggcagtttttccagtaccacctcctaaatagtccattctttctttattgatctgtggtacctcatctgatttcaggttccctcatgtacatggatccgtcttgagtgatgtgatttgttccattggtctatttgcacattcttgtgccagcaccttactgtttttattattatggctttatagaatgtcttagtagctcctttgcacttatttttcaaagctggtttaatcatttatggggctttattatatatcaaaagttatcaaagtccctcaaaaacaacaagaattttgatcgatgttacactgaacttctctattaatttggggaaaattatctttgtaagtagtcatttcatctaagacctttgtagagaatattttgaaatttatgtaaagagcataaaaagctttcattttcataaatggaaatacaggtcttatgtattctttgttaaagtaatccctaggtacttcagtcactttcattatctttttttttttttctcgagacttggtcttgctctgtcacccaggctggagtgcagtggcgacctccacaggctcaagtgatcttcctacctcagccttccaagtagctaggactacaggcacgcaccaccacgcccagctaattttttgtagagacggagtttcaccatgttgtccaggctgatcttgaactcctgagctccagcaatccacccaccttggcctcccaaagttctgggattacaggccattatcttattttttaaaaaatatttttcatgctggtatttgctggggtagaggaaagctgttgatttctgtaagttacccctgctgtatgcccttattatttctaatacttcattgttgattctgatgttctttctaagtagttggtcatattgtatgcaaatctatcctgtcacttatttatttttcttcatttatagtattgtccaggacttttagtaccatattaaatagtataagtgatactgggtacacaaattaagatttactttggctggttgtggcagaaagtccaaaggataatggcttagacaagatagtttacttttctttcccataaaggcagtctgcagaagagcaattaatctagggctgacaggcagccccttctgtgtagccatcctcagcacatggcagttgagacagtaggaagaagggagaggaataaaagggaatgtgtctaaagtttctccattaagtatggtgcatgcagtaagtttttagaatgtatcctttaataaatcaagaaaattatctaatcttcgtttgctaagattgaccataaataagtattgaacttcaaaatcctgtgctttttttctccctttgtccattaatttcataaattgtggcctggcatggtggatcacagcaccttgggaggccaaggtggttggatcgcttgaggccaggagttcaagaccagcctggccaacatggtgaaacctcatttctactaaaaataaaaaaatcagccaggcgtggtgaagcatgtctgtaatcccagctactggggagactgagacatgagaatcgcttgaacctgggaggtggaggttgcaataagctgagatcgtgccactgcactccatcctgggcaacagagtgagactccatatcaaaaaaataaataaaaattttgtaaattgcattaaatgatatccttggcattcttgagctataccccacttgatcatggtatgtatgtatatgtttatgacttcttactttgaaaatatctcaaatttacagaaaggttgcaagaaaaagtataatgaattcccatatatcctctactcagaattacttgttttaagtattttgccacatttgctctatcactctatatctttttttttttttttttttttttttgagacggaatcactctgtcacccaggctggagtgcaatggcgtgatcttggctcactgcaacctccgcctcctgtgttcaagcaattctcctgcctcagccttccaagtagctgggattacacgcgcctgccagtacgcctggctaatttttgtatttttattagaaacgaggtttcaccatgttggtcaggttggtctcaaactcctgacctcaggtgatccacctgcctcagcttcccaaagtgctggaattacaggcgtgagctaccgcgcctggcccaccctatagctctatatctttacatagacacacacacacacacacacacacacacacacacacacacacgttttttttaatcgtttgagttggtggcagccatgacttttctttttgagtcagagtttcactcttgttgcccaggctggagtgcaatggtgcaatctcggcccactgcaacctcttcctcctgcattcaagcgattctcctgcctcagtctcccaagtagctgggattacaggcatgcgtcaccacacccagctaattttgtatttttagtagagacaggatttttccatgttgatcaggctggtttcaaactcccgacctcaggtgatccgcccatctcggcctcccaaagtgctgggattacaggcatgagccaccacatccagcctgacatgaccttttaagtctggcagcatgtacgtcttaagaacaaaggtgttctcttccataaccacaatatacttatcaatatcaggaaattaaacaattatatagtacttttattctatataaagcccatattcagatgttatcactcttctcaataatgtcctttataatggttttccccaatccaggatccagtccaagatcatgtattgcattgagctccttgtctcctttaatctgaaacagttattctatctttgtcttttatgaccttgtcatttttttttttcctgaacctatggattatattgaaagcatgttttaaagttagttgttttatagaatgtttctcagtttggatttttctgatgcttactcatgagtttttggcagaaatgttatttaagtgatttatgtatatttttaaaaccttgttagattttattagccattgtatcatctaggatatctacacctgtatttatcagtgaggtagtccaatatttttattttcagtatttatctggcattggaatcaaggtagcctcattacatgaattgggcagcctttgttattctctctttattggagaaacttgtataagaattatctgtacctcgaaaaacttggtaggactcacctttaaaagcatctggaggctgggcgcagtgggctgaggcagttggatcacttgaacccaggaattcgagacgatcctgggcaacatggcgaaactctgtctctacaaaaaatacaaaaattagctgggcgtggtggcaggtgcctatagttctaactactcaggaggctgaggcaggaggattacctgagtctgggaggttgagactgtggtaagccatgatcatgccactgcactccagcctcagtgacagagtgacaccctgtctcaaaaaataataaaataaaagcatctggagctggtttttgattaccatttcatctcttctgccaattttagcattttatattttctagaaatatactcattttgtgaagatcctcatatatgatgattcagtccagcatcctagaaatgctttataaaagggatatgcctttggaaggtgtttgttcagagtgctttggtggccaattaaaaatattcctttctatccaaatatgttcccttcctgagtttagatagcaagagttcaatacctgaatttatttggtttggatattggatgtcaagagagttcaggataatttcatctgaaaatttataaatttattcatatctgttcagttcttgattttttttccttttttttttgtttgtttgtttgtttgtttttgtttgtggagatagtctcactctgtcttccaggctggagttcagtggtgcgatcttggctcaccgcaacctctgctttccaggctcaggggattcttgtgcctcagcttcctgagtagcaaggattacaggcccgtgccaccacacccggctaatttttgtattttagtagagacggggtttcaccatgtttgccagactggtctcgaactccgtacctcaggtgatccactcgcttcagcctccgaaagtgctgggattacaggtgtgagccaccatgatggcccagttcttgaattttgatgactacagttcaaattgattgtatcaagaaccttataactactcataccactgacagtgatttcttctctaggcatttacggtagggaaacaatttggggccaggtgtggtggctcacgcctgtaatcccagcactttgggaggccgaggcgggtgaatcacgaggtcaggagtttgggaccagcctggccaacatgatgaaaccccatctctactaaaaatacaaaaaattagctgggtgtggtggcaggcacctgtaatcccagctactcgggaggctgaggaaggacaatcgcttgaacccaggaggtggaagttgcagtgagccaagatcacgccactgcactccagcccggaggacagtgcgagactccctctcaaaaaaaaaaaaaaaaaaaaaagagtttgggttccaagctgagttcgtggggacagggactttattttgttcacagcagtatccccattacctagaacagtacttatcgtatagccaatgttaggttaatatttgttgaatgaatgcatgaacaaataattgtttaaaaaaatggaagtcaaccaaaatgtttgaaaacatgtttaatggatatttgccccatttgttacttatctttatggtgttttccatagtttagtgtgaaatttcaagcatgtagcaaagtttaaagaattttacaatgggcctggtgcggtggctcatgcctgtaatcccagcactttgggaggctgaggtgggcagatcacgaggtcaggagatcaagaccatcctggctaacacagtgaaaccccatctctactaaaaatacaaaaaaattagccggctgtggtggcgggcgcctgtagtcccagctacttgggaggctgaggcaggagaatgtcatgaacccgggtggcggagcttgcagtgagccgagatcgccactgcactccagcctgggcaacagagcgagactccatctcaaaaaaaaaaaaaaaaaaagaattttacaatgaacaccatatatacccatccactagattctttttttttcttctttctttcttttttttttttttgagatggagttttgttcttgttgcctaggctggagtgcaatgacacaatctcagctcaccgcaacctctgcctcctgggttcaagtgattctcctgcctcagcctcccgagtagctaggattacaggcacgcgccaccacacctggctaattttgtatttttagtagagacggcgtttctccatgttgctcaggctggtctcaaactcccgacctcaggtgatctgcctgcctcggcctcccaaagtgctcggattataggtgtgagccaccgtgcccagcccactagattctactattaacgttttaccatacttgctttattacatatttacttctaagtttctcgtattttttacactctatagagatttataatttttacaaagccagatttattcattttccttttatgactgctgggatttgtcttgctgaggaaggccttccccactcttaaggtgatacatttttttcttatgttttctaatatttgttttctttttttaaaagttcaacttttattatagattaaaggatacacatacagtttttttttttaactcagtgaagatgtctgcacagcaggaatcatgtgggatgggatggccctttttcctaacgctggaccacttgatgttctcttccatcttcccccaaccctcatttagatcatgacatcagaaaatcaggttaaagttaagaaaaagaagaatcagatcattggggattcttagtagtagcatcgccattgggagctgctagcccagcgggtattccccatgccacccctctggatcttggctccatgggtactgggaggaggccttgttggccagggaggccacgctgtgctgctagaagctgggcgacatactggtggtgcagcagagtctcgggtgcggcagcttggaggtactacccacataggcattggccttccagggtgcatcctggcccatcatgctgctgcagcagctgtggctggtgctgcatgtctgcttgcctgctaggctgctcgccggcttggccaggagcttgctgtgcctcagtggggccacatcccctgtggctgctgtggctgtgctctggtcttggaaaatggtggcgatgtggttccagaggtctgtgaagaacctgctcacaccctcgtaggctgggaaggcgttgatgtcgatgacggcatgctgccccatctggttgttgatgatgatgtcggtgccgaacagcaatactcccagtgcctgccgcagggcccgggggagttcccggatgacctctttgctcggctgctcttgaacagaccagaccccttgatcttgtccagctccatcaggaccaatgatgactctggctttgacacactgtggctattgaggaagatggattcgtggtcacattgtgtccgcggagaatttcttgagcaagggcctctggaccacggtgtaggacttgctgaccacgaacaccttgtacagaacggtgttgtggttgatgaaattctagaccacacagggtggctgtatgccattcaggccctcctgattgaatacagtagacatctcgtgagagttggtgccgtgagccactctagttttgcacatgaacaggaaagccaggctgttcttctccagcagccacatggtgtcatccccgcacaggcttgtgacctccatgaagggcagcaagcagatcctgccgccttccatgtagatctcaatcttccagatgagtttgcaggacttggagcggtcgagcagggttctgacggcagggaaggagtccaggacgatggtttcagggtgggcatcgatgtagtcctgaaacctgtgcaccagctccagggactggctgtcattctggtcggcttcaaggatgacatcagtcaacttgtgaatgatgacgtccaggggtccctgctcctcgattggccggctgaggttcagctgcatgacttttttttttttttttttgagatcagtctcactcagtcgcccaggctgaagtgcagtggtgtgatctcagctcgttgcaacctctgccccccaggttcaagcgattctcctccctcagcctcccgagtagctaggattacaggcacttgccactacggctagtttttgtatttttagtagagacagagtttcaccatgttggccaggctggtcttgaactctcgacctcaggtgatccacccgcctcggcctcccaaagtgctgggattacaggcgtgagccaccgcgcccggcctcagctgcaccacttctatccctcacttcctgcacacctccgctaaagccgggaaattgagcttcttgattttcttctcatgcagccagtagccaactctcttccctttcataaaggtctatatcttcctcctcgggcaaggagcctgggtcctgaggaaattgcccataggctgagtctgttggccagtgagcgctgggagcgtgcgggcaccccctggtggcaggggtgtggaaagggctcggggtgcggggttagggccgcgtggtgtcacggtctccacaacccccccacccctggccacccagctggagctcacggcccacatacaggttgttctttttttcatacgcagtttcactctgtcgcccaggctggagtacagtggtgcgatcggctcactgtaacctccgcctccctggttcaagcaattctcgtgcctcagcctgcccagtagctgggactgtaggtgtgcaccaccatgcccagctaattttggtattttttagtagagacgaggtttcaccatgttgcccaggctggtctcaaactcctgacctcagtgatctgcccccctcggcctcccaaagtgctaggattacaggcatgggccaccgcatctggcctgtacaggtttttttacatgggtaaattgcgtgacactgaagcttgaggccccgttgatcccatcacccaagcagtaagcttagttcccgacagatggtccttcagcccatgccccccttcccaccttcccggtctagtgatccccaatgtctgatattccaatatttacattcatgtacattcaacatttaactcccatttataagtgagaacatgcagtacttggttttctgttttcgtggcaggtggcttaggataacagcctccagctccatctatatggctgtgaaggacatgattttgtcttttttatggctgcatagtattccatggtgtatatgtaccacatttttctttatcctgtccactattgatgggcattcaggctgattccatgtccttgctattgtgaatagtgctgcagtggccaggcgccatggcccatgccagtaatcccatcactttgagaggccgaggtgggcagatcacctgaggtagggagttcgagaccagcctgaccaacatggagaaacgccatctctactaaaaataaaaaattagccaggcgtggtggcacgtgcctgtaatcacagctactcgggaggctgaggcaggagaatctcttgaaccaggaggtggaggttgcggtgagccgagattgcaccattgcactccagcctgggcaacaagagcgaaactccgtctcaaaaaaaaaaaaaaaaaaaagtgccgctttgaacatgggtgcatgtgatagaataaattattttcctttgggtatatacccggtagcaggattactgggtcgaatagccaaagcaatcctaagcaaaaagaacaaagccagaggcatcacattgtccaacttcaaactatactgtaaggctacagtaatcaaaatagcatggtcctggtgcaaaaacagacacataaaccagtggaacagagtagagaacacagaaataaacccgcacacatagaaccatctgatctttgacaaaatcaacaaaagtaagcaagggggaaaggactccctgttcaataagtgctgggataggtggctagccatattcagaagaatgaaaccggacccttacctctcaccatatacaaaaattaagatgtaagacctcagactataaaaatcctagaaggccaggcgcggtggctcatgcctgtaatcccagcactttgggaggccgaggcaggcggatcacctgaggtcgagagttcgagacgagcctgaccaacatggagaaaccccatctctactaaaaatacagaattagccaggcgtggtggcgcatgcctataatcccagctacttgggaggctgaggcaggagaatcacttgaacctgagaggcggaggttgcagtgagccaagattgtgccattgcactccagcctgggcgacaagagtgaaactctgcctcaaaaaaaaagaaaaaaaatcctagaagaaaacctaggaaatgccctcctcgatacagggtttggcaaagaatttatggctaagtccccaaaagcaattgcaacaaaaccaaaaattgacaatttggacctaattaaacagcttctgcacagcaaaagaaactaccaacagagtaaatggacagcctacagaataggagaaaatcataagctacacatctgacaaaggtctaatatccagaatctacaaggaagttaaatcaataggcaaaaagcaaaatttccaattaaaaaatgggcaaaggacatgaacagatacttctcaaaagataacatacaagtggccaacaaacatgaaaaaatgctcatcatcactaatcatcagagaaatgcaaatcaaaaccacaaggagacaccgtctcatgccagtcagatggcaattattaaaaagtaaaaaaaaaaaaacatgttagtgaggctgcaaagaaaagaatgcttatatactgttggtgggaatgcaaactagtttggtcatgggagaaagcagtttcgagatttttttttggagagagagatttctttaatatttttatggtttctatttgggaatttaagttttcacccatccataatttatttggcgtaagaagtgaggtaaactttgttttcttagtgggcaacacttttctgtgaaggatcagatagtaaatatttttggcattgcattgcaggactgtctctgttgcaactaaactgaaagcagtcacggacaatttatgaatgaatgaatatagctgtgttccagtaaaactttatttaattaattttttttttgaaacaaggtcttgctgtgttgccctggctggctggagtgcagtggcgcgatcagagctcactgcagcctctgtctccctggctcaagggatcctcccacctcagcctcacacacagctaatttctttctttctttctttctttttttctttttccagtagagacgaggtctgactactgtgttacccaggctgggtctggaactcaagggttactcctgccttggccttccaaagtgttgggattacagatgtgagccactacatctggcctccactaaaactttatttaaggagactggatttggtccactggctatagtttgctgattcctaggccagatagttattgtaactattatttattgactaatttgttttccccttgttagtttgaaatataacctttggcttatactgaatttccaagtgtgtttttgtatgctgtagattctattctatttcactgatctgtctattcatgttttaattaatttacctttataatgttttaatatttgctagagttcctctcaactcattagttttttttttttttttttttagtgagagagagagagagagagagagagggtctggctttgtcgcccaggtgcagtggcgcgatcatggctcactgcatccttgacctcctggcctcaagtgattctcctgcctcagcctcccaagtagctggggatacaaacacgcaccaccacgcctaactactttttgtatttctttgtagagatgaggttttgccatgtcacccaggctggtcttgaactcccgggctcgagcgatccgcccacctcatcctcccaaagtgctgggattaggggcatgagccactgctcctggcttatcctttgttttttgtttttgtttgttttgagacagagtctcactctgttgccaggctgtagtgcagtggcgcaatctcggctcactgcaatctttgctccctgggttcatgagattctcctgcctcagcctcctgagtagctgggattacaggcacgcgttaccacacccagctaatttttgtatttttagtagagacggggtttcaccatgttggccaggctggtctccatctcctgatctcgtgatccgcctgccttggcctcccacagtgctgggattacaggcgtgagccactgcgcccagcctgtcctttgttttttaaaacaatgctacagtaacttttttgtacatgtgcaagtatgtgtatactttaaattcccagaagtagaactgtgggtcaaagggtatatagatttttagttttgtcagctattgccgaattctcctctataaggattattccatttttaactcctaccagcaatatgaaagtacctgttttccatacagtcttgctgtttgttttcaaacattggactgttgtaaatctgttagattaaaaatgttctatcaaatcttccttactagtgattattgtatagtacaatactatattatttaatagttatcataaataataattttaatataactccaaataatgtagatactccctcctctaggaggtagagcttaattaccctccttttgactgtgggctggtcttagagactcacctctaaagaatagagtatggaggccgggtgtggtggctcacgcctgtaatcccagcactttgggagggcgaggggggcggatcgtgaagtcaggagatcgagaccagcctggccaacatgatgaaaccccgtctctactaaaaatgcaaaaattagctgggggtggtggcaggtgcctgtaatcccagctacttgggaggctgaggcaggagaatcgcttgaacccgggtggaggttgcaatgagctgagatggcgccaccgcactccagcctggcaacaaagcgagactccatctcaaaaaaaaaaaatagagtatggagagagaaatagagaaattttacagggaagaaacctggcagacagcaccttaactaggtgatcatggttaacatcaccagagataagtcatgttgttatcatgtactcttctgtgatatgatcagaagggcatttcactatctcacttctgttgtatgcttctccaaaaaaaaaaaaaaatccataatcttaggtctaatcatgagaacacatcaaacaaaaccagttaaagggcattctacaaaatacctggccagtgctcttcaaaactgttaaggtcattaaaaacaaacaaggacagactgataaaccttcacaggccagaggagactgagggaacatgacaactacatgtaatgtaatatttaggattaaatcttggatcagaaaaaggatattaacgagaaaattggtggaatcctaatataatctgtagtttagttaattccttagttttgacaaatgtgccttagttttgttaatattaggggaagctgggtgaagggtatacagggattctttgaacttttctgcaaatgtaaaattatttcaaaataagaagtttgacttcatcaaaattagaaacttttgtttatttttgttggttttatagcgatgagttttcggtatgttgcccaggctggtctcaaactcttgggttcatgtgatccgcccgtcttggcctcccaaagtgctggaattacaggtgtgagcccaccacgcctggccacaattagaaacttttggaagtctctctgaacctattctggttcagggactgctggtaacaacaacaaaagattagaaacttttttttttgagacgtagtctcactctgctgcccaggctggagtgcagtggcgcgatctcggctcactgcaagctccgcctcccaggttcacgccattgtcctgcctcagcctcccaaatagctgggactacaggcgcctgccaccacgcctggctaatttttttttttttttttttttttttttgagacggagtctcactctgtcgcccaggctggagtgcagtggcgcgatctctgctcactgcaagctccacctcccggattcacgccattctcctgcctcagcctcctgagtagctgggactgcaggcgcccgccaccacgcccggctaattttttgtattttttagtagagacggggtttcaccgtgttagccaggattgtctcgatctcctgaccttgcgatctgcccacattggcctcccaaagtgctgggattacaggcgtgagtcactgtgcctggccgattagaaacttttatacttccaaagacactatcaagaaagtgaaaagacaacccacaatgggaaaacatatttgtaaataatatatctggtaagggattaacatccagaatatatgaactcttacaacaacaaaattatccaatttaaaaatgggcaaaggattcatgaccagcttgacttaacatggtgaaacccctgtctctactaaaaatacaaaacatcagccaggtgtggtggcaggcgcctgtaatcactgctactcgggaggctgaacctgggaggcagaggttgcagtgagctgagatcatgccactgccctccagcctgggtgacagagttgtactccatctcaaaaaaaaaaaaaaaaattggcaaaaggacttgaatagacatttctccaagaaagatatacaagtggccagtaagcacatgaaaagatgcaaaataacaagtgttggtgaggatgcggggaaattggaacccttgtgcaacactggtaggaatgtaaaatggtacagctgctgtggaaaacagtttggcggttccagaaaaagttaaacacaggattaccatatgatccagcaattccactcctagatatatacccaaaagaattgaaagcaataattcaaacagatacttggacaccaatattcatagcagcgttattcacaatgtccaaaataaccaaggggtggaaacaacccaagtgtgcacgaacagatgaatgaacaaaatatgcatactacaatagaagagtattattccaccataaaaaggaaggaaattctaacatactgccttgtggatgaaccttgaaaacatgccaggtgaaataagctagacacatagggacaaatatatgattccactactatgaagtacctagaataggcaaattcattgagacagaaagtagaatagaggctgtggggtggggtgagaattgtttaatgggtacaaaggttttgtttgggatgatgaaaaattcctggaaaaggtgatggttgcataacattgtcagtatacttaatgccactgaattagataattaagaatggttggctgggcgcggtggctcatacctgtaatcccagcactttgggaggccgagacgggcggatcacctgaggtagggagttcgagagcagcctgaccaacttggagaaaccctgtctctactaaaagtacaaaattagccgggagtggtggtgcatgtctgtaatcccagctactcgggaggctgaggcaggagaatcgcttgaacccgggaggcagaggttacagtgagccaagattgcgccattggactccagcctgggcaacaagagtgaaacttgtctcaaaagaaaaaaaaaaaaaaagaggctgggcgcggtggctcacacctgtaatcccagcactttgggaggctgaggcaggcggatcacctgaagtcagaagttcgagactggcctggccaacatggtgaaactccatctctactaaaaatacaaaaattagccaggcatggtggcacacacctgtagtcccagctactcgggaggttgaggcacaagaattgcttgaggcccggcccagtggctcacgcctgtaatcccagcattttgggagaccaaggtgggcagatcacgaggtcaggagttcgagaccagcctggccagcatagtgaaaccccgtctctactaaaaatacaaaaattatccgggcgtggctgcgtgcatctatagtcctaactactcgggagactgaggcaggagaatcgcttgaacccaggaggcggaggctgcagtgagccgagattgtgccactgcactccagcctgggtgacagagcgagactccatctcaaaatttaaaaaaaaaaggatggttaaatggtaaatgtatattttaccacaatacaaaatgatctagaaaaaatatacaaaaattaaaattttaagtttattttaggccatgtgcagtggctcccgtctgtaatctcagcactttgggaggctgaggcgacaggctcactttagtccaaaagttcaggatcaggctgggcaacatagtgaggtcctgtatctacaaaaaatttgaaaattagctggatgtggtggtgcattcctgtagtcccagctggttggggctgagatgggaagattgcttaagcccaggaggtggaggctacagtaagctatgattgcaccactgcactcagcctgggcaacagaccgagaccttgtctcaagtaaaataaaatttattttgaaacagtctatccaatgtagttttaattctcatctttctctctctcttttttttttttcttgagatggagtctcgctctgtcactcaggctggagcgcagtggtacaatcatagctcactgtaacctagaactcctaggctcaagcagtcctttcgcctcagcctcctgagtagctgggactatagatgtacaccaccatgcccaactaatatgttgtggtggtgatggtggttttgtaaagacgggatcttgctatgttgtccaggctggtcttggcctcgagcaatcctcccactttcaccccgcaaagtgctgggattacaggatgagccatctcacctagcaaaattttcttttttttttttttttgactgagtctcgctctgtcgcccaagctggagtgcagtggtgcgatctcggctcattgcaacctccgccttctgggttcaagcgattctcctgtctcgccctcccgagtagctgggactacaggtgcgtgtcaccacacccagctgattttttttatttttagtagagacggggtttcaccatgttagccaggatggtctctatctctggaccttgtgatccgcctacctcaccctcccaaagtgctgggattacaggtgtgagccaccgcgcccggcaaaattttcatctttcattatgagtgagatagagcatcttttcagatacacatcattgatatttttatctgtgaattctgtttacttcctttccccatattttttcctagtttattgtcttttgacttggttaatgatgttttttatttttctgtttttttctccaagcaaaagtattttatttttatgtagttgaatttagtaatcttttctgtggcttctggatttggattataggtttccccatttcaagattataaagaaattattcagttattctatattttcttttatgatttcatttcttttttttttttttttttaagacagagtcttactctgtcacccagactggcagtggctcaccgcagcctccgcctcccgggttcaagcgattctcctgcctcagcctcccaagtagctgagattacaggcgtatgccaccacacccagctaatttttgtatttttggtagagatggggtttcaccatgttggccaggctggtctcgaattcctgacctcaagtgatctgcccacctcggcctcccagggtgccacccacgcctggcctatggtttcatttcttatgtttaaatctttgatctatttcaaatatatcctggtatatatgtgaagtatagtcataatatcttgcacatgtctaggtatttaacctttttgatgaattgtacttgggacctttctattttctaaacagtggttacattaatttgtacccagcatccttactgatttattatttataacaagtttttcagttgattctcttaggctttgcaggtatactctcatatcatttacaaataatggtaattttaccttctcctttccagcttttaacctcttttcttccttccctgtttaattgctttagctagtgtctttagaataatgttaagaatgctgttgataacggacattctaatgttgttcccgaccagaattggaatcctgttagtatagtagcattcttctgtggcatctagttttttctattttaaataaacatatattggttgctcttagaatgcttttttagtcattatttgttcaaaataattgttgagcgcctactgagtgctagggaatatggcagtgagctaagggtcccctcatttcctggagcccatattctagtaattttttaactcaccaaagaaacacagattaggccatgcacagtggtggacgcctgtaatcccagcactttggaaggctgaggtgggtggatcacttaagcccaggaatttgagaccagcctggcaatgtggtgaaaccccatctctacaaaaaatacaaaaatgagctgggcgtggtggtgcgtgcctgtggtcccaactactcaggaggctgaggtgggaggatggcttgagcttgggaggttgaggctgcagtgagccctgataatgccactgccctccagcctgggcaacagtgccagatccattctcaaaaaaaaaagaaaagaaatgcagatgaaatcagctttgagatcattattttacagttattgcggtaggagaaattttaatgaaagagctgctagtgtcggcaaggtgacagtgaagcaggggcaggggacgtggtgcaagacagggaggaggagcctcacccccggggatcctgcaagccgaatgagaccttggtgagcattttggtatttgatcctgagactgagggggagccactaaagggagtgagatgggtttgagtggctttgccttagaaagcactcacatttgggatttgggatgtagagactgaactggggaggtccaggtagaagtgaggagaacagccaggccacaaccaaggtgccccatgagggaagccagtggcatggaccagagagtgacatagggatggagagaggcaggttgcacttcagagatgtggagcagggatttaggaatccctgtatgggggcgggcctgagggcttccaaagaatagagtagggggagggaaaaatagaaagtttacagggtgagaaacctggcagacactgccttaaccagatgaccatggttaacatcaccagagctaagtcatggtggtatcatgtacttctttctctgataggatcagaagggcacctcacttctgttgtatgctcctccaaaaaaaccaaaaccctacgagaacacatcacctgggcctcttgcaccttttagaaagggcaaccttctgatccctccccatccttcttcctccactagtggtggtcgtggtgacaggactggccgctatggagccactgaccgctcgcaggatgatggtggggagaaccgcagccgagaccacgactaccgggacatggactaccgttcatatcctcgcgagtatggcagccaggagggcaagcatgactatgacgactcatctgaggagcagagtgcggaggtgaggagggggcgcgctgcgccaggcctggctgggatgggctcccaagggccctctgtgtctggctgcagcaccgtgtgcaggcagctctccactcccgtgccttcagactgtgctcggtggctttgcctcacctggagggcctgttcccactcccctctctgagggctcctctcccaacctgggtctccctggcttccacatgcttggctctgtacttctgagggcccctggccaccactctttccctttctccctgttgttcagttcgggcccatggctcactgtgaaccctgtactgcccgctcccagccaacttgggcacttgaagagcctcttccatgggacccggcgtctggggttgggaggacaacaaggggactgcagaccaccaagctgaggagctctgggaggccagccatgggcattcccagtggtgatagagcccctagacagaagggaaggacccttctggagaagccagtgccatgttgggtagttcaccctagcctgcgggatgaggcgcgatgtttacaccatcagggagcccccacccgaggggaagaaacaggcttgccttaggggaatcccagttggaggggcagtcagggacctggtccatgcgagcaggcagctctcctgtccagcaggctgggaagggagttcttgcaagcccagccctggggggcagtctgtgagctgcccactgccctctggagggtccagggcaaaaacccctttggtggactgccaggcttctccagtggcagctgtcaagctgtgcccagacgtctccaggagcactgggccctggccagggtgggaatggagcaccaagttatctggtgcttccccactgtgggcgggagggctttggccccaggcctgctctgcttagtcctggaatggatggattgggcaacagcccagagcccaacagccataccgttttgagcgtggtgtgtggtggaggactggccaaggctgaggatcagggactgaggagggagtgtctgcagccctcacaccacctccaccagctcctgctgcctggctctggctgagatctgaagctgttcttatgcccccagcttggttgcagggtggaaccgtaggagacatgcagccttcggtggtacagtgaagcaattgagcacaccccctgagctggccagagaggagaggaaaatcaagggtggggtctggtgtgctgaccccaggccatcttgccccaaggaggtttaagctgtgtcttgtcagctacctttgggagttccccccacaccaatactgtcacctacctctccccacccactgaaggcagcccccaaaaggaccccatggagaatttacagtcccagaaagattgcaggccggggcctgcccaccctgcctgcctgagcctttagccggagcccgcacatccctggctttcagagcctgcctgcctcacagagccagcggccagctcctaggcctgcccagactgactgcccgtctggtgtcactcatctcattctgtcggccaggattcctacgaggcctccccgggctccgagactcagcgtaggcggcggcggcggcacaggcacagccccaccggcccgccaggcttcccccgagacggcgactatcgggaccaggactatcggaccgagcaaggggaggaggaggaggaggaggaggatgaggaggaggaggagaaggccagtaacatcgtcatgctgaggatgctgccacaggcagccactgaggatgacgtacgtgccccccatggccccgggcaggaggccaggctgggtctcctccagggccctcaacttctccccacccctccctcacctgcaacctcagcgcctttcatcccttctccccctccagctcctatcccccagcactgatccgtcctctgtgggcaggtcccatcggccccccggtctggagggaggagtgtcagagaggccggcttggccaagggacattggccatgggtgtctggtagtggtgggtatgggcgggagaagagcagtcctgcacattccactggtcatccagccattttgcatgtgtgcatcatgggccagacgctcaccgggccagtgctggctattgctggtagcagagatgacactggggccctgtaaccattgggggagggatgggattttctgaaatttccttctctttttcccccatccttttttgtcagcagcctggcctggcctcagagccttgggtggctgctaacagcctccacgcctgcctccctttcctcctgtttccttttcatacatacttctcatgacagccacactgaagccccacgaggcctaccagaataacctccaagaatagtgtcctgatcttggtccttcttagtctactccgccgcccctcaccccctacccccatgaattctctgatcagccctcctctgaaatctgctagctgctcattttgtaacagagaaaatcccacttgtgtatttgagggtttctaaggtctggcccacctgccctgttcagggtcagacagtagctggttgctgacatttgttgagaatgtatctcagggtgggccatgtgttaggtatgattcagtccccatggcagcccagcagggaaggtactctttgtattccatccttcggatgaggaaaccaagccctgagtgggaatgtgacttgccccaggtctcatagccagtgagtggcagagcagagctggagtctgaacccgggcagctggaccctagagcccactttttgctgcttcctcagccttccctgagtttggagtcctgataagctcttctgtgtgtttttccttttcaccctgtgtatgggtgtgtgtaaggctaatgtcctgtctgttgtttaacctggtggggaaactgaggcccagagacatgaagactccttcccaagaatggctggcataggctcctggtcctcagtgagagacctcactggcctagagaccctgcctcacctgggccaaatcctgaattgcctctgcagtttccctctggcctactccatctgggaagcaatccccaggactacatctttttgctttttgtctccaccctaagttattgctacagtcatggtctagggcacatggctgggatttgctcagactcctgtcctccccagtttgacatttatgtcatggatctcttttgacgcaagctgcaggtcagcagggcaggggcgggggtgcgggttatccccttgccaagggcaagaattgcatcccaggtttccttacttcgtggctgccagcgagccctttgtcagatcaccctgcccaccgttcttaagtggctggctcacttgctctcttgttctctgtgcccctgagggtcgtcctgctgccatgctttaccttgctctgtgcccatttcttcatttgattcactttctgcaagtctggggctgaaagtcaagactgtgaactggtgtgggcctggggctgttgtcactcagggaaaagctgcgaaagaggcggaggagactgtgtgcacatcaccgatgacccctcgggatccagaggcctccagccagcctcaggtacccagcggccccattgtgctgagcctgccctactctgtatctccccgtatagatccgtggccagctgcagtcgcacggcgtgcaagcacgggaggttcggctgatgcggaacaaatcttcaggtgagcttttgttctagtgccctccccttcaagtggccagcctcagcctccgaatctccctcctgcctctgccttctcccccactccctccaccaccttcctgccacagctgggaatgggcagcgtggggggtgccctctcttctctcccactccccacactctcctcacagctccagccaaaagcctcttcaatggggctgtcggggcaggggtgcagctctgagctgagctgggtgctccctggggtcagggccagggccaggctcccaggcacctcctctctgggactctgagtatctgagatggtaaccccctcccatacactcccttccctctcctttcttctccttcctctgcccctcactttcccccacattttttggtaacagcctctgaccagaaagtagctctgacgtggtggtcccacatgtgtgtcccaagggggaagcaggggatggctcttatccaaggacacatcccaaggaacagccaggacttcctggcctcgcctgttccctccctccctccctcttgcaggctgcttggagctggcctgaggttagcagggtggtggtggggggagttgtctctacaggacctctgcccaggctccccaaggcaggcacagtggggcctcactctgcctgggcttctctctccatctctcagtctctcctccccacacctccatctctctctctctctctctctctctctctctctctctctctctctttctccctctctctctttctctctctctgccccccccaactatattattcattccatcctcctatgcatcctaacggttattcttttgaacattaagcatgcccccccaagcccctctcatccaagccctccccatgtatctgcctctaaaggacatgctatcctgaggcctcaaccctgaatccctttcccaagcctggaatcttggttgcatgtaggtcttgctctgcatcaccccaactacaccacacacggacagcttctgggtctctctctccacaaggaggtgttccaggtgcggccttctcaatggccctgggcgcttctcccaggcacccattgattcttacctctaaggtcctcctggccaatcctggccaccattctccttttgtccaggggaacctggactgtttgtggctgtagtctccaccctgtggccctgaggtggctccctagcgaggcccgcctcccctgcgctgcggtgaggctgagatgaggtcgtgtctttaaccgcccctggtttccaatgggccaagagccttcctagcctcgcagagcagcctggcccagcttctcttttgctcctgtgattcaacacctgttacaggacccctcctgggcacccctggccttgagctgggcccgccctggagttacgtattgtggcttgtgtggagccagcagcctgcccaccatcccctccctccttctttggaggcagatctctcgtattctttccctcccagctgcttctctccgtctctgtcaccccaggctggctgggcaggtctgcccgagccccatctctctcttcccagttggtgtgtgtgtctctccccctaccgacctctggcctctgtttttctccctccaccttccctgccccacctggccatctaccttgccccccacgcccgctagtctttctctctctgattgcctctttctctttcttcctttttcctcttcccctttccctctctgccccccgtcctctcccctcgggtcccgcccccgggaacgccgtgtgtccaaagctgttgactaacccactgcgtctgtatctgaatgctgtctccaggtcagagccggggcttcgccttcgtcgagtttagtcacttgcaggacgctacacgatggatggaagccaatcaggttgctttgccgcacttgaacccccccccaaacaaatactactttgtaatcgagcgctccccatcgcctgattcttatggacacagttccctgccctgtggccctgtgtcccatccccccgccccctctctccccttcctgaccctcactatctcctcttcccatctctcgctaccccactgggcttctcatccagagcccacactcaccactggccccttcctaccaccaggcactagtgctgccccttcacctctcccagctgagcgttcagagaaagagctgccagggtgggttctttcacctagcttcccactcccccggggctggtggggggggcacccctctctggggttagccagagccaggacctcattccaccctcaggaccactggaagtcctgccagtgaggagcttagctattggcacagtcactagcaagactcattttgtcagccccatccctgcatgtgaatttggccctttgattttcatgcaaggggacagcactgctctgttgatctcaagttcccgtcgagtatgatagttttatcgacaccctggcctcacttcgccgcccctacccttcctatcacatctccacactcgcaggaggcaccacctcaggcagctctgtcttctcggcaaggacctgtgcacagtcagccctggggggagcctgtcccccaagcctggcacgggatcccaactcagcagctttgggacctccgagacccaaagatctgcctggtcacccacccctgcccagatccctggtgtagggcactggagagcagtttcaggggaggaaggggcagaggtggtagaatgggggatcccggcagaggcagccctggggccgtctcctcggggttggtaggctagtgccatgggcccaggacccagccatccatgggaagacggcctcatggcagaaacttccatctgttcgaaatggctctttctttttccccttctccagcactagcgcacctgcgctctctttctctttttctcccctctccctccccctccctgtctcccctcaccccccaagtgtagcctgtgtagtcctggccctgggtgtggcctggcagtgtcagggccgagtgggggtttctccccactgtccggcaagcgtcggtcagccgaacactgtgtgcctggtggtgtgtgttcacatgtgtgcgtgcgtgtgcccggcagagcagcaaacagctgcgcccgagagctgtggcgctttccctccctacctcccttcttccctccatccgctctccgacctccctccgttccctgtccctcatccatccagctgaagggctcgctcactctcttctcctatgctgaaacggtgcgtggggcactgctgcctggacctcactgtgctctgctttttcccgcagcactccctcaacatcctgggccagaaggtgtcgatgcactacagtgaccccaagcccaagatcaatgaggactggctgtgcaataaggtacaggggcggtgggcagcagttgtcatggacagagacagcaacagcagtggcggcgatctctcccttcctctcccgctctttctccctccatctctccccctcccccaatctctcctctccctctgtctctctctctctctctctctctctctctcattctctatcccttgctagctcagcttgagtagtcaccattcctagccagccatatacaaatgtgtagtgagcgttcacttggtgcaggctctgtcctcctaaaatgcagtcttgcctggagttccagtagactttaaggaaatatatacgtggatgatgaattagtgacagtgtagacttgaagtggtggtgtggagaatgtgggcttcagagccagactggctgaaatgagactatcccagatcggccttgattttggccaaggtgcttagcctctctttgcctcactttccccatctctaaaatgtgaatattaatgacacctctcccaaaaggtggttgggaggattcagctgtgttaatgagagagtaacactcagaacagtgcctggcccacatttaacacagtcgaattgttaactgtaatcatgaaagaaaagcacagagcgttctgagagcccatagcaggtagctcaagcctgaaggccactctgaccaggccaagtcaaacctgaaactggaggctgtggttttgtagtcacctctgtcttccctgaggggaagctgaggctcagagaggtggaaccatgggtgaacctttagctgtgccctgtgccttgctcctgatcacagggacttggatgccacagtggcttcaggtctgccctggggccagcattgtgattccacagtttgtagaggccccaaccctctccccaggaagtactctgcctagtcagggagagtggtgcatctgttttaaaaaaaaaagtcccatcagaggattggtgcttaacatttctggagagataaagacaaagtgacagtggaactccttcctgtgtttccagatagcctcaaaaccagggaattctcttttttttttttttgagacaggatctggctctgtcgcccaggctggagtgcagcaatctgggctcactgcaacctctgtctccagcgctcaagccatcagcctccagagtagctgggaccacaggcgcatgccaccacacccactaatttttgcctttttatttttattttttttggtagagacagggtttcgtcatgtttgccaggctggtcttgaactcctgagctcaagcagtcctcacgcctcagcctcccaaagtgctgggattacaggcgtgagccaccacgcccagcccaaaaccagggaattctcttgaactccttcccctcccctgcatcctgttggccaccaggtcctgtcacttccatcacagaaacgccaccttccctccctcgccattcccgctgctcatgccaatcgtcacgctctcacccactcactgtggagccctctctggtatgctggcctcttgtcctctttctcccacgccctcacctggaacattcctcaaaaccacctctgactacccacgcctctcctcctctgcttaaccagccccagctcagcttaagcataagatcctccattacctaactggcttccttccccggccttggcttttgcttctccccttactctcccacaccagtttcggaaagtccattgttccctccgataacaatccctccccagcaaggcttaacaaaatgaaacttctgggcatcccaggtcaaacctccctgcttctgtgcagggactgtccctgccgagtaaatggcaccccacccccagcccatttccctccccgagcccctgctggatggtccatgcagaccgacctgcccctcttcatgctgcatctgcccctgtgctattaggccatgagggcagagaccatgttctggccatgtgcagcagggcctggcccaggagtggtgcttagtacctgagtctggaacagagatggagtgtggtagaagctgggtctccagatgctggaacattcaaggaaaatttctcaagcgtagcaggatccaacccagtcctagagctaagaggaggggtgcgggtctggctactgacttctagggctgaaacactgaaaggtttctgaatagaggagcaagtttcagggagaggaacctaataaagggattgaatacctgaggcggggaacagtcctgggagttggtggccttaagaaggcagaggaaggagaggagggagttgttgtaccaaatgggggagttgtttattcctgagctgagtgggttggcacagaggacaaatgagagtctggaaagggaagatgcacagtactgagaacaacatcagaaggttcagaaggcacctgccaccattgcctaggggctttccttcctggggcactgcggggtccctgggagatctcttcatccaagtttggagggtgcagtgggaaatccctgctccctctgacggcctggcctgtgcctcacagtgtggcgtccagaacttcaaacgccgagagaagtgcttcaaatgtggcgtgcccaagtcaggtgaggcccacctacctctcgtgctctccagggcggagcggttggggagaagggaagggtgaggggtctgtgctcagggcttggtatagggaggagggtgaccagtcgtggagccttccccttatcaccagcctgtctcccactgcccctgacagaggcagagcagaagctgcccctcggcacgaggctggatcagcagacactgccactgggtggccgggagctgagccagggcctgcttcccctgccgcagccctaccaggcccagggagtcctggcctcccaagccctgtcacagggctcggagccaagctcagagaacgccaatgacagtgagtcagttgttccttcttcctctgtgccctagggtgtcgggctgggctcaccaagaccagagaaatggcagtgagcaggacctcatcctcatggaatctccacttggtgcggggatagacatttgatgtagggagaacagggggagtggcaacatcccacctgactttgggggtgtgtcgggaaggttctcagcagacaggcagccaggctggcacctggaccgccaagcagagttgatcctggaggaagcagtgagggaagcggcagttgcaaaggcacggagtgagtgggggcagaggaaagggagcagtgggggcattgaagggcagggctggcaagagtgccaggggtgtcctctaacattgggccccttcccacagccatcattttgcgcaacctgaacccacacagcaccatggattccatcctgggggccctggcaccctacgcggtgctgtcctcctccaacgtgcgcgtcataaaggacaagcagacccaactgaaccgcggctttgccttcatccagctctccaccatcgtggtgagggcggcacagttgggggccgggcagccagggtcccggcccccggggtggagacgagggtccttttccccagcctcccaccgcggctgccagcctggaaatcgggcaatggagccgggggcctccccgggcctgacccttctgtccctgcctcccctcctcccacaggaggcagcccagctgctgcagatcctgcaggccctgcacccaccactcactatcgacggcaagaccatcaatgttgagtttgccaagggttctaagaggtcagggccccacctgtgtgccttcccacccttcccctccccaccctcccactcccccctaccgcttggggcctcctatctcactcccagtctctaacatcctcctcagggacatggcctccaatgaaggcagtcgcatcagtgctgcctctgtggccagcactgccattgctgcggcccagtgggccatctcacaggtactcagaccccttgtgcctcccagcgtcctgagacctgggctttctcaaccctcctgcaccctctctgaagcaggaaggctggcttgctatccatggatgcaaaaccctctcccagtagctggcatggctattctaccttgctcctggctctctagaccccctgggacattccccttcatcatcaccgcagctttcttcccaattgcctcccatgcgctcatgtacgacgccattgtgcctggcattctgtgctgtttggtggggtttttattgtcctgaataggtatgatatacacatatccttatatgtaatatatacatatatgatatacacgtatcatatgttcctgaataaaaataacgtataagtggttgagagaaaattgggagaagagaataaagaagtaagaagatggtgtcttccttggcctgacacccaacacacacgccacacacagcagaatcagcagaatcagccctggaacattttggcgttcatctgtttttctgtcttgtgtttgccactggcctatttgttctcttgtggccaggcaaccctcgctttccacttgtcttaaggctgcatgctttgtctgtcaggtagaaatactagccccacgtgtgggacagatgcttctagcaggttccccaccccccacccccacaccttcctgttctaatgaacccctcccacctgcccttcaggcctcccaaggtggggagggtacctgggccacctccgaggagccgccggtcgactacagctactaccaacaggatgagggctatggcaacagccagggcacagagtcttccctctatgcccatggctacctcaagggcaccaagggccctggcatcactggaaccaaaggggatcccactggagcaggtgagccccagcatctctctctgcagctgtggtgggggccagcaggcataaagtccccggccccattattcacaggcattgtccctgccctgtccctccttacaggtcccgaggcctccctagagcctggggccgactctgtgtcgatgcaggctttctctcgcgcccagcctggtgctgctcctggcatctaccaacaatcagccgaggcgagcagtagccagggcactgctgccaacagccaggtgagtgagccctgtgggtatgtatcccggggaggcaggcaggcggcaggggtggcatgggcagacactgagccctgttctcctgtctggccccatgaccagtcgtataccatcatgtcacccgctgtgctcaaatctgagctc

SEQ ID NO: 138 - DNA, 37099 bp, mus musculus; identical to SEQ ID NO: 137

(The sequence listing continues in the following parts.)

What is claimed is:

1. A method of activating an inactive X-linked allele in a cell, the method comprising administering to the cell
an inhibitory oligonucleotide targeting a PRC2 binding site in a region of a gene encoding the allele on the X Chromosome that is marked concurrently by H3K4me3 and H3K27me3 and coincides with a CpG island.

encoding Mecp2 on the X Chromosome that is marked concurrently by H3K4me3 and H3K27me3 and coincides with a CpG island.

17. The method of claim 16, further comprising administering to the cell an inhibitory oligonucleotide targeting a polycomb-associated RNA (pa-RNA) associated with Mecp2.

18. The method of claim 16, wherein the cell is in a living subject.

19. The method of claim 16, wherein the inactive X-linked allele is associated with an X-linked disorder, and the oligonucleotide is administered in a therapeutically effective amount.

20. The method of claim 16, wherein the cell is in a living subject.

21. The method of claim 16, wherein the oligonucleotide does not comprise three or more consecutive guanosine nucleotides.

22. The method of claim 16, wherein the oligonucleotide is 8 to 30 nucleotides in length.

23. The method of claim 16, wherein at least one nucleotide of the oligonucleotide is a nucleotide analogue.

24. The method of claim 16, wherein at least one nucleotide of the oligonucleotide comprises a 2' O-methyl.

25. The method of claim 16, wherein the oligonucleotide comprises at least one ribonucleotide, at least one deoxyribonucleotide, or at least one bridged nucleotide.

26. The method of claim 25, wherein the bridged nucleotide is a LNA nucleotide, a cEt nucleotide or a ENA modified nucleotide.

27. The method of claim 16, wherein each nucleotide of the oligonucleotide is a LNA nucleotide.

28. The method of claim 16, wherein one or more of the nucleotides of the oligonucleotide comprise 2'-fluoro-deoxyribonucleotides, 2'-O-methyl nucleotides, ENA nucleotide analogues, or LNA nucleotides.

29. The method of claim 16, wherein the nucleotides of the oligonucleotide comprise phosphorothioate internucleotide linkages between at least two nucleotides.

30. The method of claim 16, wherein the nucleotides of the oligonucleotide comprise phosphorothioate internucleotide linkages between at least two nucleotides.

31. The method of claim 16, wherein the oligonucleotide is a gapmer or a mixmer.

32. The method of claim 1, wherein the cell is a cell of a female heterozygous subject.

33. The method of claim 16, wherein the cell is a cell of a female heterozygous subject.

34. The method of claim 16, wherein the inhibitory nucleotide is complementary to 10 to 50 nucleotides of SEQ ID NO: 6030 or 6031.

* * * * *